United States Patent 11,931,406 (FLAVIVIRUS VACCINE) - sequence listing, part 35

SEQ ID NO: 13722 - RNA, 9879 nt, Artificial Sequence
  derived and/or modified CDS sequence (opt3) from DENV-1__FJ882529__SS-prME
agcgugaccaugcugcucaugcuuaugcccacagcccuggcuuuccacuugacuacgagaggaggggaaccucauaugaucgucuccaagcaggaaaggggaaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacguaaaguuuacagucgugguuggcgauguggcugggauuuuagcccagggcaagaagaugauccgcccucaacccauggaguacaaauauagcuggaaguccuggggcaaggcgaaaauaaucggggccgacguccagaauaccacuuucauuaucgauggaccaaacaccccugaaugucccgacgaucagagagcuuggaauauuugggagguggaggacuacggcuuugguaucuucacaacuaacauauggcugaaacuuagggauucauauacccagguuugcgaccaccguuugaugagugcagccauuaaagauucuaaggcugugcacgccgacaugggguacuggaucgaaagcgagaaaaaugaaacauggaagcucgcacgggcguccuucauugagguaaagacguguaucuggccaaaaucacauacccuguggagcaacggaguccuagaaucugagaugauaauccccaagauuuauggcgguccuaucucccaacacaauuaccgaccaggcuacuuuacucagacagccgggccguggcaucugggaaaacucgagcuggauuucgaccuuugcgaaggcaccacugugguggucgaugagcacugcgggaacagaggacccaguuugaggacaaccacgguuacuggcaagauuauccacgaaugguguugccgcagcuguacccugccuccauuacgguuuaaaggugaggacgggugcugguauggaauggagauaagacccgugaaggaaaaggaggaaaaucucguaaaaucuaugguguccgcuggcucaggugaggucgacaguuucagccugggccuucuguguauuucgaucaugaucgaagaggugaugaggucccgcuggucucgaaagauguugaugacagggacccucgccguauuuuuccugcuaauuaugggacagcugacuuggaacgaucucauccggcugugcauuauggugggcgcaaaugcuagcgaccguauggggaugggaacaaccuaccuugccuugauggcaacauuuaaaaugagaccuauguucgccgucggccuguuauuuaggcgccucacuucacgggaggugcugcuucugaccauaggucuaagucucguugcuuccguggaacugccaaacucuuuggaggaacugggggauggauuagcgaugggcaucaugauucucaagcugcuuacggacuuccaaagccaucagcugugggccacauugcucucccugaccuuuaucaaaacuaccuucucacuacacuaugcauggaagacaauggcuaugguccugagcauuguaagucuuuuuccccucugucugucuacuaccucccagaagacgacaugguugccggugcuguuaggcagccucgggugcaaaccucugaccauguuccuuaucgccgagaauaagauauggggaagaaaaucguggccacugaacgaagguaucauggccguuggcauugugucaaucuugcucucuagucugcuaaagaacgaugucccccuggcugggccucuuauugcaggaggcaugcucaucgccuguuacgugauauccgguagcucugcggaccugagcuuggagaaagcugccgagguauccugggaagaggaagcagagcauucaggggccagucacaauauuuuaguggaaguccaggaugacggaacuaugaagaucaaagaugaggagagggacgauacacugaccauccuccugaaggcuacucuucuggcaguuagcggcguguaucccuugucuauuccagccacacuauucgugugguacuuuuggcaaaagaaaaagcagcgauccggcguccugugggacaccccuucacccccagaaguggagcgcgcgguucucgaugacgggauauaucggaucaugcagagaggacugcuugguaggagucagguaggcgugggggucuuccaagaaaacguguuucauacgauguggcacguuacucguggagcuguguuaauguaccagggcaaacgccuggagccgagcugggccuccgucaagaaagaccucauuucuuacggugggggauggcgguugcagggcucguggaauaccggcgaggaagugcagguaaucgcagucgagccugggaagaaccccaagaaugugcaaacagccccaggaaccuucaaaacaagcgaaggugagguuggcgcuauugcccuggauuuuaagcccgggacuucaggauccccuaucgugaacagagaaggcaaaauagucggucucuaugggaauggagugguuaccacgaguggcacauacgugucugcaaucgcucaggccaaggcgagccaggagggcccacugcccgagauugaagacgaggucuucaggaaacgaaaccuuacuaucauggaucugcacccuggguccggaaagacccggcgcuauuugccggccauugugagagaagcaaucaagaggaaacuacggacacugauacucgcuccaacccgaguaguggccucagagauggcugaagcauuaaaggguaugcccauuagauaccaaacuaccgccguuaaaucugagcauacaggcaaggagaucgucgaccugaugugccacgccacguuuacuaugcgccuucugagcccugugagggugccaaauuauaacaugaucauuauggaugaagcucauuucaccgaccccaguuccaucgcggcacguggguacauaagcacacgggucggaaugggcgaggccgcugccauuuuuaugaccgcaacuccuccggguucuguagaagccuucccccagucaaaugcugugauccaggaugaggaaagagacauuccagagagguccuggaacaguggguaugaguggaucacagauuuuccuggaaaaaccguuugguucgugcccagcauaaagucgggcaaugacauugcgaacugucuccgcaagaauggcaaacgagucauccaguugucuagaaagacguucgauacugaauaccagaagacaaagaacaacgacugggacuacgugguuaccaccgauaucuccgagaugggggccaauuuucgggcagacagggugauugauccacgccguugccugaaaccugucauccucaaggacggacccgaaagagugauucuggcugguccaaugccgguaacuguggccagcgcagcccagcggaggggccgcauagggcgaaaccacaauaaggagggagaucaguauaucuacaugggccagccucuuaacaaugacgaggaucaugcucacuggacagaagccaaaaugcuacuggacaacauuaauacccccgaggguaucaucccagcguuguucgaacccgagagagaaaagucagcagccauugauggggaguaucgguuaaggggcgaggcucgcaaaacauuuguugaacugaugagaaggggagaccucccugucuggcugaguuacaagguggccucugagggcuuccaauauuccgaucggcguuggugcuuugacggggaacgcaacaaucaggugcuugaggaaaacauggaugucgagauauggacuaaagagggagaacgaaagaaacugagaccaagguggcucgacgcucggacguacagcgaccccuuggcacugcgcgaguucaaggaauuugccgcugguagaaggucaguuaguggcgaucuaauccuggagauugggaagcucccucagcaccuuacccagcgggcccaaaaugcacuggacaacuuagugauguugcauaauagcgaacagggaggccgagcguauagacacgccauggaggagcugccggauacaaucgaaacucucaugcugcuugcucugauugccguacucaccgguggggugacauuguucuuucuguccggccgcggauuaggcaaaaccucuaucgggcuacugugugucauggcaagcuccgugcuccuuuggauggcuucaguugagccacauuggauagccgcaucuaucauucuggaguucuuuuugauggugcugcucauccccgagccugacaggcagcggacuccccaggauaaccaacuggccuacgucguaauuggacuucucuucaugauccugacgguggcugcgaaugagauggguuugcuggaaaccacaaagaaagacuuaggcauagggcacguugccguggagaaccaccaucacgcagcuaugcuagaugucgaccugcauccagccagugccuggacucucuacgcaguggcuaccacaauuaucaccccuaugaugcgucacacuauugaaaacacaacggccaauaucucgcuuaccgcgauagcuaaccaggccgcaauccugaugggauuggauaagggcuggcccauuagcaaaauggacaucggugucccacugcucgcccuggggugcuauucccaggugaauccucuuacuuuaacagcugcaguucugaugcucguggcccauuacgcgauuaucggcccgggauugcaagcuaaggccaccagagaggcacagaagaggaccgccgcuggcauaaugaaaaaccccacaguagaugggauuguggccaucgaccuggauccagucguuuaugacgcaaaguuugaaaaacagcuaggacagaucaugcugcucauucuuuguacuucucaaauccuguugaugcgcacgaccugggcucugugcgagucaauaacacucgccacuggcccucugaccacauuaugggaggguagccccgggaaguucuggaauaccacuauugcgguguccauggccaacaucuuccggggaaguuaccuugcaggcgcuggucuggccuuuucucucaugaaaagccuaggcgggggacgaagaggcacgggggcacagggagaaacacugggcgagaaguggaagaggcaguugaaucagcugucaaaauccgaguucaacaccuauaagcgcagugguauuauggaggucgaccggagcgaagcuaaagaggggcucaagagaggagagacuaccaaacacgccgugucucguggcacagccaaacuuaggugguuuguagaacggaaucuggugaagccagaggguaaaguuaucgauuugggcugugggcgcggaggcugguccuacuauugcgcggggcugaagaaagugacugaagucaagggauacaccaaaggcgguccugggcacgaggaacccauaccgauggcuacauacggauggaaccucgugaaguuacauucaggcaaagacgucuucuuuaucccaccugagaagugugauacgcugcuuugcgacauuggcgagagcucgcccaauccaaccaucgaagaggggcgaacucugagagugcuaaagaugguugaacccuggcucaggggaaaccaauucuguauuaaaauccugaauccuuauaugccgucuguaguggagacauuggagcagaugcagcggaagcacgguggcaugcugguccgcaacccccucaguagaaauuccacccaugaaauguacugggugagcugcgggacuggaaacauuguuucagcagugaauaugacauccaggaugcuucugaaccgauuuaccaugguccaccggaaaccaacguaugagcgugauguggacuuaggcgccgguaccagacacguagcuguggaaccugagguugccaaccuggauaucauagggcagcgcauugaaaauaucaagcaugagcacaaaucuacauggcauuacgacgaggauaaccccuauaagacuugggcauaccacggaagcuaugaagucaagccuaguggcuccgccagcucuauggugaauggcguggucaaauugcucaccaagccaugggacguuauccccauggugacacaaauugcuaugacugauaccacaccuuucgggcagcagaggguauuuaaagagaagguggacacccggacuccaaaagcgaagagaggaacggcccaaauaauggaagucacagcaaaguggcugugggguuuccuaucacgcaacaaaaagcccaggaucuguacccgagaggaauuuacucggaaagugagaaguaaugcugccauuggcgcaguuuucguggacgagaaccaguggaacuccgccaaggaggcugucgaagaugagagguuuugggaccuugugcaucgcgaacgugagcugcacaaacaggggaagugcgcaaccugcguauacaacaugaugggaaagcgggagaaaaagcucggcgaguucgguaaagcgaaggggagcagagcaaucugguacauguggcugggagccagguucuuggaguuugaagcucugggcuucaugaaugaggaucacugguuuucucgcgaaaacucgcucucaggcguugagggggagggacuucauaaacuggguuauauuuuacgagacaucagcaagauaccgggcgggaauauguacgccgaugacacagcaggaugggauacgcggaucaccgaagacgaucugcagaacgaggcuaaaauuacugacaucauggaaccugagcacgccuugcucgcuaaguccauuuucaagcugacauaucaaaauaaaguggucagagugcagaggccagccaagaacggcaccgugauggaugucaucagucgcagagaccagcgggguucugggcagguuggaacuuacggccuaaauacauuuaccaacauggaagcacaacuuauaaggcagauggagagcgagggcauuuucucccccucagaacuggagacaccuaaccucgcggggcgugugcuggauugguuggaaaaacauggaguagagcgauuaaagcgcauggccaucaguggugacgacuguguggucaaaccaaucgaugacagauuugcuacugcccugaccgcacucaaugauaugggcaaggugcggaaggacauuccccagugggaaccgucuaaaggguggaacgauuggcagcaaguuccuuucugcagccaccacuuucaucagcuuauaaugaaggacggaagggagaucgugguccccugucgcaaucaggaugagcuggugggcagagcucggguaucccagggugccggguggucacuaagggaaacggcaugccugggaaaaagcuaugcccaaauguggcagcucauguacuuccaccgacgugacuugagacuggcggcuaacgccauuuguucugcaguuccaguggauugggucccuaccucccgcacaacuuggaguauccaugcccaccaucaguggaugaccacagaggacaugcuuagcguguggaaucggguuuggauugaagagaaccccuggauggaagauaagacucacaucucguccuggggcgacgugccauaucugggcaaaagggaggaccaauggugcgggucucucauaggauuaaccgcuagagccacgugggcaacaaauauccaggucgcuauuaaccaggugcgccggcugaucgguaaugagaacuacuuggauuacaugaccucaaugaagagguuuaagaaugaaagcgaccccgagggcgcccugugguga

SEQ ID NO: 13723 - RNA, 9879 nt, Artificial Sequence
  derived and/or modified CDS sequence (opt3) from DENV-1__FJ882530__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucacacacacaggugugcgaccaccguuugaugagugcagccauaaaggauucuaaagcuguucaugccgacaugggguauuggauugaaagcgagaagaaugaaacguggaagcucgcacgggcguccuucaucgaggugaaaaccuguauuuggccaaagucacacacucuguggagcaacggaguacuagaaucugagaugaucauacccaaaaucuacggcgguccuauuucccagcauaauuaucgaccaggcuacuuuacacaaaccgccgggccguggcaccugggaaagcucgagcuggauuucgaccuuugcgaaggcacuacagucgugguggaugagcacugcgggaacagaggacccaguuugaggaccacgacugucaccggcaaaaucauucaugaaugguguugccgcagcuguacacugccuccauuacgguuuaagggugaggacgggugcugguacggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaucuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaccaacugugggccaccuugcucucccugacuuuuauuaagaccacauucucacuacauuacgcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuaugucaucuccgguagcucugcggaccugagcuuggagaaggcugccgagguguccugggaagaggaagcagagcacucaggggccagucauaauauauuaguagaagugcaggaugacggaacaaugaaaauuaaggaugaggagagggacgauacccugacuauccuccugaaggcuacacuucuggcagucagcggcguuuaccccuugucuaucccagccacccuauucgugugguauuuuuggcagaaaaagaaacaacgauccggcgugcugugggacacgccuucacccccagaagucgagcgcgcggugcucgaugacgggauuuaccggauaaugcagagaggacugcuugguaggagucagguuggcguagggguguuccaggaaaacgucuuucacacuauguggcacgugacccguggagcuguuuuaauguaucaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuacgggaauggagucgugacgacaaguggcacuuauguuucugcaauagcucaagccaaagcgagccaggagggcccacugcccgagaucgaagacgagguguucaggaagcgaaaccuuaccauuauggaucugcauccuggguccggaaagacacggcgcuacuugccggccaucgucagagaagcaauuaaaaggaagcuacggacccugauccucgcuccaacucgagugguagccucagagauggcugaagcauuaaaagguaugcccauaagauaucagaccacagccgugaagucugagcacacgggcaaagagauuguugaccugaugugccaugccacuuuuaccaugcgccuucugagcccugucagggugccaaauuacaacaugaucaucauggaugaagcucacuucacagaccccaguuccauugcggcacguggguauaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguacgaguggauuaccgauuuuccuggaaagacggugugguucguucccagcaucaagucgggcaaugacauagcgaacugucuccgcaaaaauggcaagcgagugauucaguugucuagaaaaacuuucgauacagaauaucagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccauaauaaagagggagaucaguacauauauaugggccagccucuuaacaaugacgaggaucacgcucacuggaccgaagccaagaugcuacuggacaacaucaauacacccgaggguauuaucccagcguuguucgaacccgagagagaaaaaucagcagccaucgauggggaguaccgguuaaggggcgaggcucgcaagacuuuuguggaacugaugagaaggggagaccucccuguuuggcugaguuauaaagucgccucugagggcuuccaguacuccgaucggcguuggugcuuugacggggaacgcaacaaucaagugcuugaggaaaacauggauguggagauuuggacgaaggagggagaacgaaagaaacugagaccaagguggcucgacgcucggaccuauagcgaccccuuggcacugcgcgaguucaaagaauuugccgcugguagaaggucagucaguggcgaucuaauacuggagaucgggaaacucccucagcaucuuacacagcgggcccagaaugcacuggacaacuuaguuauguugcacaauagcgaacaaggaggccgagcguacagacaugccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacacuggaucgccgcaucuauaauccuggaguucuuuuugaugguucugcucauucccgagccugacaggcagcggacgccccaggauaaccagcuggccuauguggucaucggacuucucuucaugauucugaccguagcugcgaaugagauggguuugcuggaaacaacuaaaaaggacuuaggcaucgggcacguggccguugagaaccaucaccaugcagcuaugcuagauguggaccugcacccagccagugccuggacccucuacgcagucgcuacaaccauaauuacuccuaugaugcgucauacaaucgaaaacacgaccgccaauauuucgcuuacugcgaucgcuaaccaagccgcaauacugaugggauuggauaaaggcuggcccaucagcaagauggacauuggugugccacugcucgcccuggggugcuacucccaggucaauccucuuacauuaaccgcugcagugcugaugcucguugcccacuaugcgaucauuggcccgggauugcaggcuaaggccaccagagaggcacagaagaggacagccgcuggcaucaugaagaaccccacuguggaugggauaguagccauugaccuggauccaguggucuacgacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaucuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuacaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuauuacugcgcggggcugaaaaagguuaccgaagugaaaggauauacaaagggcgguccugggcaugaggaacccaucccgauggcuacguacggauggaaccucgucaaauuacacucaggcaaggacguguucuuuauaccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuacaugccgucuguuguagagaccuuggagcaaaugcagcggaaacaugguggcaugcuggugcgcaacccccucaguagaaauuccacucacgaaauguauugggucagcugcgggacaggaaacaucgugucagcaguuaauaugaccuccaggaugcuucugaaccgauuuacgauggcccaccggaagccaaccuacgagcgugauguggacuuaggcgcugguacaagacaugucgccguggaaccugagguagcaaaccuggauauuaucgggcagcgcauagaaaauauuaaacacgagcauaagucuacuuggcacuaugacgaggauaaccccuacaagaccugggccuaucauggaagcuacgaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaccgcgaacgugagcugcacaagcaggggaagugcgcgacaugcgucuauaacaugaugggaaaacgggaaaagaaacucggcgaguucgguaaggcaaaagggagcagagccauuugguacauguggcugggagcuagguucuuggaguuugaagcccugggcuucaugaaugaggaucauugguuuucucgcgaaaacucgcucucaggcguggagggggagggacuucacaagcuggguuacaucuuacgagacauuagcaaaaucccgggcgggaauauguaugcagaugacacggcuggaugggauacccggauaacugaagacgaucugcagaacgaggccaagaucacagacauuauggaaccugagcaugcuuugcucgccaaguccaucuucaaacugaccuaccagaauaagguaguuagagugcaaaggccagccaagaacggcacugucauggaugugauuagucgcagagaccagcgggguucuggacaggugggaacauauggccuaaauaccuuuacaaacauggaagcgcagcuuaucaggcaaauggagagcgagggcauauucucccccucagaacuggagacuccuaaccucgccgggcguguccuggauugguuggaaaagcacggaguugagcgauuaaaacgcauggcuauuaguggugacgacugugugguaaagccaaucgaugacagauuugccaccgcacugacggcucucaaugauaugggcaaggugcggaaagacaucccccagugggaaccgucuaagggguggaacgauuggcagcaggucccuuucugcagccaccauuuucaccaacuuauuaugaaagacggaagggagauagugguucccugucgcaaucaggaugagcuggugggcagagcccgggucucccagggugcaggguggucacuaagggaaaccgccugccugggaaagagcuacgcgcagauguggcaacucauguauuuccaucgacgugacuugagacuggcugccaacgcaaucuguucugccgugccaguagauuggguuccuacaucccgcacuaccuggaguauucacgcucaucaccaguggaugacaacugaggacaugcuuagcguguggaaucgggucuggaucgaagagaaccccuggauggaagauaaaacccacauuucguccuggggcgacgugccauaccugggcaagagggaggaccaguggugcgggucucucaucggauuaacggccagagcaacaugggcuaccaauauacaaguugccaucaaccaggugcgccggcugauugguaaugagaacuauuuggauuacaugacuucaaugaagagguuuaaaaaugaaagcgaccccgagggcgcgcugugguga

SEQ ID NO: 13724 - RNA, 9879 nt, Artificial Sequence
  derived and/or modified CDS sequence (opt3) from DENV-1__GQ868605__SS-prME
agcgugaccaugcugcucaugcuuaugcccacagcccuggcuuuccacuugacuacgagaggaggggaaccucauaugaucgucaccaagcaggaaaggggaaaauccuuacuguuuaagacaucuguuggugugaacaugugcacucuaauugccauggaccucggcgaacugugugaagauaccaugacauacaaaugcccacggauaaccgaggccgaaccggacgauguagacuguuggugcaaugcgacugauacaugggugaccuaugggacguguucacaaacuggagagcaccgccgagacaagcguagugucgcucuugcaccccaugugggccuggguuuggagaccagaacagaaacuuggaugagcuccgagggggcauggaaacagauccagaggguugaaaccugggcccuccggcacccuggauucacagugauugcucuguuucuggcacaugccaucggcaccucuauuacgcagaagggcaucauauucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuacaccccaggccccuacaagugagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacugggagcuucaaacuggagaaggaagucgccgagacccagcacgguacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucgguguuggggaaaaagcccugaagcucuccugguucaagaaaggcucaaguaucggaaagauguuugaggcuacugccagaggcgcaaggcggauggccauucugggggauaccgcuugggacuucggaagcaucgguggcguguuuacauccgucgggaaacuugugcaucagauuuucggaacggccuacggcguacuguuuucuggugugagcuggaccaugaagauagggaucggcguuuugcucacuuggcugggauuaaauucacgaaguacaucccugagcaugaccuguauugcagucggccuagugacacucuaccugggggugaugguccaggcggauucuggaugcguuaucaacuggaaaggccgcgaacuuaagugugguucagggaucuucgugacuaaugaggugcacaccuggacggaacaauauaaguuucaggcugacaguccgaaaagauugagcgccgcaauuggaaaggccugggaggagggcguaugcgguauaagguccgcuacacggcuggaaaacaucauguggaaacagauuucuaacgagcucaaucauauccuguuagaaaacgacaugaaguucaccgucgugguuggcgauguggucgggauucuggcccagggcaagaagaugauccgcccucaacccauggagcacaaauacucguggaaaagcuggggcaaggcaaagauaaucggggcugacgugcagaauacuaccuuuauuaucgauggaccaaacacaccugaaugucccgacgaucagagagccuggaauauuugggagguugaggacuauggcuucgguaucuuuacuaccaacauauggcuuaaguugagggauuccuacacacaggugugcgaccaccgucucaugucagcggccauuaaagauaguaaggcuguacaugcagacaugggguauuggaucgaaucugagaaaaaugauacguggaagcuggcccgggcuagcuucauugaagucaagaccuguaucuggccaaaaucccacacucuauggucaaacggagugcuggagagcgaaaugauaauccccaagauuuacggcgguccuaucucucaacauaauuaucgaccaggcuacuucacacagaccgccgggccguggcaccucggaaaacuggagcuugacuuugauuugugcgagggcacuacaguggucguugacgaacacugcgggaacagaggacccucccugaggaccacgacugugaccggcaagauuauccaugagugguguugccgcaguuguacauuaccuccacuccgguucaaaggugaagacgggugcugguacggaauggagauaagacccguaaaggagaaggaagagaaucuggugaaaagcauggucucugcaggcuccggugaaguggauucauuuagucuuggccuguugagcauuucgaucaugaucgaggaaguuaugaggucccgcuggucucgaaagaugcucaugaccgggacucuggcgguguuccuacugcucauugucggacagcugacauggaacgaccuuauccgguuguguauuauggugggcgccaaugcuagcgaucguauggggaugggaaccacauaucuggccuuaauggcaacuuuuaaaaugagaccuauguucgcuguuggccuccuguuuaggcgccuuaccucacgggaggugcugcuacucacgauaggucugaguuuggucgccuccguagagcugccaaacucuuuagaagaacucggggacggacuggcaaugggcaucaugauucuuaagcuguugacagauuuccaaagccaccagcucugggccacccugcuaucccugacuuuuaucaaaaccgcucuuucacuccauuacgcguggaagacaauggccauggugcugagcauuguuaguuuguucccccugugcuuaucuacuaccucccagaagacgacauggcucccggugcugcuuggcagccugggguguaaaccuuugaccauguuucucaucgcagaaaauaagauauggggaagaaaaucguggccacugaacgaggguaucauggcugucggcgugguaucaauucuacugucuagucuucucaagaacgacgugccccuggccgggccuuugaucgccggaggcauguuaauugcuugcuaugucaucuccgguagcucugcagaucugagccucgaaaaagccgcggagguuuccugggaggaagaggcugaacacucaggggccagucauaauauacugguggaggugcaggacgauggaacuaugaagauuaaagacgaagagagggaugacacacuuaccauccuguugaaggcaacucuacuggccgucagcggcguguacccccucucuaucccagcuacacuguucguuugguauuuuuggcaaaagaaaaagcagcgauccggcguacuuugggauaccccuucacccccagagguggaacgcgcagucuuagacgacgggauuuaccggauaaugcagagaggacugcucgguaggagucaggugggcguugggguguuccaagagaacgucuuccacacgauguggcacgugacucguggagccguauugauguaucagggcaaacgccuggaaccgagcugggcguccgucaagaaagaucucaucucuuacggugggggauggcggcugcagggcucguggaauaccggcgaggaggugcagguuauugcuguggaaccugggaagaaccccaagaauguccaaacagccccaggaaccuuuaaaacacccgagggugaagugggcgcaaucgcccuugacuucaagccugggacuagcggaucaccaauuguuaacagagagggcaaaaucgugggucuguacgggaauggagucgugaccacguccggcacauauguaagugcuauagcccaggcaaaggcuucucaggaaggccccuugccugagaucgaggaugaaguguuuaggaaacgaaaccuaacuauuauggaccugcauccggggagcggaaagacccggcgcuaccucccagccaucguuagagaggcgauuaagaggaaauuacggacacugauccuugcccccacccgagucguggcauccgaaauggcugaggcccugaaggguaugccuauaagauaucaaacuaccgcugugaaaucagaacacacaggcaaggagauugucgaucucaugugucaugcaacguucacuaugcgcuugcugucuccaguaagggugcccaauuacaacaugaucaucauggacgaggcccacuuuaccgauccuagcaguauugccgcucguggguauaucuccacacggguuggaaugggcgaagcggcagccauauucaugaccgcuacuccgcccgguagcguggaggccuuuccacagucuaaugcagucauucaggacgaagagagagauaucccugaaaggucauggaacuccggguacgaguggauuacagacuuccccggaaaaaccgugugguuuguuccaaguaucaagagcggcaaugauauagccaacugccuccgcaagaauggcaaacgagugauucagcugucgagaaagacguucgagacugaauaucagaagacaaagaacaacgacugggacuacgucgugaccaccgauaucucugagaugggggcuaauuuucgggcggacaggguaaucgauccucgccguugucuuaaacccgugauucuaaaggacggauccgaaagaguuauccuggccgguccaaugccggucacuguggcaagcgcugcccagcggaggggccgcauugggcgaaaccauaauaaggagggagaucaguacauauauaugggccagccuuugaacaaugacgaggaucacgcacacuggacagaagccaaaauguuacuggacaacaucaauacccccgaggguauuaucccagcucucuucgaacccgagagagaaaagucagccgcgaucgauggggaguaccggcugaggggcgaggcacgcaaaacauucguggaacuuaugagaaggggagaccugccugucuggcucaguuauaagguugccucugagggcuuucaauacuccgaucggcguuggugcuucgacggggaacgcaacaaucagguguuggaggaaaacauggauguagagauuuggacuaaagagggagaacgaaagaaacugagaccaagguggcuagacgcucggacguauagcgacccccuggcccuccgcgaguuuaaggaguucgcugcagguagaaggucagugaguggcgaucuuauaaucgagauugggaagcugccucagcauuuaacccagaaagcccaaaaugcuuuggacaaccuggucaugcuccacaauagcgaacagggaggccgggccuaccgacaugcaauggaggagcugccggauacaaucgaaacucuuaugcugcucgcguugauugccgugcugaccggugggguuacauuauuuuuccuauccggcagaggacugggcaagaccucuaucgggcuccuuugcgugauggcuagcuccguccuguuguggauggccucaguagagccacacuggauagcagcuucuaucauucuggaauuuuuccucauggugcugcuuauccccgagccugaccgccagaggacuccccaggauaaccaacucgccuauguugugauuggacuguuguuuaugauccugacggucgcagccaaugagauggguuuacuagaaaccaccaagaaggaccugggcauagggcacguggcugucgagaaccaucaccaugcgacuaugcucgauguggaccuucacccagccagugcauggacccuguacgcuguugccacaaccauuaucacuccuaugaugcggcauacaauugaaaacacgaccgccaauaucucguugacugcaauagcuaaccaggccgcgauccugaugggacucgauaaaggcuggcccauuagcaagauggacaucggugugccacugcuugcuuuaggguguuacucccagguaaauccucugacacucaccgccgcaguguugaugcuggucgcccacuaugcuauuaucggcccgggacuacaagcaaaggccacccgugaggcgcagaaaagaacagcugccggcauaaugaagaaccccacuguugaugggauuguggcaaucgaccuggauccagucguguacgacgccaaauucgaaaagcagcucggacagaucaugcuucugauuuugugcacgucucaaauccugcucaugaggaccacaugggcucugugugagucaauaacuuuagccaccggcccucuuacaacccugugggaggguagccccgggaaauuuuggaauacuacgauugcaguauccauggcuaacaucuuccgcggaaguuaucucgccggcgcgggucuagccuuuucucugaugaaaucauugggcgggggacggcgaggcacaggggcacagggagaaacccugggcgagaaguggaaaagacagcucaaucagcuuagcaaguccgaguucaacauuuacaaaaggagugguaucauggagguggaccgcagcgaagcuaaggaggggcugaaacggggagagacuaccagacacgccguuucucguggcacagcaaaguugaggugguucguggaacggaaucuggucaagccagaggguaaagugauagaucucggcugcgggcgcggaggcugguccuauuacugugcuggguuaaagaaagucacugaagugaagggauauaccaaaggcgguccugggcaugaggaacccaucccgauggccacauacggauggaaccugguuaaacuucacucaggcaaagacguauuuuucacgccaccugagaagugcgauacccugcuaugugacauuggcgagagcucgcccaauccaacuaucgaagaggggcgaacacucagagugcugaagauggucgaacccugguugaggggaaaccaauuuugcauuaaaauccugaauccuuacaugccgucugugguugagacccucgagcagaugcagcggaagcaugguggcaugcuugugcgcaacccccugaguagaaauuccacucacgaaauguauugggucagcugugggacaggaaacauugugucagccguaaauaugaccuccaggauguuacugaaccgauucacgauggcgcaccggaaaccaaccuacgagcgugauguggacuugggcgcugguacaagacauguugcagucgaaccugagguggccaaccucgauaucauagggcagcgcauugaaaauaucaagcacgagcauaaaucuacuuggcacuaugacgaggauaaccccuacaagaccugggcuuaucauggaagcuacgaagugaagccuaguggcuccgccagcucuauggucaauggcguugugaaacugcuaacaaagccaugggacguaauccccauggugacucaaauugcaaugaccgauacaaccccuuuugggcagcagagggucuucaaagagaagguggacacucggacgccaaaagccaagagaggaacagcucaaauaauggaaguuaccgcgcgcuggcuuuggucauuucugaguaggaacaagaaaccccgaaucugcacucgggaggaguucaccagaaaggugagguccaaugccgcaauuggugcugucuuuguggacgagaaccaguggaauagcgccaaagaggcaguagaagaugagcgcuucugggaccucguucagaaggaacgugagcugcacaaacagggcaagugugccacaugcguguauaacaugauggggaagcgggagaaaaaguugggagaguuuggcaaagcuaaggguucuagagccaucugguacauguggcugggggcgagguuccucgaguuugaagcacuuggauucaugaaugaggaucacugguucucgcgcgaaaacucacugagcggcgucgagggcgagggguuacauaaacugggauacauuuugcgagacaucuccaagauaccggguggcaauauguaugccgaugacacggcugggugggauacccggaucacugaagacgaucuccaaaacgaggccaaaauuacagacaucauggaaccugagcacgcacugcuagcuaccaguauuuuuaaacuuacuuaccagaauaagguggugagaguccagaggccagccaaaaacggaacaguuauggaugugaucucucgcagagaccagcggggcagcggucaaguagggaccuauggacugaauacauucacuaacauggaagcucagcucauaaggcagauggaguccgagggcauuuuucugcccucagaauuggagaccccuaacuuagccgaacgugugcuggauuggcucgagaagcauggcgucgaacgacuuaaacgcauggcaaucaguggggacgacugcgugguuaagccaaucgaugacagauucgcgacggcccugaccgcucuaaaugauaugggaaaagugcggaaggacauuccccagugggagccgucuaaggguuggaacgauuggcaacaggucccuuuuuguagccaccacuuccaucagcugauaaugaaagacggcagggagaucgugguacccugccgcaaucaggaugaacucguugggagagcccgggugucccaaggagcaggcuggucauugagggagacagcuugucuggguaagagcuacgcccagauguggcagcuuauguauuuucaccgacgugaccugagacucgcagccaacgcgauuugcucugcugucccaguggauuggguuccuacuucccgcaccacauggaguauccaugcccaccaucaauggaugacuaccgaagacauguuaagcguguggaaucgggucuggauugaggaaaaccccuggauggaggauaaaacgcacgugucguccuggggagacguaccauaccugggaaagagggaggaccagugguguggcucuuugaucggccugacagcaagagccaccugggcuucaaauauacagguggccaucaaccagguccgccggcucauugggaaugaaaacuaucuugauuacaugacuagcaugaaaagguucaagaaugagggagaccccgaaggugcacugugguga

SEQ ID NO: 13725 - RNA, 9879 nt, Artificial Sequence
  derived and/or modified CDS sequence (opt3) from DENV-1__FJ882534__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguccucaagagggggcuaugcacacugcccugaccggcgcaacggaaauccagaccaguggaacaacuaccauuuuugccggccauuuaaaaugccgucugaagauggauaaacuaacacucaaggggaugucuuaugugauguguacuggauccuucaaacuggagaaggaagucgcugagacccagcacgguacggugcuuguucagauaaaguacgagggcacagacgcgccaugcaaaauccccuucagcacccaagaugaaaagggggugacucagaacggacgcuugauuacagcaaauccuaucguaaccgacaaagagaagccagucaacauagaagccgagcccccguuuggcgagucguauauugugaucggugcuggggaaaaagcccugaagcucucuugguucaagaaaggcuccucaaucggaaagauguuugaggcaacugccagaggcgcuaggcggauggccauucugggggauaccgcaugggacuucggaaguaucgguggcguuuuuacaagcguggggaaacuuguccaucagauuuucggaacggcguacggcgugcuguuuuccgguguaucuuggaccaugaagauagggaucggcguguugcucacuuggcugggauuaaauagccgaucaacaagucuguccaugaccuguauugcuguuggccuagucacacucuaccugggggugauggugcaggccgauagcggaugcgucaucaacuggaaaggccgcgaacuuaagugugguucugggaucuucguuacuaaugaggugcacaccuggacggaacaauauaaguuucaggcagacucaccuaaaagauugagugccgcuauuggaaaggccugggaggagggcgugugcgguauaaggagcgcaacacggcuggaaaacaucauguggaaacagauuuccaacgagcucaaucauauccuguuagaaaacgacaugaagcugaccguagucgugggcgauguugcugggauucuuggacagggcaaaaagaugauccgcccccaaccaauggaguacaaauauucuuggaagucgugggggaaggccaaaauaaucggagcggacgcccagaauacuaccuucauuaucgauggcccuaacacacccgaauguccagacgaucagagagcuuggaauauuugggagguggaggacuacgguuuugggaucuucacuaccaacauaugguugaagcucagggauagcuauacacaggucugcgaccaccgucugauguccgcagccauuaaagauucaaaggcugugcacgccgacaugggauacuggaucgaaagugagaaaaaugaaacguggaagcuagcacgggcgucuuuuauugagguuaagaccuguaucuggcccaaaagccauacucugugguccaacggcgugcucgaaucagagaugauaaucccuaagauuuaugguggcccaaucagccaacacaauuaccgaccgggguacuucacacagaccgccggacccuggcaucugggcaaacuugaguuggauuucgaccugugcgaagggacuacaguagucguggaugagcacugcggaaacagaggcccuucuuuaaggaccacgacugugaccgguaagauuauccacgaaugguguugccgcuccuguacacucccaccccugcgguuuagaggggaggacggaugcugguauggcauggagauaaggccugucaaagaaaaggaggaaaaucuuguuaagaguauggugagcgcugguucuggcgagguagacuccuucucacugggguugcucuguauuaguaucaugaucgaagaggugaugcgcagccgauggucgcggaaaaugcugaugaccggaacucuagccgucuuuuuccugcucauuaugggccagcugacauggaacgaucuuauccguuugugcauuauggugggggcaaaugcuuccgacagaaugggaaugggcaccacauaccuggccuuaauggcaacuuuuaagaugaggccaauguucgccguuggucuccuguuucgccggcuuaccucuagagaggugcugcuacucacgauagggcugagcuuggucgcuucaguggaacugcccaacaguuuagaggaacucggagauggccuggcgaugggcaucaugauucuuaaacuguugacagacuuccaaucccaucagcucugggccacccugcuaucucugacuuuuaucaagaccacauucagccuucacuaugcauggaaaacuauggcuaugguucucuccauugugucacuguuuccguugugucugagcaccacgagucagaagacaaccugguuaccuguccuccuggggucucuuggaugcaagccacugacuauguucuugaucguagagaauaaaauaugggguaggaaguccuggccccucaacgaaggcaucauggccguggggauuguuagcauccugcuaucgucacugcuuaaaaacgaugugccucucgccggaccccugauugcuggcgguauguugaucgcauguuacgucauaucugggaguuccgccgacuuaagccuggagaaggcggcugaggugucuugggaagaggaagccgagcauagcggagcaucccacaauauucucguagaagugcaggaugacggcacaaugaaaaucaaggaugaggagcgagacgauacccugacuauccuucugaaagccacauugcuagcugucucaggcguuuauccacugaguauuccugcaacccucuuugugugguacuucuggcaaaagaagaaacagcgcagcggggugcugugggacacgcccucuccaccggaagucgagcgggccgugcuugaugacggaauauauagaaucaugcagagggguuuacugggccguucccagguugggguaggaguguuccaagaaaacgucuuucauacuauguggcacgugacccgcggcgcgguucucauguaccaggguaagcgguuggagccuucaugggcuagugugaaaaaggaccugauuagcuacgggggaggcuggagacucaggggcuccuggaauacaggggaggaaguccaggugaucgccguagagcccggcaaaaauccaaagaauguccagaccgcacccgguacauucaagacuccugaaggcgaggugggggccauugcucuggauuuuaaaccaggaaccucuggcucgcccaucguuaaccgagaagguaagauaguggggcuuuauggaaauggcgucgugacgacaagcggcacuuacguuucagccaucgcacaagcuaaagccucccaggaggggccucugccggagauugaagacgagguguuccggaagcgcaacuugaccaucauggaucuacacccaggaagugguaaaacaagaagguaucugcccgcgauuguccgggaagccaucaagcgaaagcucagaaccuuaauacuggcaccuacucgcgugguagcuucugagauggccgaagcucuuaaaggcaugccaauuagguaccagaccacagcaguaaagagcgagcauacggggaaagagaucguugaccugaugugccacgccacuuuuaccaugcgucucuugucccccguccgggugccuaauuauaacaugaucauuauggaugaagcccauuucacagacccgucaucuaucgcugcgagaggauacauaagcaccagggugggcaugggugaggcagccgcuauuuuuaugacugccacacccccagggagugucgaagcauucccucaauccaaugccguaauccaggaugaggaacgcgacauucccgagcgaagcuggaacucuggauaugaguggaucaccgauuuuccaggcaagacggugugguucguuccuucaauaaaauccggcaaugacauugcuaacugucugagaaagaaugggaagcgggugauccagcucaguaggaaaacuuuugauacagaauaccagaagaccaaaaacaacgacugggacuacgucgugaccacugauaucagcgagaugggagcgaauuuccgcgccgaccguguuauugaucccagacggugccugaagccagugauccuuaaagacgguccggaaagggucauucuagcaggcccuaugcccgugacaguagcuucggccgcacaacgccgagggagaauaggacggaaccacaauaaggagggcgaucaguauaucuacaugggucagccacugaacaaugacgaggaucaugcccacuggaccgaagcuaagauguuguuagacaacauuaauacacccgaggggaucaucccugcccuguucgaaccagagagggaaaaaucugcggcaguggauggcgaguaucgccucagaggagaggccaggaagacuuuuguugaacugaugcggcguggcgaccuucccgucuggcuguccuacaaaguggcuagcgagggguuccaguauucagaucgccgauggugcuuugacggagaaagaaacaaucaagugcucgaggaaaacauggaugucgagauuuggacgaaggagggugaaaggaaaaaguugcggccucgcuggcuggacgccagaaccuacagugacccgcuagcucugagggaguucaaagaauuugcagccggccggcgaucuguuuccggggaucucauacuugagaucggaaagcugccacagcacuuaacacagagagcucagaaugccuuggacaaccuggugaugcuccauaauagcgaacaaggcggucgcgcauauaggcacgcgauggaggagcugcccgauacuauugaaacccuuaugcugcucgccuugaucgcuguacugacagggggcgugaccuuauucuuucuaucaggacggggccuggggaagacaaguauuggacuccuuugugucauggccagcuccgugcuguuguggauggcaucuguugagccucauuggaucgcugccagcauaauccuggaguucuuucucauggugcugcuuauucccgagccagaccgucagagaacgccucaggauaaccagcucgcauacgucguaaucggucuguuguucaugauucugaccguggccgcuaaugagaugggcuuacuagaaacaacuaaaaaggaccuggggaucggacacguugcgguggagaaccaccaucacgccgcaaugcucgaugucgaccuucaucccgcuuccgccuggacccuguacgccguggcaacaaccauaauuacuccaaugaugaggcacacaaucgaaaacacgaccgcuaauauuucauugacugccaucgcgaaccaagcugccauacugaugggccucgauaaagguuggccuaucucuaagauggacauuggggucccgcugcuugcauuaggcugcuauagucaggugaauccccugacacucaccgccgcuguuuugaugcugguggcacauuacgccaucauuggaccaggccuacaggcgaaagcuacccgcgaggcccaaaagcggacagcagccgggaucaugaagaacccuacuguagauggaauaguggcuauugaccuggaucccgucguuuaugacgccaaauuugaaaagcagcucggccagaucaugcuucugaucuuguguacgucgcagauucugcucaugcgaaccacaugggcacugugcgagagcaucacuuuagcuaccgguccacuuacaacccugugggagggguccccuggaaaauucuggaauacuacgauagccgugucuauggcgaacauuuuuagaggcucauaccucgccggugcaggccuagcuuucagccugaugaagucccuagggggaggcaggcgcgggacaggagcccaaggcgaaacccugggugagaaauggaagcggcagcucaaucagcuuaguaagucugaguucaacacuuauaaaagaagcgggaucauggaggucgaccguucagaagcaaaggagggacugaaaaggggcgagaccacaaagcacgcugugucccgggguacugccaaauugcgcugguuuguagaacgaaaucuggugaagcccgagggcaagguuauugaucucggguguggaagaggcggguggaguuacuauugcgccggacugaaaaaggugaccgaagucaaaggcuacacaaagggugggccgggacacgaggaaccaaucccuauggcgacguacggcuggaaccuagugaaacuucauagcggcaaggacgucuucuuuauacccccagagaaaugugauacccugcuaugcgacaucggggagucuucccccaauccuacuauugaagagggaaggacacuccgggugcugaagaugguugaaccgugguugcgcgguaaccaguucuguaucaagauucugaaucccuauaugccaucaguaguggagacccucgagcaaaugcagagaaaacacggcgggaugcuugucaggaacccucugagccgaaauucgacucaugaaauguacugggugucuugcggaacaggcaacaucguuagugcugugaauaugaccucccggauguuacugaaccguuuuacgauggcacacagaaagcccaccuaugagcgcgaugucgacuuggguacagggacuaggcacguggccguagaaccugagguggcuaaccucgauauuaucggacagcggauagaaaauauuaaacaugagcacaagagcaccuggcauuacgacgaggauaacccauauaaaacaugggccuaccacggcucauaugaaguuaagcccuccggcucugcaagcaguauggucaaugggguggugaagcugcuaacuaaaccuugggacgucaucccaaugguuacccagaucgccaugacagauaccacucccuucggacaacagagaguguuuaaggagaaaguagacacgcgcacaccgaaggcuaaaagggguaccgcgcagauuauggaagugacugcccgauggcuuuggggcuuccugucccggaacaagaagccuagaauauguaccagggaggaauuuacacgcaaaguccguagcaaugcagcuaucggggccguguucguugacgagaaccaauggaacucugcaaaggaggccguggaagaugagcgguuuugggaccucguccauagagaaagggagcugcacaaacagggaaagugcgcuacgugcguguacaacaugaugggcaaacgcgaaaagaaguugggugaguucgggaaagccaagggaucacgagcgauuugguacauguggcugggcgcacgguuucucgaguucgaagcccuuggcuucaugaaugaggaucacugguuuaguagagaaaacucccugagcgggguagagggagaggguuuacauaaacugggcuauaucuugagggacauuucuaagaucccagggggaaauauguacgcugaugacaccgccggcugggauacucgcauaacagaagacgaucuccagaacgaggcaaaaaucaccgacauuauggaacccgagcacgcucugcuagccaaggcuaucuucaaacuuacuuaucagaauaagguugugagaguccaacggccugccaagaacgguacagugauggaugugauuucgaggcgugaccagcgagggucaggacaggucggcaccuacggccugaauacauuuacuaacauggaagcacagcucauccgccaaauggagagcgaggggauauucuccccaagugaacuggagacccccaacuuggcggaaagagccuuagauuggcuggagaaauauggaguugaacggcucaagaggauggcuauuucuggugacgacugugugguaaaaccgaucgaugaccgcuuugccacggcacuuaccgcucugaaugauaugggcaaggugagaaaagacaucccucagugggagcccagcaagggguggaacgauuggcagcaggucccauucugcucccaucacuuucaccaacuaauuaugaaggacggacgggagauagugguuccuuguaggaaucaggaugaacuggugggccgagcccgugucucacagggugcaggguggagucucagagagacagccugcuugggaaaaucuuacgcgcagauguggcaacugauguauuuccaucgccgggaccuuaggcuggcugccaacgcaaucuguagcgccgugcccguagauuggguuccaacuuccagaaccacauggucaauucacgcucaucaccaguggaugacuaccgaagacaugcucagcguguggaaucgcgucuggaucgaggaaaaccccuggauggaggauaagacgcauauuucuuccugggaggacgugccuuacuuaggcaaacgggaagaccaguggugcggcagucugaucggguugacagccagggcaaccugggcuacuaauauacaaguugccaucaaccaggugcgaagacugauuggaaaugagaacuaccucgauuauaugacaagcaugaagcgguuuaaaaaugaaucggacccagagggugcgcuuugguga

SEQ ID NO: 13726 - RNA, 9879 nt, Artificial Sequence
  derived and/or modified CDS sequence (opt3) from DENV-1__FJ882536__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaaaaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguucaaagaauuugccgcuggccggcgauccgucagcggggaucucauacuugagaucggaaagcugccgcagcacuuaacacagagagcccagaaugcauuggacaaccugguuaugcuccauaauucagaacaaggcggucgcgcguauaggcacgccauggaggagcugccagauacuauugaaacccuuaugcugcucgcuuugaucgccgugcugacagggggcguaaccuuauucuuucuaaguggacggggccuggggaagacuagcauuggacuccuuugugugauggcauccucuguccuguuguggauggcuagcguggagccccauuggaucgccgcauccauaauccuggaguucuuucucaugguucugcuuauuccugagcccgaccgucagagaacgccacaggauaaccagcucgccuacguggucaucggucuguuguucaugauucugaccguagcugcgaaugagaugggcuuacuagaaacaacuaaaaaggaccuggggaucggacacguggccguugagaaccaccaucacgcagcuaugcucgauguggaccuucauccugccucagccuggacccuguacgcagucgcuacaaccauaauuacucccaugaugaggcacacaaucgaaaacacgaccgccaauauuucuuugacugcgaucgcuaaccaagccgcaauacugaugggccucgauaaagguuggccaaucaguaagauggacauuggggugccucugcuugccuuaggcugcuauucgcaggucaauccgcugacacucaccgcugcaguguugaugcugguugcccauuacgcgaucauuggacccggccuacaggcuaaagccacccgcgaggcacaaaagcggacagccgcugggaucaugaagaacccaacuguggauggaauaguagccauugaccuggauccuguggucuaugacgcaaaauuugaaaagcagcucggccagaucaugcuucugaucuuguguacgagccagauucugcucaugcgaaccacaugggcucugugcgaguccaucacuuuagccaccgguccccuuacaacccugugggaggggucuccaggaaaauucuggaauacuacgauagcgguuucaauggccaacauuuuuagaggcagcuaccucgcaggagcuggccuagccuucucccugaugaagagucuagggggaggcaggcgcgggacaggagcacaaggcgaaacccugggugagaaauggaagcggcagcucaaucagcuuucuaagagcgaguucaacacuuauaaaagaucagggaucauggagguggaccguuccgaagcuaaggagggacugaaaaggggcgagaccacaaagcacgccgucagucgggguacugccaaauugcgcugguuuguggaacgaaaucugguaaagccugagggcaaggugauugaucucggguguggaagaggcggguggagcuacuauugcgcgggacuaaagaagguuaccgaagugaaaggcuacacaaagggugggcccggacacgaggaaccgaucccaauggcuacguacggcuggaaccuggucaaacuucauucuggcaaggacguguucuuuauaccucccgagaaaugugauacccugcuaugcgacaucggggaguccucaccaaaucccacuauugaagagggaaggacacuccggguccugaagaugguggaaccuugguugcgcgguaaccaguucuguaucaagauucugaauccguauaugcccagcguuguagagacccucgagcaaaugcagagaaaacacggcgggaugcuugugaggaacccacugucgcgaaauucuacucaugaaauguacugggucaguugcggaacaggcaacaucguguccgcaguuaauaugaccagccggauguuacugaaccguuuuacgauggcccacagaaagccuaccuaugagcgcgauguggacuuggguacagggacuaggcacgucgcuguggaacccgagguagccaaccucgauauuaucggacagcggauagaaaauauuaaacaugagcacaagucaaccuggcauuacgacgaggauaacccuuauaaaacaugggcauaccacggcuccuaugaagugaagccaucuggcagcgccaguuccaugguuaauggggucgugaagcugcuaacuaaacccugggacgugaucccuauggucacccagaucgcuaugacagauaccacuccauucggacaacagagaguuuuuaaggagaaaguggacacgcgcacacccaaggcgaaaagggguaccgcccagauuauggaaguaacugcacgauggcuuuggggcuuccugagccggaacaagaagccgagaauauguaccagggaggaauuuacacgcaaagugcguucuaaugcugccaucggggcagucuucguggacgagaaccaauggaacucagccaaggaggcuguugaagaugagcgguuuugggaccucgugcauagagaaagggagcugcacaaacagggaaagugcgccacgugcgucuacaacaugaugggcaaacgcgaaaagaaguugggugaguucgggaaagcgaagggaagucgagcaauuugguacauguggcugggcgcccgguuucucgaguucgaagcucuuggcuucaugaaugaggaucacugguuuuccagagaaaacagccugucugggguggagggagaggguuuacauaaacugggcuauaucuugagggacauuucgaagaucccugggggaaauauguacgccgaugacaccgcaggcugggauacucgcauaacagaagacgaucuccagaacgaggcuaaaaucaccgacauuauggaaccagagcacgcccugcuagcuaaggccaucuucaaacuuacuuaucagaauaagguaguuagagugcaacggcccgcaaagaacgguacagucauggaugugauuucaaggcgugaccagcgagggagcggacaggugggcaccuacggccugaauacauuuacuaacauggaagcgcagcucauccgccaaauggaguccgaggggauauucaguccuucugaacuggagaccccaaacuuggccgaaagagcuuuagauuggcuggagaaauauggagucgaacggcucaagaggauggccauuagcggugacgacuguguugugaaacccaucgaugaccgcuuugcaacggcucuuaccgcccugaaugauaugggcaagguaagaaaagacaucccgcagugggagccuuccaagggguggaacgauuggcaacaggugcccuucugcucacaucacuuucaccaacuaauuaugaaggacggacgggagauagucgugccauguaggaaucaggaugaacugguuggccgagcacgugugagucagggugccggguggucucucagagagacagcgugcuugggaaaaagcuacgcucagauguggcaacugauguauuuccaucgccgggaccuuaggcuggccgcaaacgccaucuguuccgcugucccuguggauuggguacccacuucaagaaccacauggagcauucacgcccaucaccaguggaugacuaccgaagacaugcucucuguuuggaaucgcguguggaucgaggaaaacccauggauggaggauaagacgcauauuuccaguugggaggacguccccuacuuaggcaaacgggaagaccaguggugcggcagccugaucggguugacagcaagggcuaccugggccacuaauauacaaguggcgaucaaccagguucgaagacugauuggaaaugagaacuaccucgauuauaugacaucgaugaagcgguuuaaaaaugaauccgacccugagggugcucuuugguga

SEQ ID NO: 13727 - RNA, 9879 nt, Artificial Sequence
  derived and/or modified CDS sequence (opt3) from DENV-1__FJ882537__SS-prME
agcgugacaaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggagaacugugugaagauacuaugaccuacaaaugcccacggauaacagaaguggaaccggacgauguagacuguuggugcaauaccacugauacaugggugaccuaugggacguguagucagacuggagaacaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgauugcuacaaucacaccccaggccccuacuagcgagauccagcugaccgacuacggggcgcucacacuugauuguucuccaagaaccggacuggacuucaacgaaaugguguugcuaacuaugaaagagaaguccuggcugguacauaaacagugguuucucgaucugccgcuucccuggacaucaggcgccagcacgagucaagagaccuggaauaggcaggaccuguugguuacuuucaagacagcacacgcuaagaaacaggaaguggucgugcucgguucucaagagggggccaugcacaccgcucugacaggcgccacugaaauucagaccacgggaaccacaacuauauuugcaggccauuuaaagugccggcugaaaauggauaagcuaacccucaaagggauguccuaugucauguguacaggcagcuucaagcuggagaaggaaguggccgagacucagcacgguaccguucuugugcagaucaaauacgagggcacggacgcuccuugcaagauuccauucucgacacaagaugaaaaagggguaacccagaacggacguuugaucacugcgaaucccauagucacagacaaggagaaaccugugaacauugaagcagagccacccuuuggcgagucuuauaucguuaucggugccggggaaaaggcucugaagcucuccugguucaaaaagggcucaaguauuggaaaaauguuugaggccaccgcacgcggcgccagaaggauggcuauccugggggauacugccugggacuucggaagcauugguggcguguuuaccuccgucgggaaacuugugcaucagauauucggaacagcauacggcguacuguuuucuggugugagcuggacgaugaaaaucgggauuggcguuuugcucaccuggcugggauuaaauucacggaguacuucccugagcaugacauguaucgcggucggccuaaucacccucuaccugggggugauggugcaggcugauucuggaugcgucauuaacuggaagggccgagaacuuaagugugguucagggauauucguuacaaaugaggugcacacuuggaccgaacaauauaaauuucaggccgacaguccgaagcgcuugagcgcagccaucggaaaggcuugggaggagggcgugugcgguauuagauccgccacgaggcuggaaaacaucauguggcggcagauuucuaacgagcucaaucauauccuguuagaaaacgacaugaaguucacaguagucgugggcgauguuguggggauacuggcacagggcaagaagaugguccgcccucaacccauggagcacaaauacucguggaaaagcuggggcaaggcuaagaucauuggggccgacgugcagaauaccacuuuuaucauugauggaccaaacaccccugaaugucccgacgaucagagagcguggaauaucugggagguugaggacuauggcuucgguauauuuacaacuaacauuuggcuuaaguugagggauuccuacacccaggugugcgaccaccgucucaugucagccgcuaucaaagauaguaaggcaguacaugccgacaugggguauuggauugaaucugagaaaaaugaaacauggaagcuggcucgggccagcuucaucgaggucaagacguguauauggccaaaaucccacacccuauggucaaacggagugcuggaaagcgagaugaucauucccaagaucuacggcgguccuauuucucaacauaauuaucgaccaggcuacuucacucagacagcagggccguggcaccucggaaaacuggagcuugauuuugacuugugcgaaggcaccacuguggucguugaugagcacugcgggaacagaggacccucccugaggacaaccacggugacuggcaagaucauacaugaaugguguugccgcaguuguaccuuaccuccacuccgguucaaaggugaggacgggugcugguacggaauggagauuagacccguaaaggaaaaggaggaaaaucuggugaaaagcauggucucugcgggcuccggugagguggacucauuuagucuuggccuguuguguaucagcaucaugauugaagagguuaugaggucgcgcuggucccgaaagaugcucaugacagggacccuggccguguucuuucuacugaucaugggacagcucacuuggaacgaucugauucggucuugcauaauggucggcgcuaaugccagcgaccguauggggaugggaacaaccuaucuugcauugauggcuacauucaaaaugagaccuauguuugccgugggccuguuauucaggcgccucacuucacgggagguucugcuucugaccaucggucuaagucucguggcauccgucgaacugccaaacucuuuggaggaacugggggauggauuagccaugggcauuaugauccucaagcugcuuacggacuuucaaagcuaccagcugugggcuacauugcucucccugaccuucauuaaaacuaccuuuucacuacacuaugcguggaagacaauggccaugguacugagcaucgugagucuucucccccuguguuugucuacuaccucccagaagacgacauggcugccgguuuuacucggcagccuggggugcaaaccucuuaccauguuccugauagcagagaauaagaucuggggaagaaaaucguggccauugaacgaagguauuauggcugugggcaucgucucaauucuccugucuagucuacugaagaacgaugugccccuugccgggccucucaucgccggaggcaugcugauagcuuguuacguaauuuccgguagcucugcagacuugagcuuagagaaagccgcggagguguccugggaagaggaagcugagcauucaggggccagucacaauauccuggucgaaguucaggaugacggaacuaugaagaucaaagaugaggagagggacgauacacucaccauucugcuuaaggcaacucuguuggccgugagcggcguguauccccuaucuauaccagcuacacuguuugucugguacuucuggcaaaagaaaaagcagcgauccggcgugcucugggacaccccuucacccccagaaguugagcgcgcaguacuggaugacgggaucuaucggauuaugcagagaggacuuuuagguaggagucaggugggcgucgggguguuccaagaaaacguuuuucauacgauguggcacgugacucguggagccguccugauguaccagggcaaacgccucgagccgagcugggcguccgugaagaaagacuugaucucuuacggugggggauggcggcugcagggcucguggaauaccggcgaggaaguacaggucauugcuguggagccugggaagaaccccaagaauguucaaacagccccaggaaccuucaaaacacccgaaggugaggugggcgcaaucgcccucgauuuuaagccugggacuagcggaucaccaauagucaacagagaaggcaaaaucgugggucuguaugggaauggaguugugaccacguccggcacauacgucagugcuauugcccaggcaaaggcuucucaggagggcccccuuccugagaucgaagacgagguguucaggaaacgaaaccugacuauuauggauuugcacccggggagcggaaagacccggcgcuaucuaccagccaucguaagagaagcgauaaagaggaaacugcggacacucauuuuagcccccacccgagugguugcauccgagauggcugaagcccugaaggguaugccuaucagauaccaaacuaccgcugucaaaucagagcauacaggccgcgagaucguggaccuuaugugccacgcaacguuuacuaugaggcugcucucuccagugcguguccccaauuauaacaugauuaucauggaugaagcccauuucaccgacccuagcaguauagccgcucggggguacauuuccacaagaguaggaaugggcgaggcggcagccaucuuuaugaccgcuacuccgcccgguagcguggaagccuucccacagucuaaugcaguuauucaggaugaggaaagggacaucccugagcgcucauggaacuccggguaugaguggauaacagauuuucccggaaagaccgugugguucgucccaaguauuaaaagcggcaaugacaucgccaacuguuugcgaaagaauggcaagagagugauccagcugucgcggaaaacguuugauacugaauaccaaaagaccaagaacaacgacugggacuacguugugaccaccgauauuucugagaugggggcuaauuucagggcggaccgcgucaucgauccucguagaugccucaagcccgugauucugaaagacggaccagaacggguaauacuugccgguccgaugccugugacuguugcauccgcugcccagaggcgcggccgaaucgggagaaaccacaauaaggagggagaucaguauauuuacaugggccagccccuaaacaaugacgaggaucaugcacacuggacagaagccaagaugcuguuggacaacaucaauaccccagaggguaucauucccgcuuuauucgaaccugagcgggagaaaagcgccgcgauagauggggaguauaggcugcgcggcgaggcaagaaagacauuugucgaacucaugaggcggggagaccugccaguguggcuuucauacaaaguggccagugagggcuuccaauauucugaucgucgcuggugcuuugacggggaacgaaacaaucagguccuggaggaaaacauggauguugagaucuggacuaaggagggagaaaggaaaaagcucaggccccggugguuggacgcucgcacguacuccgacccucuggcccuaagagaguucaaagaauuugcugcagguaggcggagcgugucaggcgaucugauucucgagaucgggaaacuuccgcagcaccugacccagcgagcccaaaaugcuuuagacaacuugguaaugcugcauaauagugaacagggaggcagagccuaucgccacgcaauggaggagcucccagauacaauugaaacucugaugcuucuggcgcucaucgccguguugaccgguggggucacacuguucuuuuuaagcggcaggggacuaggcaagaccuccauagggcugcucugugugauggcuucuagcgcccuucuguggauggcauccguugagccccauuggaucgcugccucaauuaucuuggaguucuuucugauggugcuccugauuccugagcccgaccggcagcguacuccacaggauaaccaacuugcauacgucguaaucggacuccuguucaugauauugacgguggccgcuaaugagaugggucuguuagaaaccaccaaaaaggaccuaggcauugggcacguugcgguggagaaccaccaucacgccacuaugcuggaugucgaccuccauccugcaucugcuuggacccuuuacgccguggccacaaccaucauuacucccaugaugagacacacaaucgaaaacacgaccgcaaauauaagucugacugcuaucgccaaccaggcggcuauuuugaugggacuggauaaaggcuggccaaucucgaagauggacauuggugucccucuccuggcccuugggugcuauagccaggugaauccguuaacacugaccgcagccguucucauguugguggcucauuacgcaaucauaggccccggacugcaagccaaagcgaccagggaggcucagaagcgcacagccgcaggcauuaugaagaacccaacuguagaugggaucguggccaucgaccuagauccugucguuuaugacgcuaaauuugaaaagcagcugggacagauuaugcuccuuauccuguguacgucccaaauauugcugaugcggaccacaugggcccucugcgagucuauuacucuggcaaccggccccuuaacaacccuuugggaggguucaccagggaaauucuggaauacuacgaucgcugugagcauggccaacauuuuucgaggauccuaccuggcgggcgccggucucgcauucagucuaaugaagucucugggcgggggaagaaggggcacaggggcucagggagaaaccuugggcgagaaauggaagcgccagcugaaucagcucagcaagucagaguucaacacuuauaaacgguccgguaucauggaggucgacagaagugaagccaaggaggggcuucguaggggagagaccacaaaacacgcagugagccggggcacugcuaagcugcgcugguuuguagaacgaaauuuggugaaaccugaggguaagguuauagaucugggcugugggagaggaggcuggucuuacuauugcgccgggcucaagaaagugaccgaagucaagggauacacaaaaggcggucccgggcacgaggaaccgaucccaauggccacguacggauggaacuuagugaagcugcauuccggcaaagacgucuucuuuauuccucccgagaagugugauacccuucugugcgacaucggcgagucaagcccaaaucccacuauugaagaggggaggacacuacgggugcucaaaaugguugaaccuuggcugcgcggaaaccaauucuguaucaagauuuugaauccguauaugcccucgguaguggagacccuggagcacaugcagagaaagcaugguggcaugcucgucaggaacccacuuucucgaaauaguacucacgaaauguacuggguguccugcgggacaggaaacaucguuagcgcggugaauaugaccucacggaugcuguuaaaccguuuuacgauggcucacagaaaaccuaccuaugagcgcgaugucgaccugggcgcagguacaaggcauguggccguagaacccgagguggcuaacuuggauauaauugggcagcggaucgaaaauaucaagcacgagcauaaauccacuuggcacuacgacgaggauaacccuuauaagaccugggccuaccauggaucuuaugaaguuaaaccaagcggcagugcauccagcauggucaauggcguggugaagcuccugacaaagcccugggacgucauuccuaugguuacucagauagccaugaccgauacaaccccauucgggcaacagagaguguuuaaagagaagguagacacucgcacgcccaaagcuaagaggggaacagcgcagaucauggaagugaccgcccgauggcuaugggguuuccuuucucggaacaaaaagccgagaauuuguacuagggaggaauuuacccgcaagguccguucaaaugcagcuaucggcgccguguucguugacgagaaccaauggaauagugcaaaagaggccguggaagaugagcgguuuugggaccugguccacagagaaagggagcuccacaagcaggggaaaugcgcuacaugcguguacaacaugaugggaaagcgcgagaaaaagcugggcgaguucgguaaggccaaagggucccgagcgauuugguacaugugguugggagcacgguuucuggaguucgaagcccucggcuucaugaaugaggaucauugguuuagcagagaaaacucucuuucgggcguagagggggagggacugcacaaguuagguuauauccugagggacauaucaaaaaucccuggcgggaauauguacgcugaugacacggccggaugggauacccgcauuacugaagacgauuugcagaacgaggcaaagaucacagacauuauggaaccagagcaugcucuccuggccaccagcaucuucaaacuaacuuaucagaauaagguugugagaguccaacggcccgcuaaaaacggcacagugauggaugugauauccaggcgugaccagcgagguagugggcaggucggaaccuacggccuuaauacauuuacuaacauggaagcccagcugauucgccaaauggagucugagggcaucuucagcccuuccgaacucgagaccccaaaccuggcagaaagaguuuuggauugguuagagaaguaugggguggaacggcugaagaggauggcgaucucaggagacgacuguguagugaaacccauugaugaccgcuuugccacggcucucaccgcccuuaaugauauggguaaggucagaaaagacauaccgcagugggagccuaguaagggcuggaacgauuggcaacaggugcccuucugcucucaccacuuucaucaacugaucaugaaagacgggcgggagauuguugugccauguaggaaucaggaugagcuagucggacgagcacgugugagccagggcgcugguuggucccugagagagacagccugccucgggaagucauacgcacagauguggcaauugauguauuuccaccgccgggaccugaggcuugccgcgaacgcuaucuguagcgccguaccuguugauugggugcccacuucuagaaccacaugguccauucaugcacaccaucaguggaugacuaccgaagacaugcugagugucuggaaucgcguguggaucgaggaaaacccauggauggaggauaagacgcacauaagcucguggggagacguucccuaccucggcaaacgggaggaccaguggugcggcuccuuaaucgggcugacagccagggcuaccugggccacuaauauucaaguggcaaucaaccagguccgaagauugauuggaaaugaaaacuaccuggauuauaugacaucuaugaagcgguuuaaaaaugagucagacccugaaggugcucucugguga

SEQ ID NO: 13728 - RNA, 9879 nt, Artificial Sequence
  derived and/or modified CDS sequence (opt3) from DENV-1__GQ868606__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaaucaucgaccaggcuacuuuacacaaaccgccgggccguggcaccugggaaagcucgagcuggauuucgaccuuugcgaaggcacuacagucgugguggaugagcacugcgggaacagaggacccaguuugaggaccacgacugucaccggcaaaaucauucaugaaugguguugccgcagcuguacacugccuccauuacgguuuaagggugaggacgggugcugguacggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaucuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaccaacugugggccaccuugcucucccugacuuuuauuaagaccacauucucacuacauuacgcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuaugucaucuccgguagcucugcggaccugagcuuggagaaggcugccgagguguccugggaagaggaagcagagcacucaggggccagucauaauauauuaguagaagugcaggaugacggaacaaugaaaauuaaggaugaggagagggacgauacccugacuauccuccugaaggcuacacuucuggcagucagcggcguuuaccccuugucuaucccagccacccuauucgugugguauuuuuggcagaaaaagaaacaacgauccggcgugcugugggacacgccuucacccccagaagucgagcgcgcggugcucgaugacgggauuuaccggauaaugcagagaggacugcuugguaggagucagguuggcguagggguguuccaggaaaacgucuuucacacuauguggcacgugacccguggagcuguuuuaauguaucaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuacgggaauggagucgugacgacaaguggcacuuauguuucugcaauagcucaagccaaagcgagccaggagggcccacugcccgagaucgaagacgagguguucaggaagcgaaaccuuaccauuauggaucugcauccuggguccggaaagacacggcgcuacuugccggccaucgucagagaagcaauuaaaaggaagcuacggacccugauccucgcuccaacucgagugguagccucagagauggcugaagcauuaaaagguaugcccauaagauaucagaccacagccgugaagucugagcacacgggcaaagagauuguugaccugaugugccaugccacuuuuaccaugcgccuucugagcccugucagggugccaaauuacaacaugaucaucauggaugaagcucacuucacagaccccaguuccauugcggcacguggguauaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguacgaguggauuaccgauuuuccuggaaagacggugugguucguucccagcaucaagucgggcaaugacauagcgaacugucuccgcaaaaauggcaagcgagugauucaguugucuagaaaaacuuucgauacagaauaucagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccauaauaaagagggagaucaguacauauauaugggccagccucuuaacaaugacgaggaucacgcucacuggaccgaagccaagaugcuacuggacaacaucaauacacccgaggguauuaucccagcguuguucgaacccgagagagaaaaaucagcagccaucgauggggaguaccgguuaaggggcgaggcucgcaagacuuuuguggaacugaugagaaggggagaccucccuguuuggcugaguuauaaagucgccucugagggcuuccaguacuccgaucggcguuggugcuuugacggggaacgcaacaaucaagugcuugaggaaaacauggauguggagauuuggacgaaggagggagaacgaaagaaacugagaccaagguggcucgacgcucggaccuauagcgaccccuuggcacugcgcgaguucaaagaauuugccgcugguagaaggucagucaguggcgaucuaauacuggagaucgggaaacucccucagcaucuuacacagcgggcccagaaugcacuggacaacuuaguuauguugcacaauagcgaacaaggaggccgagcguacagacaugccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacacuggaucgccgcaucuauaauccuggaguucuuuuugaugguucugcucauucccgagccugacaggcagcggacgccccaggauaaccagcuggccuauguggucaucggacuucucuucaugauucugaccguagcugcgaaugagauggguuugcuggaaacaacuaaaaaggacuuaggcaucgggcacguggccguugagaaccaucaccaugcagcuaugcuagauguggaccugcacccagccagugccuggacccucuacgcagucgcuacaaccauaauuacuccuaugaugcgucauacaaucgaaaacacgaccgccaauauuucgcuuacugcgaucgcuaaccaagccgcaauacugaugggauuggauaaaggcuggcccaucagcaagauggacauuggugugccacugcucgcccuggggugcuacucccaggucaauccucuuacauuaaccgcugcagugcugaugcucguugcccacuaugcgaucauuggcccgggauugcaggcuaaggccaccagagaggcacagaagaggacagccgcuggcaucaugaagaaccccacuguggaugggauaguagccauugaccuggauccaguggucuacgacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaucuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuacaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuauuacugcgcggggcugaaaaagguuaccgaagugaaaggauauacaaagggcgguccugggcaugaggaacccaucccgauggcuacguacggauggaaccucgucaaauuacacucaggcaaggacguguucuuuauaccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuacaugccgucuguuguagagaccuuggagcaaaugcagcggaaacaugguggcaugcuggugcgcaacccccucaguagaaauuccacucacgaaauguauugggucagcugcgggacaggaaacaucgugucagcaguuaauaugaccuccaggaugcuucugaaccgauuuacgauggcccaccggaagccaaccuacgagcgugauguggacuuaggcgcugguacaagacaugucgccguggaaccugagguagcaaaccuggauauuaucgggcagcgcauagaaaauauuaaacacgagcauaagucuacuuggcacuaugacgaggauaaccccuacaagaccugggccuaucauggaagcuacgaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaccgcgaacgugagcugcacaagcaggggaagugcgcgacaugcgucuauaacaugaugggaaaacgggaaaagaaacucggcgaguucgguaaggcaaaagggagcagagccauuugguacauguggcugggagcuagguucuuggaguuugaagcccugggcuucaugaaugaggaucauugguuuucucgcgaaaacucgcucucaggcguggagggggagggacuucacaagcuggguuacaucuuacgagacauuagcaaaaucccgggcgggaauauguaugcagaugacacggcuggaugggauacccggauaacugaagacgaucugcagaacgaggccaagaucacagacauuauggaaccugagcaugcuuugcucgccaaguccaucuucaaacugaccuaccagaauaagguaguuagagugcaaaggccagcacgcaacggcacugucauggaugugauuaguagacgggaccagagggguucuggacaggugggaacauauggccuaaauaccuuuacaaacauggaagcgcagcuuauccgucaaauggagagcgagggcauauucucccccucagaacuggagacuccuaaccucgccgggcgaguccuggauugguuggaaaaacacggaguugagcgcuuaaagagaauggcuauuaguggugacgacugugugguaaaaccaaucgaugaccgguuugccaccgcacugacggcucucaaugauaugggcaaggugaggaaggacaucccccagugggaaccgucuaaaggguggaacgauuggcagcaggucccuuucugcagccaccauuuucaccaacuuauuaugaaggacggacgcgagauagugguucccuguagaaaucaggaugagcuggugggccgggccagggucucccagggugcaggguggucacuacgagaaaccgccugccugggaaaaagcuacgcgcagauguggcaacucauguauuuccaucguagagacuugcgccuggcugccaacgcaaucuguucugccgugccaguagauuggguuccuacaucccggacuaccuggaguauucacgcucaucaccaguggaugacaacugaggacaugcuuagcguguggaauagggucuggaucgaagagaaccccuggauggaagauaagacccacauuucguccuggggcgacgugccauaccugggcaaaagagaggaccaguggugcgggucucucaucggauuaacggcccgcgcaacaugggcuaccaauauacaaguugccaucaaccaggugcggaggcugauugguaaugagaacuauuuggauuacaugacuucaaugaagcgauuuaagaaugaaagcgaccccgagggcgcgcugugguga

SEQ ID NO: 13729 - RNA, 9879 nt, Artificial Sequence
  derived and/or modified CDS sequence (opt3) from DENV-1__FJ882539__SS-prME
agcgugacaaugcugcucaugcuuaugcccacagcacuggcuuuccacuugacuacgcgaggcggggaaccucauaugaucgucuccaagcaggaaaggggaaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcacuugcuagccaagagacuuggaaucggaaagaccuguugguaacauuuaagaccgcccacgcuaagaaacaggaaguugugguccucgguagucaggagggggccaugcacacagcacugacuggcgccaccgaaauccaaacgucuggaaccacaacuaucuucgcuggccauuuaaagugccgucugaaaauggauaagcuaacccucaaagggauguccuaugugauguguacagggagcuucaagcuggagaaggaagucgcggagacucagcacgguaccgugcuuguucagauuaaauacgagggcacggacgcaccuugcaagauaccauuuucgacacaggaugaaaaagggaucacccaaaacggacgcuugauuacugccaaucccaucgugacagacaaggagaaaccuguaaacauagaagcugagccacccuucggcgagucuuauauugucaucggugccggggaaaaggcacugaagcucuccugguuuaaaaagggcucaaguaucggaaaaauguucgaggccaccgcuagaggcgccaggcggauggcaauucugggggauacugcgugggacuuuggaagcaucgguggcguguucaccuccguugggaaacuugugcaucagauuuuuggaacagcuuacggcguccuguucucuggugugagcuggacgaugaaaauagggaucggcguauugcucaccuggcugggauuaaauucacgaaguacuucccugagcaugacauguauugccgugggccuaguuacccucuaccugggggucauggugcaggcagauucuggaugcgugaucaacuggaagggccgcgaacuuaagugugguucagggaucuuugucacaaaugagguucacacuuggaccgaacaguauaaauuccaagccgacaguccgaagagauugagcgcugccauuggaaaagcaugggaggagggcgugugcgguauaagguccgcuacgcggcuggaaaacaucauguggaagcagauuucuaacgagcucaaucauauccuguuagaaaacgacaugaaauuuacagugguagucggcgauguggccgggauucuggcgcagggaaagaaaaugauccgcccucagcccauggaguacaaguauucguggaaaagcuggggcaaagccaagauaaucggggcugacguucaaaauaccacuuucauuaucgauggaccaaacaccccugaaugucccgacgaucagagagcauggaauauuugggagguggaggacuacggcuuugguaucuucacaacuaacauauggcuuaaauugagggauuccuauacccaggucugcgaccaccgucucaugucagccgcuauuaaggauaguaaagccgugcacgcagacaugggguacuggaucgaaucugagaagaaugaaacauggaagcuggcgcgggccagcuucauugagguuaaaacguguaucuggccaaagucccauacccuauggucaaacggagugcuggaaagcgagaugauaauccccaaaauuuauggcgguccuaucucucagcacaaucaucgaccaggcuacuuuacucaaacagcugggccguggcaccucggaaagcuggagcuugauuucgacuugugcgaaggcaccacuguagucguggaugagcacugcgggaacagaggacccucccugaggacaaccacggugacuggcaaaauuauccaugaaugguguugccgcaguuguaccuuaccuccacuccgguuuaagggugaggacgggugcugguacggaauggagauaagacccgucaaggaaaaagaggaaaaucugguuaagagcauggugucugccggcuccggugagguagacucauucagucuuggccuguuguguauuagcaucaugaucgaagaggugaugaggucgcgcuggucccgaaaaaugcucaugacagggacccuggcagucuuuuuccuacugauuaugggacagcucacuuggaacgaucugauccggcuuugcauuauggugggcgcuaaugccucugaccguauggggaugggaacaaccuauuuggcacugauggccacauuuaagaugagaccuauguucgcuguuggcuuacucuuuaggcgccugacuagccgggaggugcuucugcuaaccauaggucucucacuggucgcgaguguggaauugccaaacucccuggaggaauuaggggauggacucgccaugggcaucaugauucugaaacuucugacggacuuccagucucaccaauugugggcaacacuccugagccuaaccuuuaucaagacuaccuucucccugcauuacgcuuggaagacaauggccaugguucuuucaauugugagccucuuuccccuguguuugaguacuaccucucagaaaacgacauggcugccggucuuacucggcucccuggggugcaagccucuuaccauguuccugaucgccgagaauaaaauauggggaagaaagagcuggccauugaacgaagguaucauggcuguaggcauugugucgauccuccugucaucucuacugaaaaacgauguuccccuugcagggccucucauugccggaggcaugcugaucgcguguuaugugauaagugguuccagcgcugacuugucuuuagagaaggccgcagaggucagcugggaagaggaagccgagcacuccggggcuucacauaauauucugguggaaguacaggaugacggaacuaugaaaaucaaggaugaggagagggacgauacacucaccauccugcuuaaggcaacucuguuggccgugaguggcgucuacccccuaagcauuccagcgacacuguucguuugguauuuuuggcagaaaaagaaacaacgaucuggcgugcucugggacaccccuucacccccagaaguggagcgcgcuguccuggaugacgggauauaccggaucaugcagagaggacuuuuagguaggagccaggugggcguugggguauuccaggaaaacguguuucacacgauguggcacgucacucguggagccgugcugauguaucaaggcaagcgccucgagccgaguugggcaagcguuaaaaaggacuugauuuccuacggugggggauggcggcugcagggcucuuggaauaccggcgaggaagugcaggucaucgccguggagccugggaagaaccccaaaaauguacagacagcuccaggaaccuucaagacaucggaaggugaggucggcgccauugcacucgauuuuaaacccgggacuagcggaucaccuaucgugaacagagaaggcaagauaguuggucuguacgggaauggaguggucaccacguccggcacauaugugagugcuaucgcccaagcgaaagccucucaggagggcccacuucccgagauugaagacgagguuuucaggaagcgaaaccugacuaucauggauuugcauccugggagcggaaagacccggcgcuaccuaccggcaauugugagagaagcuaucaaaaggaagcugcggacacucauauuagccccaacccgagucguggcuuccgagauggcagaagcccugaaagguaugcccauuagauaucagacuaccgccguaaagucagagcacacaggcaaagagaucguggaccuuaugugccaugcuacguuuacuaugcgccugcucucuccuguuagggucccaaauuacaacaugaucauuauggaugaagcgcacuucaccgaccccagcaguaucgcagcccguggguauauauccacacgggugggaaugggcgaggcugccgcaauuuuuaugaccgccacuccuccggguagcguggaggcuuucccccaaucuaaugcggucauccaggaugaggaaagagacauuccagagaggucauggaacuccggguacgaguggaucacagauuuuccuggaaagaccguaugguucgugcccaguauaaagagcggcaaugacauugccaacuguuugcgcaaaaauggcaagcgaguuauccagcugucgagaaaaacguucgauacugaauaucagaagaccaagaacaacgacugggacuacguggucaccaccgauaucucugagaugggggcaaauuuucgggcugacagggugauugauccacgccguugccucaagccuguuauccugaaggacggacccgaaagagugauucuugccgguccaaugccggucacuguggcauccgccgcucaacggaggggccgcauagggcgaaaccauaauaaagagggagaucaguacaucuauaugggccagccucuaaacaaugacgaggaucacgcccacuggacagaagcgaagaugcuguuggacaacauuaauacccccgaggguaucaucccagcauuauucgaacccgagagagagaaauccgccgcuauugauggggaguaccggcugaggggcgaggcccgcaagacauuuguagaacucaugagaaggggagaccugccuguguggcuuucauauaaaguugcuagugagggcuuccaguacucugaucggcguuggugcuuugacggggaacgcaacaaucaaguccuggaggaaaacauggauguggagauauggacuaaggagggagaaagaaagaagcucagaccaaggugguuggacgcacggacguauuccgacccccuggcccuacgcgaguucaaggaauuugcugccgguagaaggagcgugucaggcgaucugauccucgagauugggaaacuuccucagcaucugacccagcgggcacagaaugcguuagacaacuuggucaugcugcacaauagugaacaaggaggccgagccuacagacaugcuauggaggagcucccggauacaaucgaaacucugaugcuucuggcccucauugcaguuuugaccgguggggugacacuguucuuuuuaagcggccgcggacuaggcaagaccuccaucgggcugcucuguguaauggcuucuagcgugcuucuguggauggccuccgucgagccacacuggauagcagccucaaucauuuuggaguucuuucugauggugcuccugauccccgagccugacaggcagcggacuccccaggauaaccagcuugcuuauguugugauuggacuccuguucaugaucuugacggucgcggccaaugagaugggucuguuagaaaccaccaaaaaggaccuaggcauagggcacguagcaguggagaaccaucaccaugcugccaugcuggauguugaccuccacccagccucugcauggacucuuuacgcuguggccaccacaauuaucaccccuaugaugcgucauacuauugaaaacacaacggcgaauaucagucugaccgcuauagccaaccaagcagccaucuugaugggacuggauaaaggcuggcccauuucgaagauggacaucggugucccacuccuggcucuugggugcuacagccaggugaauccuuuaacucugacagcagccguccucauguugguggcgcacuaugcuauuaucggcccgggacugcaggccaaggcaaccagagaggcccagaaaaggaccgcugccggcauaaugaagaaccccacaguugaugggauuguggcaaucgaccuagauccaguaguguacgacgcuaaauuugaaaagcagcugggacagaucaugcuccuuauucuguguacuucccagaucuugcugaugcgcacgaccugggcccucugcgagucuauaacacuggcgacuggcccuuuaaccacacuuugggaggguucacccgggaaauucuggaauaccacuauugccgucagcauggcaaacaucuuccggggauccuaucuggcuggcgccggucucgcauuuagucuaaugaagucucugggcgggggacgaagaggcacgggggcucaaggagaaacauugggcgagaaguggaaaaggcagcugaaucagcucagcaagucagaguucaacaccuacaaacgcuccgguauuauggagguugaccggagugaagccaaggaggggcuuaaaagaggagagacuaccaagcacgccgugagccguggcacagcgaagcugaggugguuugucgaacggaauuuggugaaaccagaggguaagguaaucgaucugggcugugggcgcggaggcuggucuuauuacugcgcugggcucaaaaaggugacugaaguuaaaggauauaccaagggcgguccugggcaugaggaacccauaccgauggcaacauacggauggaacuuagugaaacugcacuccggcaaggacgucuucuuuaucccaccugagaagugugauacgcuucugugcgacauuggcgagucaagccccaauccaaccaucgaagaggggcgaacucuaagagugcucaaaauggucgaacccuggcugaggggaaaccaguucuguauuaagaucuugaauccuuacaugccgucggugguugagacacuggagcaaaugcagcggaaacaugguggcaugcucguacgcaacccccuuucuagaaauaguacccacgaaauguauuggguguccugcgggacuggaaacauugucagcgccgugaauaugacaucaaggaugcuguuaaaccgauuuaccauggcucaccggaagccaacguacgagcgugauguugaccugggcgccgguaccagacauguggcagucgaaccugagguggccaacuuggauaucauagggcagcgcauugaaaauaucaaacacgagcauaaguccacauggcacuaugacgaggauaaccccuacaagacuugggcuuaucauggaucuuacgaaguaaaaccuagcggcagugcguccagcauggugaauggcguugucaagcuccugaccaaaccaugggacgugauccccauggugacacagauugccaugacugauaccacaccuuucgggcaacagagggucuuuaaggagaaaguugacacccggacuccaaaggcaaagagaggaacggcucagauaauggaagugacagccaaauggcuaugggguuuccuuucucgcaacaagaaacccaggaucuguacccgagaggaauuuacucggaagguaagaucaaaugcagccauuggcgcuguguucgucgacgagaaccaauggaauagugccaaagaggcgguggaagaugagagguuuugggaccugguucaccgcgaacgugagcuccacaagcaggggaagugcgcaaccugcguguauaacaugaugggaaaacgggaaaagaaacugggcgaguucgguaaggccaaaggguccagagcuaucugguacaugugguugggagccagguuccuggaguuugaagcacucggcuucaugaaugaggaucauugguuuagccgcgaaaacucucuuucgggcgucgagggggagggacugcacaaguuagguuacauucugcgagacaucucaaaaauaccgggcgggaauauguaugcugaugacacagccggaugggauacgcggaucaccgaagacgauuugcagaacgaggcuaagauuacugacaucauggaaccugagcaugcccuccuggcaaagagcauuuucaaacuaacauaccagaauaaggugguaagaguucaaaggccagcgaaaaacggcaccgugauggaugucaucucccgcagagaccagcgggguaguggacaggugggaacuuauggccuuaauacauuuaccaacauggaagcccagcugauaaggcaaauggagucugagggcauuuucagccccuccgaacucgagacaccuaaccuggcugggcguguguuggauugguuagaaaagcacggagucgagcgacugaaacgcauggccaucucaggugacgacuguguugugaagccaaucgaugacagauuugcaacugcucucaccgcccuuaaugauaugggcaagguacggaaagacauuccccagugggaaccgaguaagggguggaacgauuggcaacaggugccuuucugcucucaccauuuucaccaacugauaaugaaagacggaagggagaucgucgugcccugucgcaaucaggaugagcuaguuggcagagcacgggugagccagggugccggguggucccugagggaaacggcgugccucggaaagucauacgcucagauguggcaauugauguauuuccaucgacgugaccugagacuugccgcaaacgccauuuguagcgcugucccaguggauuggguaccuaccucucgcacaacuugguccauccacgcccaucaccaguggaugaccacagaggacaugcugaguguuuggaaucggguguggauugaagagaaccccuggauggaagauaaaacucacaucagcucguggggcgacgucccauaccucggcaagagggaggaccaguggugcggguccuuaauaggacugaccgcaagagcuacgugggccacaaauauccaaguggcgauuaaccagguucgccgguugaucgguaaugagaacuaucuggauuacaugaccucuaugaagagguuuaaaaaugaaucagaccccgagggcgcucucugguga

SEQ ID NO: 13730 - RNA, 9879 nt, Artificial Sequence
  derived and/or modified CDS sequence (opt3) from DENV-1__FJ882541__SS-prME
agcgugaccaugcugcucaugcuuauccccacagcccuggcuuuccacuugacuacgagaggcggggagccucauaugauugucuccaagcaggaaaggggaaaaucuuuacuguuuaagaccucagcagguguuaacaugugcacacuaauagccauggaccucggcgagcugugugaagauacuaugaccuacaaaugcccacggaucacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauucagaagguugaaacuugggcccucaggcacccuggauucaccgugaucgcucuguuucuggcacaugccauuggcacaucgaucacccagaagggcauaaucuucauucucuuaaugcuggucacgccaucaauggcuaugcggugcguggggaucggaagccgcgauuuuguagagggucuuaguggcgccacuuggguugacguggucuuggagcacggguccugugugacaaccauggcgaaagauaagcccacucuggacauugaacuacucaaaacagaggugaccaacccugcaguccugagaaagcuuugcaucgaagccaaaauaucuaauacgaccacagauagcagguguccaacucaaggagaggcuacccugguugaagagcaggacgccaacuucgugugccggcgcacauuuguagaucgaggcugggguaauggguguggauuguucggcaagggcucccucauuacuugcgcaaaguuuaaaugcgugaccaagcuggaggggaaaaucguccaguacgaaaacuuaaaguauucagugauuguuacagugcacaccggagaccagcaucaagucgguaaugagaguacugaacacggcacgacagcuaccaucacuccccaggccccuaccagcgagauccagcugacagacuacggggcgcucacccuugauuguucuccaagaacuggacuggacuucaacgaaaugguguugcuaacaaugaaaggcaaguccuggcugguacauaaacagugguuucucgaucugccgcuucccuggacgucaggugccagcaccagucaagagacuuggaauaggcaggaccuguugguuacauucaagaccgcacacgcuaagaaacaggagguggucgugcucgggucucaagaaggcgccaugcacacagcucugacuggagccaccgagauucagacguccggcaccacaacuauauuugcagggcauuuaaagugccggcugaaaauggauaagcuaacccucaaaggaaugagcuaugucauguguacagguucguucaagcuggaaaaggagguggccgaaacucagcacggcaccguucuugugcagaucaaauacgaggggacggacgcuccuugcaagauuccauucucuacacaagaugagaaaggaguaacccagaacggccguuugaucacugcgaaucccauagucacagacaaggaaaaaccugugaacauugaggcagaaccacccuuuggugaguccuauaucguuaucggggccggcgagaaggcucugaagcucucaugguucaaaaagggaaguagcauuggcaaaauguuugaagccaccgcacgcggggccagaaggauggcuauccugggagauacugccugggacuucgguuccauuggcgggguguuuaccucugucggaaagcuugugcaucagauauucggcacagcauacgguguacuguuuagcggggugucauggacgaugaaaaucggcauuggaguuuugcucaccuggcugggcuuaaauagucgguccacuagccugucuaugacauguaucgcggucgggcuagugacccucuaccugggagugaugguccaggcugauucaggcugcguuaucaacuggaagggucgagagcuuaagugugggaguggaauuuucgugacaaaugaagugcacacuuggaccgagcaauauaaauuucaggccgacagcccgaagcgcuuguccgcagccauaggcaaagcuugggaagaggguguaugcggcaucagaucugccacgaggcuggagaacauuauguggcggcagaucucgaacgaacucaaucauauucuguuagagaacgacaugaaguucacagucgugguuggggauguggucggaauccuggcacagggcaaaaagaugauacgcccucaacccauggaacacaaauacagcuggaaguccugggggaaggcuaaaaucauuggagccgacgugcagaauaccacuuuuaucauugauggcccaaacaccccugagugucccgacgaucagagagcguggaauaucugggaaguugaggacuaugguuucgggauauuuacaacuaacauuuggcuuaaguugagggauucauacacccaggugugcgaccaccgucucaugagugccgcuaucaaagauucuaaggcaguacaugccgacaugggauauuggauugagagcgaaaaaaaugagacauggaagcuggcucgggccuccuucaucgaagucaagacguguauauggccaaaaucacacacccuauggagcaacggcgugcuggagucugaaaugaucauucccaagaucuacgguggcccuauuucccaacauaauuaucgaccaggguacuucacucagacagcaggaccguggcaccucggcaaacuggagcuugauuuugacuugugcgaggggaccacuguggucguugaugaacacugcggaaacagaggccccagucugaggacaaccacggugacugguaagaucauacaugagugguguugccgcagcuguaccuuaccuccacuccgguucaaaggggaagacggaugcugguacggcauggagauuagacccguaaaggagaaggaagagaaucuggugaaaucuauggucuccgcggguucaggcgaaguggacaguuuuagccuugggcuguuguguaucucgaucaugauugaggaaguuaugaggucccgcuggucucgaaagaugcucaugacaggaacccuggccguguucuuucuacugaucaugggccagcucacuuggaacgaucugauucggagcugcauaauggucggggcuaaugccucagaccguaugggaaugggcacaaccuaucuugcauugauggcuacauucaaaaugagaccuauguuugccgugggucuguuauucaggcgccucacuagucgggagguucugcuucugaccaucgggcuaucccucguggcaucugucgagcugccaaacagcuuggaagagcugggagauggcuuagccaugggcauuaugauccucaagcugcuuacggacuuucaauccuaccagcugugggcuacauugcucucacugaccuucauuaaaacuaccuuuagccuacacuaugcguggaagacaauggccaugguacugaguaucgugucucuucucccccuguguuuguccacuaccagccagaagacgacauggcugccgguuuuacucgggucgcugggaugcaaaccucuuaccauguuccugauagcagaaaauaagaucugggguagaaaaucauggccauugaacgagggcauuauggcuguggggaucgucucuauucuccugaguucccuacugaagaacgaugugccccuugccggaccucucaucgccggcgguaugcugauagcuuguuacguaauuagcgggucuagcgcagacuuguccuuagaaaaagccgcggaggugucaugggaggaagaggcugaacauaguggagccagccacaauauccuggucgagguucaggaugacggcacuaugaagaucaaagaugaagagagggacgauacacucaccauucugcuuaaggcaacucuguuggccgugucuggcguguauccccuauccauaccagcuacacuguuugucugguacuucuggcaaaagaaaaagcagcgaucaggggugcucugggacaccccuagucccccagagguugaacgcgcaguacuggaugacggaaucuaucggauuaugcagagaggucuuuuaggcaggagccaggugggggucggaguguuccaagagaacguuuuucauacgauguggcacgugacucguggcgccguccugauguaccaggguaaacgccucgaaccguccugggcgucugugaagaaagacuugaucucguacgggggaggcuggcggcugcagggcagcuggaauaccggggaggagguacaggucauugcuguggaaccuggaaagaaccccaagaauguucaaacagccccagguaccuucaaaacacccgagggcgaagugggggcaaucgcccucgauuuuaagccuggaacuucaggcuccccaauagucaacagagaggguaaaaucguggggcuguauggaaauggcguugugaccacgaguggcacauacgucucugcuauugcccaggcaaaggcuagccaggaagggccccuuccugagaucgaggacgaaguguucaggaaacgaaaccugacuauuauggauuugcacccgggauccgguaagacccggcgcuaucuaccagccaucguaagagaggcgauaaagaggaaacugcggacacucauuuuagcccccacccgagugguugcaucagaaauggcugaggcccugaagggcaugccuaucagauaccaaacuaccgcugucaaaucugaacauacagggcgcgagaucguggaccuuaugugccacgcaacguuuacuaugaggcugcucagcccagugcguguccccaauuauaacaugauuaucauggaugaggcccauuucaccgacccuaguuccauagccgcucggggauacauuagcacaagaguaggcaugggugaagcggcagccaucuuuaugaccgcuacuccgcccgggucuguggaggccuucccacagucaaaugcaguuauucaggaugaagagagggacaucccugaacgcuccuggaacaguggauaugaguggauaacagauuuucccggcaagaccgugugguucgucccaagcauuaaaucgggcaaugacaucgccaacuguuugcgaaagaaugggaagagagugauccagcugucucggaaaacguuugauacugaguaccaaaagacaaaaaacaacgacugggacuacguugugaccaccgauauuuccgaaaugggagcuaauuucagggcggaccgcgucaucgauccucguagaugccucaagcccgugauucugaaagacgguccagagcggguaauacuugccggcccgaugccugugacuguugcaagcgcugcccagaggcgcgggcgaaucggaagaaaccacaauaaggaaggcgaucaguauauuuacaugggucagccccuaaacaaugacgaggaucaugcacacuggacagaggccaagaugcuguuggacaacaucaauaccccagaagggaucauucccgcuuuauucgagccugaacgggagaaaucagccgcgauagauggcgaauauaggcugcgcggagaggcaagaaagacauuugucgagcucaugaggcggggcgaccugccaguguggcuuaguuacaaaguggccucugaaggguuccaauauuccgaucgucgcuggugcuuugacggagagcgaaacaaucagguccuggaagagaacauggauguugaaaucuggacuaaggagggugagagaaaaaagcucaggccccggugguuggacgcucgcacguacagcgacccucuggcccuaagagaauucaaagaguuugcugcaggcaggcggucagugaguggggaucugauucucgaaaucggaaagcuuccgcagcaccugacccagcgagcccaaaaugcuuuagacaacuugguaaugcugcauaauagcgagcagggcgguagagccuaucgccacgcaauggaagagcucccagauacaauugagacucugaugcuucuggcgcucaucgccguguugaccgggggcgucacacuguucuuuuuauccggaaggggccuagggaagaccucuauaggacugcucugugugauggcuagcuccgcccuucuguggauggcaucaguugaaccccauuggaucgcugccucuauuaucuuggaguucuuucugauggugcuccugauuccugaacccgaccggcagcguacuccacaggauaaccaacuugcauacgucguaaucggucuccuguucaugauauugacgguggccgcuaaugagaugggccuguuagagaccacaaaaaaggaccuagggauuggacacguugcgguggaaaaccaccaucacgccacuaugcuggaugucgaccuccauccugcaagugcuuggacccuuuacgccguggccacaaccaucauuacucccaugaugagacacacaaucgagaacacgaccgcaaauauaucgcugacugcuaucgccaaccaggcggcuauuuugaugggccuggauaaagguuggccaaucagcaagauggacauuggggucccucuccuggcccuuggcugcuauucccaggugaauccguuaacacugaccgcagccguucucauguugguggcucauuacgcaaucauaggacccggccugcaagccaaagcgaccagggaagcucagaagcgcacagccgcagggauuaugaagaacccaacuguagauggaaucguggccaucgaccuagauccugucguuuaugacgcuaaauuugagaagcagcugggccagauuaugcuccuuauccuguguacgucucaaauauugcugaugcggaccacaugggcccucugcgaaucaauuacucuggcaaccggucccuuaacaacccuuugggaggggagcccaggaaaauucuggaauacuacgaucgcuguguccauggccaacauuuuucgaggcaguuaccuggcgggugccggccucgcauucucucuaaugaagagccuggggggaggcagaagggggacaggagcucagggcgagaccuugggugaaaaauggaagcgccagcugaaucagcucucaaaguccgaguucaacacuuauaaacggagugggaucauggaagucgacagaagcgaggccaaggaaggacuucguaggggcgagaccacaaaacacgcagugucucgggguacugcuaagcugcgcugguuuguagagcgaaauuuggugaaaccugaaggcaagguuauagaucugggguguggaagaggcgggugguccuacuauugcgccggacucaagaaagugaccgaggucaagggcuacacaaaaggugggcccggacacgaagagccgaucccaauggccacguacggcuggaacuuagugaagcugcauucaggcaaagacgucuucuuuauuccucccgaaaagugugauacccuucugugcgacaucggggagagcucgccaaaucccacuauugaggaaggaaggacacuacgggugcucaaaaugguugagccuuggcugcgcgguaaccaauucuguaucaagauuuugaauccguauaugcccucuguaguggaaacccuggagcagaugcagagaaagcacggcgggaugcucgucaggaacccacuuagucgaaauuccacucaugagauguacugggugagcugcggaacaggcaacaucguuucagcggugaauaugaccucccggaugcuguuaaaccguuuuacgauggcucacagaaaaccuaccuaugaacgcgaugucgaccugggugcagggacaaggcacguggccguagagcccgaaguggcuaacuuggauauaauuggacagcggaucgagaauaucaagcaugaacacaaaucuacuuggcauuacgacgaggauaacccuuauaagaccugggccuaccacggcagcuaugagguuaaaccaaguggcuccgcaagcucuauggucaaugggguggugaagcuccugacaaagcccugggacgucauuccuaugguuacucaaauagccaugaccgauacaaccccauucggacagcagagaguguuuaaagaaaagguagacacucgcacgcccaaagcuaagagggguacagcgcaaaucauggaggugaccgcccgauggcuauggggcuuccuuucacggaacaaaaagccgagaauuuguacuagggaagaguuuacccgcaagguccguaguaaugcagcuaucggggccguguucguugacgaaaaccaguggaauuccgcaaaagaggccguggaggaugaacgguuuugggaccugguccauagagagagggaacuccacaagcagggaaaaugcgcuacaugcguguacaacaugaugggcaagcgcgagaaaaagcugggugaauucgggaaggccaaaggaagccgagcgauuugguacaugugguugggcgcacgguuucuggaguucgaggcccucggcuucaugaaugaagaucacugguuuucuagagagaacucgcuuucagggguagaaggagagggucugcauaaguuaggcuauauccugagggacauaagcaaaaucccugggggaaauauguacgcugaugacacggccggcugggauacccgcauuacugaggacgauuugcagaacgaagcaaagaucacagacauuauggagccagaacacgcucuccuggccaccuccaucuucaaacuaacuuaucaaaauaagguugugagaguccagcggcccgcuaggaacgguacagugauggaugugauaagucgucgagaccagcgcgggucuggacaggucggcaccuacggccuuaauacauuuacuaacauggaggcccaacugauuagacagauggaaagcgaggggaucuucuccccuucagagcucgaaaccccaaaccuggcagagcggguuuuggauugguuagaaaaacauggaguggagaggcugaagcgcauggcgaucaguggugacgacuguguagugaagcccauugaugacagauuugccacggcucucucugcccuuaaugauaugggcaaaguccggaaggacauaccgcagugggaaccuagcaaaggguggaacgauuggcagcaagugcccuucugcucccaccacuuucaucagcugaucaugaaggacggaagggagauuguugugccaugucgaaaucaggaugagcuagucggccgugcaagagugucacagggugcuggguggagccugcgcgaaaccgccugccucggaaaaucuuaugcacaaauguggcaguugauguacuuccaccggagggaccugagacuugccgcgaacgcuaucuguuccgccguaccuguugauugggugcccacaagucgcacuaccuggagcauucaugcacaccaucaguggaugacaacugaggacaugcugucggucuggaaucggguguggaucgaagagaacccauggauggaagauaagacccacauauccucuuggggcgacguucccuaucucggcaagagggaggaccaauggugcgggucauuaaucggacugacggcccgagcuacaugggccaccaauauucagguggcaaucaaccaggucagacgguugauugguaaugagaacuaccuggauuacaugacuagcaugaaaagguuuaagaaugaaagugacccugagggcgcucucugguga

SEQ ID NO: 13731 - RNA, 9879 nt, Artificial Sequence
  derived and/or modified CDS sequence (opt3) from DENV-1__FJ882542__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaacaugugcacucuaauugccauggaccucggagagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaggaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccauccacaccugaaugucccgacgaucagagagccuggaacaucugggagguggaggacuauggcuucgguauuuuuacuaccaauaucuggcuuaaguugagggauucauacacacagguuugcgaccaccgucucaugagugcugcaauaaaagauucuaaggccgugcaugcugacaugggguauuggauugaaagcgagaaaaacgaaacguggaagcuggcccgggcauccuucaucgagguaaagaccuguauuuggccaaaaucacacacucuauggagcaauggaguccuggaaucugagaugaucauacccaagaucuacggcgguccuauuucccaacauaacuaucgaccaggcuacuucacacagaccgcggggccguggcaccucggaaaacuggagcuugauuuugacuugugcgaaggcacuacagugguggucgaugagcacugcgggaauagaggacccagucugaggaccacgacuguuaccggcaagaucauucaugaaugguguugccgcagcuguacauuaccuccacuccgguucaaaggugaggacgggugcugguacggaauggagaucagacccgugaaggaaaaggaggaaaaccugguaaaaucuaugguguccgccggcucaggugaggucgacaguuuuagccuuggccuguuguguauaucgauuaugaucgaagaggugaugaggucccgcuggucucgaaagaugcucaugaccgggacucuggcuguuuuccuacugcucaucaugggacagcugacauggaaugaucuuauucgguugugcaucauggugggcgccaacgcaagcgaccguauggggaugggaaccacauaucuggcuuuaauggccacuuuuaaaaugagaccuauguucgcagucggccuccuguuuaggcgccuuaccucacgggaggugcugcuacucacgauuggucugaguuugguugccuccguggaacugccaaauucuuuagaggaacucggggauggacuggcuaugggcauaaugauccuuaagcuguugacagacuuccaaagccaccagcucugggcgacccugcuaucccugacuuuuauuaaaaccacacuuucacuccauuacgccuggaagacuauggcaaugguccugagcaucgcuaguuuguucccccuguguuuaucuaccacgucccagaagacaaccuggcucccgguacugcuuggcagccuggggugcaaaccuuugacuauguuucucauuacagagaccaagaucuggggaagaaaaucguggccacugaacgaagguauaauggccgugggcguugugucaauccuacugucuagucuucucaagaaugaugucccccuggccgggccuuugauugcuggaggcauguuaaucgcauguuaugugauuuccgguagcucugccgaccugagccucgagaaagcggcugagguauccugggaagaggaagccgagcacucaggggcaagucauaacauccugguggucguucaggaugacggaacuaugaagauaaaagaugaagagagggacgauacacuuaccauucuguugaaggccacgcuacuggcugugagcggcguguacccccucucuaucccagcaacucuguucgucugguauuuuuggcaaaagaaaaagcagcgauccggcgugcuuugggacaccccuucacccccagagguugaacgcgccguauuagaugacgggaucuaccggauuaugcagagaggacugcucgguaggagucaggugggcgucgggguguuccaagagaacguuuuccacacaauguggcacgugacccguggagcggucuugauguaucagggcaaacgccuggaaccgagcugggcuuccgugaagaaagaccucauaucuuacggugggggauggcggcugcagggcucguggaauacaggcgaggagguacaggucaucgccguggaaccugggaagaaccccaagaauguucaaacugcaccaggaaccuuuaaaacgcccgagggugaagugggcgccauugcucuugauuucaagccugggacaagcggaucaccaaucgucaacagagagggcaaaauugugggucuguacgggaauggaguugugacuaccuccggcacauaugucagugccaucgcacaggcuaaggccucucaggaaggccccuugccugagauagaggacgaaguguuuaggaaacgaaaccuaaccaucauggaucugcauccggggagcggaaagacucggcgcuaccucccagcgauuguaagagaggccaucaagaggaaauuacggacccugauucuugcacccacacgagugguugcuuccgaaauggccgaggcucugaaggguaugccuaucagauaucaaacgacugcagucaaaucagaacacaccggcaaggagauaguggaccucaugugccaugccacauucaccaugcgcuugcugucuccagugaggguccccaauuacaacaugauuaucauggaugaggcccacuuuacugacccuagcaguaucgcugcgcguggguauauuuccacacggguaggaaugggcgaagcagccgcuaucuucaugaccgccacgccgcccgguagcguggaggcauuuccacagucuaaugccguuauacaggaugaagagagagacauuccugaaaggucauggaacuccggguacgaguggaucacugauuuccccggaaaaacagugugguuugucccaaguauuaagagcggcaaugacaucgcuaacugucuccgcaagaauggcaaacgagugauacagcugucgagaaagaccuucgauaccgaguaucagaaaacuaagaacaaugacugggacuacguugugacaaccgauauuucugaaaugggggcgaacuuucgggccgacagggucaucgauccucgccguugccuuaaacccgugauccuaaaggacggaccagagagaguaauucuggcagguccgaugccugugacaguugcuuccgccgcacagcggaggggccgcaucgggcgaaaccauaauaaggaaggagaucaguacauuuauaugggccagcccuugaacaaugacgaggaucacgcccacuggacugaggcuaaaauguuacuggacaacauaaauacgccagaagguaucauucccgcccucuucgagccugaaagagaaaagagcgcggcaaucgauggggaauaccggcugaggggcgaggcccgcaaaaccuucgucgagcuuaugagaaggggagaccugccaguguggcucucauauaagguggcuagugaaggcuuucaauacucugaucggcguuggugcuucgacggggagcgcaacaaucaggucuuggaagagaacauggauguugaaaucuggacaaaagagggagagcgaaagaaacugagacccagguggcuagacgcccggacuuauuccgacccucuggcucuccgcgaauuuaaggaguucgcagccgguagaaggagcgugucaggcgaucuuauucuggaaauagggaaguuaccgcagcauuugacccagcgggcucaaaaugcccuggacaaccucguaaugcugcacaauagugagcagggaggccgagcauacagacaugcgauggaggaacuuccagauacaaucgagacccugaugcucuuggcccugauugcuguguuaacuggugggaugacgcuauuuuuccugagcggccgcggacucggcaaaaccuccaucgggcuucugugugucauggccucuagcguguugcuguggauggcauccguugaaccccacuggauugcugccucaaucauacucgaguuuuuccugauggugcuucucaucccugaacccgacaggcagcggacaccacaggauaaccaacuggcauaugucguaauuggauugcuguuuaugaucuuaacuguggccgcuaaugagaugggucuacuggagaccacaaagaaagaccucggcauugggcacguugcgguggaaaaccaucaccaugccaccaugcuugaugucgaccugcacccugcaucugcuuggacuuuguacgccguggccacaacgaucauaacccccaugaugcgucauacuauugagaauacaaccgcaaacaucagucugaccgcuauugccaaccaggcggcuauccucaugggacuggauaagggcuggccaauaucgaaaauggacaucggugucccucuuuuagcccuggggugcuacagccaggugaauccgcucacauugacugcagccguucugaugcuaguggcucacuaugcaauuaucggccccggacugcaagccaaggcgacgagagaagcucagaagaggaccgccgcaggcauuaugaaaaacccaacaguagaugggaucguggccauagaccucgauccugucguuuacgacgcuaaguucgagaaacagcuuggacagauuaugcuguugauccuguguacuucccaaauccuccugaugcgcaccacaugggccuuaugcgaaucuauuacccuugcaacuggcccccugacgacacucugggaggguucaccagggaaguuuuggaauaccacuaucgcugugagcauggccaacauauuccggggauccuaucuagcgggcgccggucuggcauuuaguuugaugaaaucucugggcgggggacgaagaggcaccggggcucagggagagacacucggcgaaaaguggaagaggcagcuuaaucagcugagcaaaucagaguucaacauuuacaagcgcuccgguaucauggaagucgaccggagugaggccaaagaaggguugaagagaggagagacuacccgucacgcagugagcaggggcacagcuaaacugcggugguucguagagcgcaaucucgugaagccugaagguaagguuauugauuuaggcugugggcgaggaggcuggucuuauuacugcgccgggcugaaaaaggugacggaggucaaaggauauaccaagggcggucccgggcaugaggagccgaucccaauggccacuuacggauggaaccuugugaaacugcacuccggcaaggacgucuuuuucacaccucccgaaaaaugugauacccuacucugcgacauaggcgagucaagcccaaaucccacuaucgaggaagggagaacacugaggguguugaagaugguugagccuuggcugcggggaaaccaauuuuguauuaagauccucaauccguacaugcccucgguaguggaaacccuugagcagaugcagcgcaaacaugguggcaugcuggucagaaacccauuaucuaggaauaguacgcacgagauguauuggguguccugcgggaccggaaacauuguuagcgcggugaauaugacaucacgaaugcuguugaaccgguucacuauggcucaccguaagccuaccuacgaaagagaugucgaccucggcgcagguacacgccauguggccguagagcccgaaguggcuaaucuggauaucauugggcagaggaucgagaacauaaaacacgaacauaaguccacuuggcacuaugacgaggauaacccuuacaaaaccugggccuaucauggaucuuacgagguuaagccaagcggcagugcauccagcauggucaauggcguggugaagcuacuuacaaaacccugggacgucauuccuaugguuacccaaaucgccaugacugauacgacaccauuugggcagcagcggguguucaaggaaaaaguagacaccagaacucccaaggcuaaacgcggaaccgcgcaaaucauggaggugacagccagguggcugugggguuuucucucucgaaacaagaagccgcggauuuguacgagagaagaguucaccaggaaaguccgcucaaaugcagcuauaggcgccguguuuguugacgaaaaccaguggaauagugcaaaggaggccguggaggaugaacguuucugggaccugguccagaaagagcgggaauugcacaagcaggggaaaugcgcuacuugcguguauaacaugaugggaaagagagagaagaaacugggcgaauuugguaaggccaaaggguccagggcgaucugguacauguggcucggagcacgcuuccuugaguuugaggcccugggcuucaugaaugaagaucacugguucagccgagagaacucuuuaucgggcguagaaggggagggacugcauaaguuggguuacauucuccgggacaucucaaaaauuccuggcgggaauauguaugcugaugacacagccggaugggauaccagaaucacugaggacgaucugcaaaacgaagcaaagauaacagacaucauggagccagaacacgcucuacuugccaccagcauuuuuaaacugacauaccagaauaagguugugaggguccagcgccccgcuaagaacggcacugugauggaugugaucuccagacgggaccagagggguagugggcaagucggaaccuauggccucaauacguucaccaacauggaggcccagcugauucgucagauggaaucugagggcaucuuuuugccuagcgaguuagaaacaccaaaucuggcagagcgaguucucgauuggcuugaaaaauacgggguggagcgccugaagagaauggcgauauccggagacgacuguguagugaaacccauugaugaccgguucgccacugcucuaaccgcccugaacgauauggguaaggucaggaaagacaucccgcagugggaaccuucaaagggcuggaacgauuggcaacaggugcccuuuugcagucaucacuuccaccagcucaucaugaaggacgggcgcgagauuguugugccauguagaaaucaggaugaguuggucggacgggcaagggugucucaaggcgcugguuggagccugcgagaaacagccugccuugggaaauccuaugcacagauguggcagcugauguacuuucaucguagagaccuccgcuuagccgcgaacgcuauauguucagccguaccuguugauugggugcccacuagccggaccacguggucuauccacgcacaucaccaauggaugacaaccgaggacaugcuguccgucuggaauaggguguggauugaagagaacccauggauggaagauaagacucauguuaguagcuggggagacgugcccuauuugggcaaaagagaggaccaguggugcggcucgcugaucgggcucacagcccgcgcuaccugggccuccaauauucaggucgcaaucaaccaggugcggaggcuuauaggaaaugagaacuaccuggauuacaugacuucuaugaagcgauucaaaaaugaaggugacccugagggcgcucuaugguga

SEQ ID NO: 13732 - RNA, 9879 nt, Artificial Sequence
  derived and/or modified CDS sequence (opt3) from DENV-1__FJ882543__SS-prME
agcgugaccaugcugcucaugcuuaugcccacagcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccauugggaaacuuguucaucagauauucggaacggcguacggcgugcuguuuucuggugucagcuggaccaugaagaucgggauuggcguguugcucacuuggcugggauuaaauucacgaaguacaucccugagcaugaccuguaucgcuguaggccuagugacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacauuauguggaaacagaucucuaacgagcucaaucauauucuguuagaaaacgacaugaaguucaccguggugguaggcgaugucguggggauccuggcucagggcaagaagaugauacgcccucaacccauggagcacaaauacucguggaaaagcuggggcaaggccaagaucauuggggcggacguucagaauacuaccuuuaucauugauggaccaaacacaccugaaugucccgacgaucagagagccuggaauaucugggagguggaggacuauggcuucgguauauuuacuaccaacauuuggcuuaagaugagggauuccuacacacaggucugcgaccaccguuugaugucagcugcaaucaaagauaguaaggccgugcaugcugacaugggguauuggauugaaucugagaaaaaugaaacguggaagcucgcccgggcauccuucaucgagguuaagaccuguauauggccaaaaucccacacucuguggucaaacggagugcuagaaagcgagaugaucauucccaagaucuacggcgguccuauuucucaacauaaucaccgaccaggcuauuucacacagaccgcggggccguggcaccugggaaaacucgagcuggauuuugaccuuugcgaaggcacuacaguagucguggaugagcauugcgggaacagaggacccuccuugaggaccacgacugugaccggcaagaucauacacgaaugguguugccgcaguuguacacugccuccauuacgguucaaaggugaggacgggugcugguacggaauggagauuagacccgucaaggaaaaggaggaaaaucucguuaaaagcauggugucugccggcuccggugagguagacucauuuagucugggccuucuguguaucagcaucaugauugaagaggugaugaggucgcgcuggucccgaaagauguugaugaccgggacucucgcugucuuccugcuacugaucaugggacagcucacauggaacgaucugauucggcuuugcauaauggugggcgccaaugcaucugaccguauggggaugggaaccacauacuuggcucugauggccacuuuuaaaaugagaccuauguucgcaguuggcuuacucuuuaggcgccugaccagccgggaggugcuucugcuaacgaucggucucucacuggucgccaguguggaauugccaaacucccuggaggaauuaggggauggacucgcuaugggcauuaugauccugaaacuucugacagacuuccaaucucaucaguugugggcggcccuccugagccuaaccuuuauuaaaacuacccugucccuucacuaugcauggaagacaauggcuaugguucucucaaucgugagccugauacccuugugucugaguacuaccucucagaagacgacaugguuaccgguccuccugggcucccuugggugcaaaccucugaccauguucuugaucgccgagaauaagauuuggggaagaaaaagcuggccacucaacgaagguaucauggccguaggcgugguuucgauucugcuaucaucucugcuuaagaacgaugugccccucgcugggccucugaucgcaggaggcauguugauagccuguuacgucauuagugguuccagcgcggacuuaucucuggagaaagcugccgaggugagcugggaagaggaagcagagcauuccggggccucacacaauauccucguagaagugcaggaugacggaacuaugaagaucaaagaugaggagagggacgauacacugaccauucuucugaaggcuacuuugcuagcagucaguggcguuuauccccugagcauaccagccacacucuuugugugguacuucuggcaaaagaaaaagcagcgaucuggcgugcugugggacaccccuucacccccagaagucgagcgcgcggugcuugaugacgggaucuaucggauuaugcagagaggauuacuggguaggagccagguuggcguagggguguuucaagaaaacgucuuccacacgauguggcaugugacucguggagcuguucucauguaccagggcaaacgcuuggagccgaguugggccagcgugaagaaagaccugaucuccuauggugggggauggcggcuccagggcucuuggaauaccggcgaggaaguccaggugauugcaguagagccugggaagaaccccaagaauguccaaacagccccaggaaccuucaaaacacccgaaggugaggugggcgcuaucgcccuggauuuuaagccugggacuucgggaagcccaauaguuaacagagaaggcaaaaucgugggucuuuacgggaauggagucgugaccacgucaggcacauacguuuccgcaauugcucaggccaaggcgagucaggagggcccccugccugagaucgaagacgagguguucaggaaacgaaacuugacuauuauggaucuacacccggggucuggaaagacccggcgcuaucugccagccaucgucagagaagcaauaaagaggaaacuccggacauuaauucuggcucccacccgagugguagccagcgagauggcugaagcacuuaaggguaugccuaucagauaccaaacuaccgccgugaaauccgagcauacaggcaaggagaucguugaccugaugugccacgccacguuuacuaugcgccucuugucaccagucagggugcccaauuauaacaugauuaucauggaugaagcucauuucaccgacccuucuagcauagcggcacguggguacauuaguacacgggugggaaugggcgaggccgcugccaucuuuaugaccgcaacuccgcccgguuccgucgaagccuucccacagagcaaugcuguaauucaggaugaggaaagagacaucccugagaggucuuggaacucaggguaugaguggauaacagauuuucugggaaaaaccgugugguucguucccuccauuaagaguggcaaugacaucgcgaacugucuccgcaagaauggcaaacgagugauccagcugagcagaaagacguuugauacugaauaccagaaaaccaagaacaacgacugggacuaugucgugaccaccgauauuucggagaugggggccaauuuccgggcagacaggguuaucgauccacgccguugccuuaaaccugugauucuaaaggacggacccgaaagagucauacuggcugguccaaugccggugacuguagccucugcagcccagcggaggggccgcaucgggcgaaaccacaauaaggagggagaucaguacauuuacaugggccagccuuugaacaaugacgaggaucacgcucauuggacagaagccaaaauguuacuggacaacaucaauacccccgaggguaucauuccagcgcucuuugaacccgagagagaaaaguccgcagccauagauggggaguaucggcugaggggcgaggcucgcaaaacauucguggaacuuaugagaaggggagaccugccuguuuggcucagcuacaaggucgccucagagggcuuccaauauagugaucggcguuggugcuuugacggggaacgcaacaaucagguguuggaggaaaacauggauguggagaucuggacuaaagagggagaacgaaagaaacugagaccaagguggcuagacgcucggacguacucugacccccuggcacuccgcgaguucaaggaauuugccgcugguagaagguccgucagcggcgaucuuauucuggagaucgggaaguuaccucagcacuugacccagcgggcccaaaaugcacuggacaaccucguuaugcugcauaauucagaacagggaggccgagcguauagacacgccauggaggagcuuccggauacaauugaaacucugaugcucuuggcucugaucgccguguuaaccggugggguaacacuauucuuucugaguggccgcggacucggcaaaaccagcauagggcuucugugugugauggcauccucugucuugcuguggauggcuagcguggagccacacuggaucgccgcauccauuauccucgaguucuuucugaugguucuucucauucccgagccugacaggcagcggacuccccaggauaaccaacuggccuacguggucaucggauugcuguucaugauauuaacgguagcugcgaaugagaugggucuacuggaaaccacaaagaaagaccucggcauugggcauguggccguugagaaccaccaucacgcaacuaugcuugauguggaccugcauccagcuucagccuggaccuuguaugccgucgcaacaaccaucauuacuccuaugaugcgucacacaaucgaaaacacgaccgcuaauauaucucugacugccaucgcgaaccaggcugccauucucaugggacuggauaagggcuggcccaucaguaaaauggacauuggugugccacuuuuagcacuggggugcuacucgcaggucaauccucucacauugaccgccgcugugcugaugcuaguugcacacuacgccaucauaggcccgggacugcaagcgaaggcuaccagagaggcccagaagaggacagcagccggcauuaugaaaaaccccacuguggaugggaucguagcuaucgaccucgauccaguggucuaugacgccaaguuugaaaaacagcuuggacagauuaugcuguugauccuguguacgagccaaauacuccugaugcgcaccacaugggcauuaugcgaguccauuacucuugcuaccggcccucugacaacccucugggaggguucucccgggaaguucuggaauacuacgaucgccguuucaauggcgaacauuuuucggggaagcuaccuagccggcgcaggucuggcuuucuccuugaugaaaagucugggcgggggacgaagaggcacaggggcccagggagaaacccucggcgagaaguggaagaggcagcuuaaucagcugucuaaaagcgaauuuaacaucuauaagcgcucagguauaauggagguggaccgguccgaagcaaaagagggguugaagagaggagagacuacccgucaugcugucaguaggggcacagccaaacugcggugguucguggaacgcaaucucguaaagccagaggguaaggugaucgauuuaggcugugggcgaggaggcuggagcuacuauugcgccgggcugaaaaagguuacugaagugaaaggauacaccaagggcgguccugggcacgaggaacccauuccgauggcgacauauggauggaaccuugucaaacugcauucuggcaaggacguguucuuuacgccaccugagaaaugugauacccuacucugcgacaucggcgaguccucacccaauccaacuauugaagaggggagaacacugagggucuugaagaugguggaacccuggcugcggggaaaccaauucuguaucaagauucucaauccuuacaugccgagcguuguagagacccuugagcagaugcagcgcaaacacgguggcaugcuggugagaaaccccuuaucgagaaauucuacucacgaaauguacugggucaguugcgggacaggaaacaucguguccgcuguuaauaugaccagccgaaugcuguugaaccgguuuacgauggcacaucguaagccaaccuaugagaaagauguggaccucggcgccgguacaagacacgucgcuguggaaccugagguagccaaccuggauauaauugggcagcgcaucgaaaauaucaagcaugagcacaaaucaacuuggcauuacgacgaggauaaccccuauaagaccugggcauaccacggauccuaugaagugaagccuucuggcagcgccaguuccaugguuaauggcgucgugaaacuacuuacaaagccaugggacgugauucccauggucacucaaauagcuaugaccgauacaaccccuuucgggcagcagaggguuuuuaaagagaagguggacacucggacgccaaaagcgaagagaggaacaguacaaaucauggaagugaccgcccgcuggcugugggguuuccucagcaggaacaagaaaccccgaauuuguacucgggaggaauuuaccagaaaggucaggucuaaugcagcuaucggcgccguguucguugacgagaaccaguggaacucagcaaaagaggccguggaagaugagcgcuuuugggaccuggucaagaaagaacgugaguugcacaagcaggggaagugcgcuacaugcguguacaacaugaugggaaaacgggaaaagaaacugggcgaguucgguaaggccaaagggaguagagcgauuugguauauguggcucggagcaagguuucuugaguucgaagcccugggcuuuaugaaugaggaucauugguucucccgcgaaaacagcuuaucuggcguagagggggagggacugcacaaguuggguuacauccuccgagacauaucgaaaaucccgggcgggaauauguacgcugaugacacggccggaugggauacccggauuacugaagacgaucugcagaacgaggcaaagaucacagacauuauggaaccugagcaugcucuacuugccaccucaaucuucaagcugacuuaucaaaauaaaguugugagaguccagaggccagcuaagaacggcacagugauggaugugauaagccgcagagaccagcgggguuccgggcaggucggaaccuacggccucaauacauuuacuaacauggaagcccaacugauuaggcagauggagagugagggcaucuucuugcccucugaauuagagaccccuaaccuggcagaacguguucucgauuggcuugagaaauaugggguggaacgacugaagcgcauggcgaucagcggagacgacuguguagugaaaccaauugaugacagauuugccacggcucuaaccgcccugaaugauauggguaagguccggaaggacauaccccagugggagccguccaaaggcuggaacgauuggcagcaagugccuuucugcucacaccacuuucaucagcucaucaugaaggacgggagggagauuguugugcccugucgcaaucaggaugaauuggucggaagggcacgggugagucagggcgcugguuggucucugagggagacagccugccuugggaaaagcuacgcacaaauguggcagcugauguauuuccaccgacgugaccucagauuagccgcgaacgcuaucuguuccgccguaccaguugauugggugccuacuucacgcaccacauggagcauucaugcacaccaucaguggaugacuaccgaagacaugcugucugucuggaaucggguguggaucgaggaaaaccccuggauggaggauaagacgcacguuuccaguugggaggacgugccauacuugggaaaaagggaagaccaauggugcggcagccugauaggccucacagccagagcuaccugggccucgaauauccaggucgcaauuaaccaggugcgccggcuuaucgggaaugagaacuaucuggauuacaugacuuccaugaagagguuuaagaaugaaggagaccccgagggugcucuaugguga

SEQ ID NO: 13733 - RNA, 9879 nt, Artificial Sequence
  derived and/or modified CDS sequence (opt3) from DENV-1__FJ882544__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaacaugugcacacuaauugccauggaccucggagaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggacuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaaacagagauuuuguggagggucuuagcggcgccacauggguagacguuguguuggagcacgggaguugugucaccacuauggcgaaggauaaacccacacuggacaucgaacuacucaagaccgaggugacgaauccugcagugcugaggaaacuuugcauugaagccaagaucuccaacaccacaacugauucucgguguccaacccaaggagaggcuacacuggucgaagaacaagacgccaauuucguuugccgccgaacuuuuguggauagaggcugggguaacggguguggauuguucggcaaaggcagccucauaaccugcgcaaaguuuaagugcguaacaaaacuggaggggaagauugugcaguacgaaaauuuaaaauauuccgucaucgugaccguucacacuggagaccagcaucaaguggguaacgagucaacggaacacggcacaaccgcuacuauuacaccccaagccccuaccaccgagauccagcugacugacuacggggcgcucacacuugauuguaguccaaggacgggacuggacuucaaugaaauggucuugcuaaccaugaaggagaaaagcuggcuggugcauaagcagugguuucucgaucugccgcuucccuggacuucuggcgccuccacaucacaagagaccuggaaccggcaggaccuguugguaacauucaaaacugcacacgcuaagaagcaggaaguugugguccucgguagccaagagggggccaugcacaccgcucugacgggcgccaccgaaauccagacaaguggaacuaccacaauuuuugcaggccauuuaaaaugccgucugaagauggauaaacuaacucucaaggggaugucuuaugugauguguaccggauccuucaaacuggagaaggaagucgccgagacgcagcacgguacagugcuuguucagauaaaguacgagggcaccgacgcuccuugcaaaaucccauucagcacucaagaugaaaagggggugacacagaauggacgcuugauuaccgcgaaccccaucguaacugacaaaggcaagccugucaauauagaggcagaaccacccuuuggugagucguauauugugaucggggccggcgagaaagcucugaagcucucuugguucaagaaaggauccucaaucggcaagauguuugaagccaccgcaagaggggccaggcggauggcuauucugggagauacagccugggacuucgguaguaucggcgggguuuuuacgagcgugggaaaacuuguccaucagauuuucggcaccgcauacggugugcuguuuuccgggguaucuuggacuaugaagauaggcaucggaguguugcucacauggcugggcuuaaacagccgaucaaccagucuguccaugacauguauugcgguugggcuagucacucucuaccugggagugauggugcaggcugauagcggcugcgucaucaauuggaaaggucgcgagcuuaagugugggucuggaaucuucguuaccaacgaagugcacacguggacagagcaauauaaguuucaggccgacucaccgaaaagauugagugcagccauuggcaaggcuugggaagagggugugugcggcauaaggagcgccacccggcuggagaacaucauguggaaacagauuuccaaugaacucaaccauauccuguuagagaaugacaugaaguucacuguagucgugggggauguugcaggcauucuggcucagggcaaaaagaugauccgcccucaacccauggaauacaaauauucuuggaagucgugggggaaggccaaaauaaucggagcggacgugcagaacaccacauuuauuaucgauggcccaaauacuccugagugucccgacgaucagagagccuggaacauuugggaagucgaggacuacgguuucgggaucuuuaccacaaauauauggcuuaaguugagggauagcuauacacaggugugcgaccaccgucucauguccgcugcaauuaaagauucaaaggccguucacgcugacaugggauacuggaucgagagugagaaaaaugagaccuggaagcuggcccgggcaucuuucauugaagugaagacuuguaucuggccaaaaagccauacacuaugguccaauggcguacuggagucagaaaugauaauccccaagauuuaugguggcccuaucagccaacacaacuaccgaccaggguacuucacccagacugcgggaccguggcaucucggcaaacuggagcuugauuuugacuugugcgaggggacaaccgucgugguggaugaacacugcggaaauagaggccccucucugaggacgacuaccgucacagguaagauuauccacgagugguguugccgcuccuguaccuuaccuccacuccgguucagaggggaagacggaugcugguauggcauggagauaaggcccguuaaagagaaggaagagaaccuggugaagaguaugguaagcgccgguucuggcgaaguggacuccuuuucacuugggcuguuguguauuaguaucaugaucgaggaagucaugcgcagccgauggucgcggaaaaugcucaugacuggaacacuggcuguguucuuucuacugauuaugggccagcucaccuggaaugaucugauccgucuuugcauuaugguuggggccaacgcauccgacagaaugggaaugggcacaacuuacuuggcucugauggccaccuucaagaugaggccuauguuugcaguggguuuacucuuccgccggcugacgucuagagagguccuucugcuaacaauagggcucagccugguggccucaguugaguugccaaauagucuggaagaguuaggagauggccucgcuaugggcaucaugauucugaaacuucugaccgacuuucaaucccaucaguugugggcgacucuccugucucuaaccuucaucaagacaacuuuuagccugcacuaugccuggaaaaccauggcaauggugcuuuccauugucucacucuucccccuguguuugagcacgacaagucagaagaccacuuggcugccgguauuacucgggucucugggaugcaagccucuuacaauguuucugaucgcugaaaacaaaauaugggguaggcgauccuggccauugaacgagggcaucauggccguggggauuguuagcauccuccugucgucacuacugaagaaugaugugccccuugccggaccucucauugcuggcgguaugcugaucgcauguuacgucauaucugggaguuccgccgacuugagcuuagaaaaagcggcugaggugucuugggaggaagaggccgaacauagcggagcaucccacaacauucugguagaggugcaggaugacggcaccaugaagaucaaagaugaagaacgcgacgauacucucacaauccugcuuaaggccacccuguuggcugucucaggcguuuauccccuaaguauuccagcaacgcuguucgugugguacuucuggcagaaaaagaagcagcggagcggggugcucugggacacuccuucucccccagaggucggcagagccgugcuggaugacgguauauauaggaucaugcagcguggccuuuuagggcgcucccagguuggaguaggcguguuucaagaaaaugucuuccauaccauguggcacgugacacggggugcgguucugauguaccaggggaaaagacucgagccgucaugggcuagugugaagaaagacuugauuagcuacggaggcggcuggaggcugcagggguccuggaacaccggagaagagguccaggugaucgccguagagccugguaagaaucccaaaaacguccaaacagcaccaggcacuuuuaagacccccgaaggggaggugggagccauugcucucgauuucaagccuggcacgucugguucgccaaucguuaaucgagaagggaaaauagugggacuguauggcaacggcgucgugacaacuagcgggaccuacguuucagccaucgcacaggcuaaggccucccaggagggaccccuuccugaaauugaggacgagguguuucggaaacgcaaucugacaaucauggauuugcacccggguaguggcaagaccagaagguaucuaccagcgauuguccgggaagccaucaaacgaaagcugagaacucucauauuagcacccacccgcgugguagcuucugagauggccgaagcucugaaggggaugccuauuagguaccaaacaacggcagugaaaagcgagcauacuggaaaggaaaucguugaccuuaugugccacgccaccuucacaaugcgucugcucuccccaguccgggugcccaacuauaauaugaucauuauggaugaggcccauuuuaccgacccuucaucuaucgcugcgagaggcuacauaagcacuaggguggguaugggggaggcagccgcuauuuucaugacagccaccccgcccggaagugucgaagcauuuccacaguccaacgccguaauccaggaugaggaacgcgacauuccugagcgaagcuggaacucuggcuaugaauggaucacggauuuccccggcaaaacugugugguuuguuccaucaauaaaguccgggaacgacauugcuaauuguuugaggaaaaacggaaagcgggugauccagcugaguaggaagacauucgauaccgaguaccagaaaaccaagaacaaugacugggacuacgucgugacuacagauaucagcgagaugggugcgaacuuccgcgccgaccguguuauugauccuagacggugccucaaacccgugauccugaaggacggcccagaaagggucauucuugcagggccgaugccugugaccguagcuucggccgcacagcgccgaggaagaauaggccggaaucacaacaaagagggugaucaguauaucuacauggggcagccccuaaauaacgacgaagaucaugcccacuggacagaggcuaagaugcuguuggacaauauuaacacuccagagggcaucauccccgccuuauuugaaccugagagggaaaagucugcggcaauugauggagaguaucgccugagaggcgaagccaggaaaacguucguggagcucaugcggcguggggaccugccaguuuggcuuuccuacaaggucgcuagcgagggauuucaauauucagaucgccgauggugcuucgacggugaaagaaauaaccaggugcuggaggaaaauauggauguggagauauggaccaaagaaggcgagaggaagaaacuccggccccgcugguuggacgccagaacauacagugacccucuggcucuaagggaguuuaaggaguucgcagccgggcggcgaucugucuccggagaucugauccucgagauuggcaaacuuccgcagcaccugacucagagagcucaaaacgccuuagacaauuugguuaugcugcauaacagcgaacagggugggcgcgcauauaggcacgcgauggaggaacucccagauaccaucgagacacugaugcuucuggcccucauugcuguguugaccggcggaguaacucuguuuuucuuaucaggccgggggcuaggaaagacgaguaucggucugcucugugugauggccagcuccguccuucuguggauggcaucuguggagccccauuggauagcugccagcaucauuuuggaauuuuuccugaugguucuccugaucccugagcccgaccgucagagaaccccacaggauaaucaacuugcauacguggucauuggccuccuguuuaugaucuugacaguagccgcuaacgaaauggggcuguuagagacuaccaagaaagaccuaggaauaggccacguggcgguugagaaccaccaucacgccgcaaugcuggauguggaccuccauccugcuuccgccuggacacuuuacgccgucgcaaccacuauuaucacacccaugaugaggcacacgauugaaaauaccacugcuaacaucucacugacagccauagcgaaucaggcugccaucuugaugggucuggauaagggguggccaauuucuaaaauggacaucggcgugccucuccuggcacuuggaugcuauagucaggucaacccguuaacccugaccgccgcugugcucauguugguugcacauuacgccauuaucggccccgggcugcaagcgaaggcuacacgcgaggcccagaaacggacugcagccggaauaaugaagaauccaacgguggauggcauuguagcuaucgaccuagauccuguggucuaugacgccaaguucgaaaaacagcugggucagaucaugcuccuuauucuguguaccucgcaaaucuugcugaugcgaacaacuugggcacucugcgagagcauaacccuggcuacagggcccuuaaccacucuuugggaaggauccccaggcaaguuuuggaacacgacaauugccguuucuauggcgaauaucuucagagguucauaccuggccggcgcagggcucgcuuucagccuaaugaaaucccugggaggcgggaggcgcggaaccggcgcccagggugagacuuugggggagaaguggaaacggcagcugaaccagcucaguaagucugaauuuaauaccuauaagagaagcggaauuauggagguggaccguucagaagcaaaagagggccuuaagaggggugaaacaacuaaacacgcugucucccggggcaccgccaagcugcgcugguucguggagcgaaacuugguaaaaccugaggggaaggugaucgaucugggauguggcagagggggauggaguuacuauugcgccggccucaagaaaguuacagaagugaaggguuacacgaaagggggacccggccacgaggaaccgauaccaauggcgaccuacggcuggaauuuagucaagcugcauagcgggaaagacguguuuuucaucccucccgagaagugugauacucuucugugcgacauuggagaaucuuccccaaaccccacaaucgaggaggguaggacccuacggguccucaaaaugguggaaccuuggcugcgcggcaaucaauuuuguauuaagaucuugaacccguauaugcccucaguuguagagacucuggaacagaugcagagaaagcacgggggaaugcucgugaggaauccacuuagccgaaacucgacacaugagauguacugggucucuugcggcaccgguaauauugugagugcuguuaacaugacgucccggaugcuguuaaaccguuucaccauggcacacagaaaaccuacauaugagcgcgauguggaccugggggccggaacuaggcacgucgcuguggaacccgagguagccaauuuggauaucauaggccagcggauugaaaacaucaagcaugagcacaaaagcaccuggcauuacgacgaagauaauccuuauaagacaugggcauaccacggcucauaugaggugaaaccauccgggucugccagcaguaugguuaacggagucgugaagcuccugacuaagcccugggacgugaucccuauggucacccaaauugcuaugacagauaccacuccauuuggucagcagagaguuuucaaagagaagguggacacgcgcacacccaaagcgaagaggggcaccgcccaaauaauggaaguaacugcaaaauggcuauggggguuucuuucccgaaauaagaagccgcggaucuguaccagagaggaguucacaaggaaagugcgcagcaacgcugccauuggagcagucuuuguggacgagaaucaguggaacucugccaaggaagcuguugaggaugagcguuucugggaccuggugcaucgggaaagagagcuccacaaacagggcaagugcgccacgugcgucuacaauaugauggguaaaagggaaaagaagcugggggaguuuggaaaagcgaagggcucacgcgcaaucugguacaugugguugggcgcccgauuccuggaguucgaggcucucggguuuaugaacgaggaucacugguucagucgggaaaauucccuuagcggaguggagggugaaggccugcauaaauuaggguauauucugagagacaucucuaacauaccuggaggcaauauguacgccgaugacaccgcagguugggauacuaggaucacagaggacgauuugcagaacgaggcucgcauuaccgacaucauggaaccagagcacgcccuccuggcuaagucgauuuuuaaacuaacuuaucaaaauaagguaguuagagugcagcggcccgccaaaaacgggacagucauggaugugaucucaaggcgugaccagcgaggaagcggccaggugggcaccuacgggcuuaacacauucacuaauauggaagcacaacugauacgccagauggaguccgaaggaauuuuuaguccuucugagcucgagaccccaaaccuggcggaaagagucuuggauugguuagagaaguaugguguugaacggcugaagaggauggccaucagcggcgacgacugugugguaaaacccaucgaugaccgcuucgcuacggcccucaccgcacuuaaugauauggggaaggugagaaaagacauuccgcagugggagccuuccaagggauggaacgauuggcagcaaguccccuuuugcucacaucacuuccaccagcugauaaugaaagacggccgggaaaucgugguuccauguaggaaucaggaugagcuagugggucgagcucgugucagucagggggccggauggucucugagagagacagcaugccucggcaagagcuacgcccaaauguggcaguugauguauuuucaucgccgggaccugaggcuugcggcuaacgccauuuguuccgcagugccuguagauuggauccccacuucaagaaccacauggagcauucacgcccaucaccaguggaugacuaccgaagacaugcugucuguuuggaaucgcguguggaucgaggaaaacccauggauggaggauaagacgcauauauccaguuggggcgacguccccuaccucgggaaacgggaagaccaauggugcggcagcuuaaucggucugacagcuagggccaccugggcaacuaauauucagguggcuaucaaccagguucgaagauugauuggcaaugagaacuaccuggauuauaugacaucgaugaagcgguucaaaaaugaguccgacccugaaggggcccucugguga

SEQ ID NO: 13734 - RNA, 9879 nt, Artificial Sequence
  derived and/or modified CDS sequence (opt3) from DENV-1__FJ898371__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaagcuucaaacuggagaaggaaguggcugagacccagcacgguacgguccuugugcagauaaaguacgagggcacagacgcgccuugcaaaaucccauucuugacccaagaugaaaaggggguuacucagaacggacgccugauuacagcaaaucccaucgugaccgacaaagagaagccuguaaacauagaagccgagccacccuuuggcgagucguauauugucaucggugcuggggaaaaagcccucaagcugucuugguucaagaaaggcuccucaaucggaaagauguuugaggcaacugccagaggcgcuaggcggauggccauucuuggggauaccgcaugggacuucggaaguaucgguggcguguuuacaagcguugggaaacuggugcaucagauuuucggaacggcguacggcgucuuguuuuccggugugucuuggaccaugaagauagggaucggcguacuccugacuugguuaggacugaauagccgaucaacaagucuauccaugaccuguauugcugugggccucguuacacuguaccuuggggucauggugcaggccgauagcggaugcgugaucaacuggaaaggccgcgaauugaagugugguucugggaucuucgucacuaaugagguucacaccuggacggaacaauauaaguuucaggcagacucaccgaaaagacugagugccgcuauuggaaaggccugggaggagggcgugugcgguauaaggagcgcaacacggcucgaaaacaucauguggaaacagauuuccaacgagcugaaucauaucuuacuggaaaacgacaugaaguucaccgugguagucggcgaugugguugggauucuugcucagggaaaaaagaugauccgcccucaacccauggagcacaaauacucuuggaagucguggggcaaggccaaaauaaucggggcggacgugcagaauacuaccuuuauuaucgauggaccaaacacaccugaaugucccgacgaucagagagccuggaauauuugggaggucgaggacuauggcuucgguaucuuuacuaccaacauaugguugaagcucagggauagccacacacaggugugcgaccaucgucugauguccgcugcaauuaaagauucaaaggccguucacgcugacaugggguacuggaucgaaagugagaaaaaugaaacguggaagcuagcccgggcaucuuucauugaggugaagaccuguaucuggccaaaaagccauacucugugguccaacggaguacucgaaucagagaugauaauccccaagauuuauggcgguccuaucagccaacacaauuaccgaccaggcuauuucacacagaccgcggggccguggcaccugggaaaacuugaguuggauuuugaccugugcgaaggcacuacagucgugguggaugagcauugcgggaacagaggacccucuuuaaggaccacgacugucaccggcaagauuauccacgaaugguguugccgcuccuguacacucccuccacugcgguucaaaggugaggacgggugcugguacggaauggagauaagacccguuaaggaaaaggaggaaaaucuugugaaaaguaugguaagcgccggcucuggugagguggacuccuuuucacugggcuugcucuguauuaguaucaugaucgaagaggucaugaggagccgcuggucgcgaaagaugcugaugaccgggacucuagcuguguuccugcuccugauuaugggacagcuuacauggaacgauuugauccggcugugcauuaugguuggcgccaaugcauccgaccguauggggaugggaaccacauacuuagcucucauggccacuuuuaaaaugagaccuauguucgcagugggccugcuuuuuaggcgccugaccucucgggagguccuacuccugacgauagguuugagccugguggccucaguugaauuaccaaacagucucgaggaacugggggauggacuugcuaugggcaucaugauucugaaguugcucacagacuuccaaucccaucagcugugggcgacccuacugucucuuacuuuuaucaaaaccacacucagccugcacuaugccuggaagacuauggcaaugguguuguccauugucucacuguuccccuuaugucucagcaccacgagucagaagacaaccuggcugccgguacuucugggcucuuuggggugcaaaccucucacuauguuucugaucgcugagaauaagauauggggaagaaaauccuggccacuaaacgaagguaucauggccgugggcguugugagcauucugcuuucgucacuccugaagaacgauguccccuuggccgggccuuuaaucgcuggaggcaugcugauugcauguuacgugaucucugguaguuccgccgaccucagccuggagaaagcggcugagguaucuugggaagaggaagccgagcauagcggggcaucccacaauauacuuguggaaguccaggaugacggaacaaugaagauuaaagaugaggagagggacgauacccugacuaucuugcuaaaggccacacugcucgcuguuucaggcguguauccccugaguaucccagcaacccuuuucgugugguacuuuuggcaaaagaaaaagcagcgaagcggcgucuuaugggacacgccuucucccccagaaguggagcgcgccguucuggaugacgggauuuaucggauaaugcagagaggacucuuggguaggucccagguaggcgugggggucuuccaagaaaacguguuccacacuauguggcauguuacccguggagcggugcugauguaccagggcaaacgccucgagccgucaugggcuagugucaagaaagaccugaucagcuauggugggggauggcggcuucagggcuccuggaauacaggcgaggaagugcagguaauugccgucgagccugggaagaaccccaagaaugugcaaaccgcaccaggaacauuuaaaacucccgaaggugagguuggcgccaucgcucuggauuucaagccugggaccucuggaucgccaauugugaacagagaaggcaaaaucgucgguuuguacgggaauggagugguuacgacaagcggcacuuacgugucagccauagcacaggcuaaggccucccaggagggcccccuaccugagaucgaagacgaggucuuuaggaaacgaaaccugaccauuauggaucuccacccggggaguggaaagacacggcgcuauuuaccagcgaucgugagagaagccauuaagaggaaacugcggacccuuauccuggcacccacucgaguaguggcuucugagauggccgaagcucucaaggguaugccuauaagauaccaaaccacagcaguuaaaagcgagcauacgggcaaggagauugucgacuugaugugccacgccacuuucaccaugcgccugcucuccccagugagggugcccaauuauaacaugaucaucauggaugaagcccauuuuacagacccuucaucuauugcugcgcguggguacaucagcacccgggucggaaugggcgaggcagccgcuauauucaugacugccacaccgcccgguaguguagaagcauuuccacaguccaaugccgugauucaggaugaggaaagagacaucccugagaggagcuggaacucuggguaugaguggauuaccgauuuccccggaaaaacgguuugguuugugccaucaaucaaguccggcaaugacauagcuaacugucugcgcaagaauggcaaacgagucauucagcuuaguagaaagacuuucgauacagaauaccaaaaaaccaagaacaacgacugggacuaugugguuaccacugauaucagcgagaugggggcgaauuuucgggccgacagggugaucgauccucgccguugccuaaaacccgucauucugaaggacggaccagaaagagugaucuuggcagguccgaugccuguaacaguggcuucggccgcacagcggaggggccgcauugggcgaaaccacaauaaggagggagaucaguacauauacaugggccagcccuuaaacaaugacgaggaucacgcccauuggaccgaagcuaaaaugcugcucgacaacaucaauacaccagaggguauuauccccgcccuguucgaaccugagagagaaaagucugcggcaaucgauggggaguaucggcuuaggggcgaggcccgcaaaacuuucguugaacugaugagaaggggagaccucccagucugguuguccuacaagguggcuagcgagggcuuucaauauucagaucggcguuggugcuucgacggggaacgcaacaaucaggugcuggaggaaaacauggaugucgagauuuggacgaaagagggagaacgaaagaaacuaagacccagguggcuggacgcccggaccuacagugacccucucgcucuucgcgaguuuaaggaauucgcagccgguagaaggucuguuuccggcgaucugauauuagagaucgggaaguugccgcagcaccugacacagcgggcucaaaaugcccucgacaaccuggugaugcuucauaauagcgaacagggaggccgagcauauagacacgcgauggaggagcugccagauacuauugaaacccucauguugcuggccuuaaucgcuguacuaacagguggggugacccuguuuuuccucucaggccgcggacuuggcaaaacuaguauugggcuguugugugucauggccagcuccgugcugcucuggauggcaucuguugagccccacuggaucgcugccagcauaauccuggaauuuuuccuuauggugcuccugauuccugagcccgacaggcagcggacgccacaggauaaccaauuggcauacgucguaaucggacuguuauuuaugauucuaaccguggccgcuaaugagaugggucugcucgaaacaacuaagaaagaccuuggcaucgggcauguugcgguggagaaccaccaucacgccaccaugcuggaugucgacuugcauccugcauccgcuuggacacuguaugccguggccaccacuauaauuacacccaugaugcgucacacgaucgaaaacaccacugcaaauauuucacucacagcuaucgccaaccaggcggcuauacugaugggacuugauaagggcuggccaaucucuaaaauggacauuggugucccuuuacuggcccucgggugcuacagucaggugaauccguugacccugaccgcagccguucuaaugcugguggcucacuacgcaaucauuggccccggacuccaagccaaggcgacaagagaggcucagaagaggacugccgcaggcaucaugaaaaacccaacgguagaugggauaguggccauugaccuugauccugucguuuaugacgcuaaguucgaaaaacagcugggacagaucauguugcugauccucuguaccucgcaaauucuguuaaugcgcacaacuugggcccuuugcgagagcaucacccuggcaacaggcccccucaccacucuaugggaggguuccccagggaaguuuuggaauacgacaauagcugugucuauggccaacauuuuccggggaucauaccuggcgggcgccgguuuggcauuuagccugaugaaaucccucggcgggggacgaagaggcaccggggcucagggagaaacucuuggcgagaaguggaagaggcagcugaaucaguugaguaaaucugaauucaacaucuauaagcgcagcgguauuauggaggucgaccggucagaagccaaagaggggcugaagagaggagagaccacacgucaugcaguguccaggggcacugcuaaacuccggugguucguagaacgcaauuuagugaagccugaggguaagguuaucgaucugggcugugggcgaggaggcuggaguuacuauugcgccgggcuuaaaaaggugaccgaagucaaaggauacacaaagggcggucccgggcacgaggaaccgauaccaauggccacguauggauggaaccuggugaaacuacauagcggcaaggacgucuuuuucaccccucccgagaaaugugauacucuccugugcgacaucggcgagucuuccccaaaucccacaauugaagaggggagaaccuugagggugcugaagaugguugaaccuuggcuccggggaaaccaauuuuguaucaagauucuuaauccguacaugcccucaguaguggagacucuggagcagaugcagcgcaaacacgguggcauguuagucagaaacccacugagcaggaauucgacacacgaaauguacugggugucuugcgggaccggaaacaucguuagugcggugaauaugacgucccgaauguugcucaaccgguucaccauggcucaucguaagccuacauaugagagagaugucgaccugggcgcagguacucgccacguggccguagaacccgagguggcuaaccuagauauuaucgggcagaggauagaaaauauuaaacaugagcacaagagcaccuggcauuacgacgaggauaacccuuauaaaacaugggccuaccacggaucauaugaaguuaagccauccggcucugcaagcaguauggucaauggcguggugaagcuucugacuaaacccugggacgucaucccuaugguuacccaaaucgccaugacagauaccacuccauuugggcagcagcggguguucaaggagaaaguagacacgagaacacccaaggcuaaacgcggaaccgcgcaaauuauggaagugacugccagguggcucugggguuuucugucccgaaacaagaagccgcggauauguaccagagaggaauucacaaggaaaguccgcagcaaugcagcuaucggcgccguguuuguugacgagaaccaguggaauucugcaaaggaggccguggaagaugagcguuucugggacuugguccagaaagaacgggagcugcacaagcaggggaaaugcgcuacgugcguguacaacaugaugggaaagagagaaaagaaacucggcgaguuugguaaggccaaagggucaagggcgauuugguauauguggcuuggagcacgcuuccuggaguuugaagccuuaggcuucaugaaugaggaucauugguucagucgagaaaacucccugagcggcguagagggggagggauugcacaagcucgguuacauccugcgggacauuucuaaaaucccuggcgggaauauguacgcugaugacaccgccggaugggauacuagaauaacagaagacgaucuacaaaacgaggcaaagaucaccgacauuauggaaccagagcaugcucuucuggccacuucgaucuuuaaacucacauaucagaauaagguugugaggguccagcgccccgcuaagaacggcaccgugauggaugugauuucaagacgggaccagagggguagcgggcaagucggaacauacggccugaauacuuucaccaacauggaagcccaguugauccgucagauggaguccgagggcauauuuuuaccuagugaacuggagacgcagaaccucgcagaacgaguucuugauuggcuggagaaauaugggguggaacgccuaaagagaauggcgauuucuggagacgacuguguagugaaaccaaucgaugaccgguucgccaccgcucugacagcccucaaugauauggguaaggucaggaaagacaucccccaaugggagccgagcaagggcuggaacgauuggcagcaggugccuuuuugcucccaccacuuccaucaguugauuaugaaggacgggcgcgagauaguugugcccuguagaaaucaagaugaacuggucggacgggcaagggugucacagggcgcugguuggagucuucgagagacugccugccuggggaaaucuuacgcacagauguggcaacucauguauuuucaccguagagacuuacgccuggccgcgaacgcuaucuguagcgccguaccaguugauugggugccuaccucccggacaacuuggucaauucaugcacaccaucaguggaugaccacggaagacauguugagcgucuggaauaggguguggaucgaggaaaaccccuggauggagaauaagacacacguuucuuccuggggagaugugccauaccugggcaaaagagaggaccaguggugcggcagucucauugggcuuaccgcccgcgcuacuugggccagcaacauccaggucgcaauaaaucaagugcggaggcugaucggaaacgaaaauuaucuagacuacaugacaucgaugaagcgauucaaaaacgagggugaucccgaaggcgcucugugguga

SEQ ID NO: 13735 - RNA, 9879 nt, Artificial Sequence
  derived and/or modified CDS sequence (opt3) from DENV-1__FJ882545__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaaaaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguucaaagaauuugccgcuggccggcgauccgucagcggggaucucauacuugagaucggaaagcugccgcagcacuuaacacagagagcccagaaugcauuggacaaccugguuaugcuccauaauucagaacaaggcggucgcgcguauaggcacgccauggaggagcugccagauacuauugaaacccuuaugcugcucgcuuugaucgccgugcugacagggggcguaaccuuauucuuucuaaguggacggggccuggggaagacuagcauuggacuccuuugugugauggcauccucuguccuguuguggauggcuagcguggagccccauuggaucgccgcauccauaauccuggaguucuuucucaugguucugcuuauuccugagcccgaccgucagagaacgccacaggauaaccagcucgccuacguggucaucggucuguuguucaugauucugaccguagcugcgaaugagaugggcuuacuagaaacaacuaaaaaggaccuggggaucggacacguggccguugagaaccaccaucacgcagcuaugcucgauguggaccuucauccugccucagccuggacccuguacgcagucgcuacaaccauaauuacucccaugaugaggcacacaaucgaaaacacgaccgccaauauuucuuugacugcgaucgcuaaccaagccgcaauacugaugggccucgauaaagguuggccaaucaguaagauggacauuggggugccucugcuugccuuaggcugcuauucgcaggucaauccgcugacacucaccgcugcaguguugaugcugguugcccauuacgcgaucauuggacccggccuacaggcuaaagccacccgcgaggcacaaaagcggacagccgcugggaucaugaagaacccaacuguggauggaauaguagccauugaccuggauccuguggucuaugacgcaaaauuugaaaagcagcucggccagaucaugcuucugaucuuguguacgagccagauucugcucaugcgaaccacaugggcucugugcgaguccaucacuuuagccaccgguccccuuacaacccugugggaggggucuccaggaaaauucuggaauacuacgauagcgguuucaauggccaacauuuuuagaggcagcuaccucgcaggagcuggccuagccuucucccugaugaagagucuagggggaggcaggcgcgggacaggagcacaaggcgaaacccugggugagaaauggaagcggcagcucaaucagcuuucuaagagcgaguucaacacuuauaaaagaucagggaucauggagguggaccguuccgaagcuaaggagggacugaaaaggggcgagaccacaaagcacgccgucagucgggguacugccaaauugcgcugguuuguggaacgaaaucugguaaagccugagggcaaggugauugaucucggguguggaagaggcggguggagcuacuauugcgcgggacuaaagaagguuaccgaagugaaaggcuacacaaagggugggcccggacacgaggaaccgaucccaauggcuacguacggcuggaaccuggucaaacuucauucuggcaaggacguguucuuuauaccucccgagaaaugugauacccugcuaugcgacaucggggaguccucaccaaaucccacuauugaagagggaaggacacuccggguccugaagaugguggaaccuugguugcgcgguaaccaguucuguaucaagauucugaauccguauaugcccagcguuguagagacccucgagcaaaugcagagaaaacacggcgggaugcuugugaggaacccacugucgcgaaauucuacucaugaaauguacugggucaguugcggaacaggcaacaucguguccgcaguuaauaugaccagccggauguuacugaaccguuuuacgauggcccacagaaagccuaccuaugagcgcgauguggacuuggguacagggacuaggcacgucgcuguggaacccgagguagccaaccucgauauuaucggacagcggauagaaaauauuaaacaugagcacaagucaaccuggcauuacgacgaggauaacccuuauaaaacaugggcauaccacggcuccuaugaagugaagccaucuggcagcgccaguuccaugguuaauggggucgugaagcugcuaacuaaacccugggacgugaucccuauggucacccagaucgcuaugacagauaccacuccauucggacaacagagaguuuuuaaggagaaaguggacacgcgcacacccaaggcgaaaagggguaccgcccagauuauggaaguaacugcacgauggcuuuggggcuuccugagccggaacaagaagccgagaauauguaccagggaggaauuuacacgcaaagugcguucuaaugcugccaucggggcagucuucguggacgagaaccaauggaacucagccaaggaggcuguugaagaugagcgguuuugggaccucgugcauagagaaagggagcugcacaaacagggaaagugcgccacgugcgucuacaacaugaugggcaaacgcgaaaagaaguugggugaguucgggaaagcgaagggaagucgagcaauuugguacauguggcugggcgcccgguuucucgaguucgaagcucuuggcuucaugaaugaggaucacugguuuuccagagaaaacagccugucugggguggagggagaggguuuacauaaacugggcuauaucuugagggacauuucgaagaucccugggggaaauauguacgccgaugacaccgcaggcugggauacucgcauaacagaagacgaucuccagaacgaggcuaaaaucaccgacauuauggaaccagagcacgcccugcuagcuaaggccaucuucaaacuuacuuaucagaauaagguaguuagagugcaacggcccgcaaagaacgguacagucauggaugugauuucaaggcgugaccagcgagggagcggacaggugggcaccuacggccugaauacauuuacuaacauggaagcgcagcucauccgccaaauggaguccgaggggauauucaguccuucugaacuggagaccccaaacuuggccgaaagagcuuuagauuggcugggaaaauauggugucgagcggcucaagaggauggccauuagcggcgacgacuguguugugaaacccaucgaugaccgcuuugcaacggcucuuaccgcccugaaugauauggggaagguaagaaaagacaucccgcagugggaaccuuccaagggauggaacgauuggcaacaggugcccuucugcucacaucacuuucaccaacuaauuaugaaggacggccgggagauagucgugccauguaggaaucaggaugagcugguuggucgagcacgugugagucagggggccggauggucucucagagaaacagcgugcuugggcaaaagcuacgcucagauguggcaacugauguauuuccaucgccgggaccuuaggcuggccgcaaacgccaucuguuccgcugucccuguggauuggguacccacuucaagaaccacauggagcauucacgcccaucaccaguggaugacuaccgaggacaugcucucuguuuggaaucgcguguggaucgaagagaacccauggauggaagauaagacgcauauuuccaguugggaggacguccccuacuuaggcaaacgggaggaccaguggugcgggagccugaucggauugacagcaagggcuaccugggccacuaauauacaaguggcgaucaaccagguucgaagacugauugguaaugaaaacuaccucgauuauaugacaucgaugaagcgguuuaaaaaugaguccgacccugaaggcgcucuuugguga

SEQ ID NO: 13736 - RNA, 9879 nt, Artificial Sequence
  derived and/or modified CDS sequence (opt3) from DENV-1__FJ898372__SS-prME
uccgugaccaugcugcucaugcuuaugcccacagcacuggcuuuccacuugacuacgcggggcggggaaccucauaugaucgucuccaagcaggaaaggggaaagucuuuacuguuuaagaccucagccgguguuaauaugugcacauugauugcaauggaccucggcgagcugugugaagauacuaugaccuacaagugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaagggauaagcccacucuggacaucgaacuacucaagacagaggugaccaacccugccgugcugcggaaacuuugcauugaagcuaaaaucucuaauacgaccacagauagccgcuguccaacucaaggagaggccacccuggucgaagaacaggacgcaaacuucguuugccgaagaacauuuguggauaggggcugggguaauggguguggauuguucggcaagggcucccucauaacuugcgcuaaauuuaagugcguaaccaagcuggaggggaaaauugugcaguacgaaaacuuaaaguauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccacggacaggacuggacuucaacgaaauggucuugcuaacgaugaaagagaagucuuggcuggugcauaaacagugguuucucgaucugccgcuucccuggaccuccggcgcaucaacuagccaagagacauggaaucgucaggaccuguugguaaccuucaagacagcucacgccaaaaagcaggaaguugugguccucgguagucaagagggggcuaugcacacugcccugaccggcgcaacggaaauccagaccucuggaacaacuaccauuuuugccggccauuuaaagugccgccugaaaauggauaagcuaacacucaaagggauguccuaugugauguguacugggagcuucaagcuggagaaagaagucgcugagacccagcacgguacggugcuuguucagauaaaguacgagggcacagacgcgccuugcaagaucccauucucgacccaagaugaaaaaggggugacucagaacggaagauugauuacagcaaaucccaucguaaccgacaaggagaaaccugucaacauagaagccgagccacccuuuggcgagucuuauauugugaucggugcuggggaaaaggcccugaaacucuccugguucaagaagggcucaaguaucggaaaaauguuugaggcaacugccaggggcgcucggcgaauggccauucugggggauaccgcaugggacuucggaagcaucgguggcguuuuuacauccguggggaaacuuguccaucagauuuucggaacggcguacggcgugcuguuuucugguguaagcuggaccaugaaaauagggaucggcguguugcucacuuggcugggauuaaauucacgcaguacaucccugagcaugaccuguauugcuguuggccuagucacacucuaccugggggugauggugcaggccgauucuggaugcgucaucaacuggaagggcagagaacuuaaaugugguucagggaucuucguuacuaaugaggugcacaccuggacggaacaauauaaguuucaggcagacaguccgaagagguugagcgccgcuauuggaaaagccugggaggagggcgugugcgguauacgguccgcaacacgccuggaaaacaucauguggaagcagauuucuaacgagcucaaucauauccuguuagaaaacgacaugaaacugaccguagucgugggcgauguugcugggauucuuggacagggcaagaaaaugaucagaccucaacccauggaguacaaguauucguggaaaagcugggggaaggccaagauaaucggagcggacgcccagaauacuaccuucauuaucgauggcccaaacacaccugaaugucccgacgaucagagggcuuggaauauuugggagguggaggacuacgguuuugggaucuucacuaccaacauaugguugaaacuccgugauuccuauacacaggucugcgaccaccggcugaugucagcagccauuaaggauaguaaagcugugcacgccgacaugggauacuggaucgaaucugagaagaaugaaacguggaaacuagcacgagcgagcuuuauugagguuaagaccuguaucuggccaaagucccauacucuguggucaaacggcgugcucgaaagcgagaugauaauccccaaaauuuaugguggcccuaucucucaacacaauuacagaccaggguacuucacacagaccgccggaccguggcaucugggcaaacuugaguuggauuucgaccugugcgaagggacuacaguagucguggaugagcacugcggaaacaggggccccuccuuacgcaccacgacugugaccgguaaaauuauccacgaaugguguugccggaguuguacacucccuccacugagauuuaggggagaagacggaugcugguauggcauggagauacgccccgucaaggaaaaagaggaaaaucuuguuaagagcauggugucugcugguuccggcgagguagacucauucagucugggguugcucuguauuagcaucaugaucgaagaggugaugcgaucgcgguggucccguaagaugcugaugaccggaacucuagccgucuuuuuccugcucauuaugggccagcugacauggaacgaucuuaucagauugugcauuauggugggggcaaaugcuucugacaggaugggaaugggcaccacauaccuggccuuaauggcaacuuuuaaaaugcgcccuauguucgccguuggucuccuguuucggagacuuaccagcagggaggugcugcuacucacgauagggcugucauuggucgcuaguguggaacugccaaacuccuuagaggaacucggagauggccuggcgaugggcaucaugauucuuaagcuguugacagacuuccaaucucaucagcucugggccacccugcuaagccugacuuuuaucaaaaccacauucucccuucacuaugcauggaagacuauggcuaugguucucucaauugugagccuguuucccuugugucugaguaccacgucucagaaaacaaccugguuaccgguccuccuggggucccuuggaugcaagccucugacuauguucuugaucgccgagaauaagauauggggucgaaaaagcuggccacucaacgaaggcaucauggccguagggauugugucgauccugcuaucaucucugcuuaagaacgauguuccccucgcuggaccucugauugcaggcgguauguugaucgccuguuacgugauaaguggguccagcgcggacuuaucucuggagaaagcugccgaggucagcugggaagaggaagcagagcauuccggagccucacacaauauucucguggaaguacaggaugacggcacaaugaagaucaaagaugaggagcgcgacgauacccugacuauccuucugaaggcuacauugcuagcagugaguggcgucuauccccugagcauuccagccacccucuuuguuugguacuucuggcagaagaagaagcagcggucuggggugcugugggacacgccuucacccccagaaguggagagagcgguccuugaugacggaauauauaggaucaugcagcgugguuuacugggccgcagccagguggggguuggaguauuccaagaaaacguguuucauacuauguggcacgucacccggggcgcugugcucauguaccaggguaaaagauuggagccgaguugggccagcguuaagaaagaccugauuuccuacgggggaggcuggaggcuccgaggcucuuggaauacaggggaggaagugcaggucaucgcaguggagccuggaaagaaccccaaaaauguacagaccgccccagguacauucaagacucccgaaggcgaggucggggcuauugcccuggauuuuaagccuggaaccucgggcagcccaaucgugaaccgggaagguaaaauaguugggcuuuauggaaauggcguggucacgacaucaggcacuuacguguccgcaaucgcucaagccaaggcgagucaggaggggccccugccugagauugaagacgagguuuuccgcaaaagaaacuugaccaucauggaucuacacccgggaucugguaagacaaggcgguaucugccagccauugugcgagaagcaaucaaaagaaagcuccgcaccuuaauacuggcucccacuagggucguggccagcgagauggcugaagcacuuaagggcaugccuauucguuaccagaccacagccguaaaauccgagcauacggggaaggagaucguggaccugaugugccacgccacuuuuaccaugcggcucuugucaccaguuagaguccccaauuauaacaugaucauuauggaugaagcucauuucacagacccuucuagcaucgcggcaaggggauacauaaguacccgcgugggcaugggugaggccgcugccauuuuuaugacugcaacaccgcccggguccguggaagccuucccacaaagcaaugcugucauccaggaugaggaacgagacauuccugagagaucuuggaacucaggauaugaguggaucaccgauuuucccggcaaaacgguaugguucgugccauccauaaagaguggcaaugacauugcgaacugucugcggaaaaaugggaagaggguuauccagcucagccgcaagacuuuugauacagaauaccagaaaaccaagaacaacgacugggacuacguggucaccacugauaucucggagaugggagccaauuuccgugcagacagagugauugauccucggaggugccugaaacccguuauccuuaaggacgguccagaacgcgugauucuagcuggcccgaugccugucacaguggccucugcagcccaacgaagagggcggauaggaaggaaccacaauaaagagggcgaucaguauaucuacaugggucagccccugaacaaugacgaggaucaugcucacuggaccgaagccaagauguuguuagacaacauuaauacaccagaggggaucauccccgcgcuguucgaaccugagcgcgaaaaguccgcagccguagauggcgaguauagacucaggggagaggcucggaaaacuuuuguggaacugaugcgucgcggcgaccuuccaguuuggcugagcuacaaggucgccucagagggguuccaguauagugaucgaagauggugcuuugacggagaaaggaacaaucaagugcucgaggaaaacauggauguggagauuuggacgaaagagggugaacggaagaaauugcgccccagauggcuggacgcuaggaccuacucugacccucuagcacugcgggaguucaaggaauuugccgcuggccgaagauccgucagcggggaucucauacuugagaucggaaaacugccgcagcacuuaacacagcgcgcccagaaugcauuggacaaccugguuaugcuccauaauucagaacaaggcgguagggcguaucggcacgccauggaggagcugccagauacuauugaaacccuuaugcugcucgcuuugaucgccgugcugacagggggcguaaccuuauucuuucuaaguggacguggccuggggaagacuagcauuggacuccuuugugugauggcauccucuguccuguuguggauggcuagcguggagccccauuggaucgccgcauccauaauccuggaguucuuucucaugguucugcuuauuccugagcccgacagacagaggacgccacaggauaaccagcucgccuacguggucaucggucuguuguucaugauucugaccguagcugcgaaugagaugggcuuacuagaaacaacuaagaaagaccuggggaucggacacguggccguugagaaccaccaucacgcagcuaugcucgauguggaccuucauccugccucagccuggacccuguacgcagucgcuacaaccauaauuacucccaugaugcgccacacaaucgaaaacacgaccgccaauauuucuuugacugcgaucgcuaaccaagccgcaauacugaugggccucgauaaggguuggccaaucaguaaaauggacauuggggugccucugcuugccuuaggcugcuauucgcaggucaauccgcugacacucaccgcugcaguguugaugcugguugcccauuacgcgaucauuggacccggccuacaggcuaaggccacccgggaggcacaaaaacgaacagccgcugggaucaugaagaacccaacuguggauggaauaguagccauugaccuggauccuguggucuaugacgcaaaguuugaaaaacagcucggccagaucaugcuucugaucuuguguacgagccagauucugcucaugagaaccacaugggcucugugcgaguccaucacuuuagccaccgguccccuuacaacccugugggaggggucuccaggaaaguucuggaauacuacgauagcgguuucaauggccaacauuuuuaggggcagcuaccucgccggugcuggccuagccuucucccugaugaaaagucuagggggaggccgccgggggacaggagcacaaggcgaaacccugggugagaaguggaaaagacagcucaaucagcuuucuaagagcgaguucaacacuuauaagcguucagggaucauggagguggacagguccgaagcuaaagagggacugaagcggggcgagaccacaaaacacgccgucagucgcgguacugccaaguugcgaugguuuguggaaagaaaucugguaaaaccugagggcaaggugauugaucucggguguggaaggggcggguggagcuacuauugcgcgggauuaaagaaaguuaccgaagugaagggcuacacaaaaggugggcccggacacgaggaaccgaucccaauggcuacguacggcuggaaccuggucaaacuucauucuggcaaagacguguucuuuauaccucccgagaagugugauacccugcuaugcgacaucggggaguccucaccaaaucccacuauugaagagggacggacacuccgcguccugaaaaugguggaaccuugguugagagguaaccaguucuguaucaagauucugaauccguauaugcccagcguuguagagacccucgagcaaaugcagaggaagcacggcgggaugcuugugcgaaacccacugucgagaaauucuacucaugaaauguacugggucaguugcggaacaggcaacaucguguccgcaguuaauaugaccagccguauguuacugaacagauuuacgauggcccaccgcaaaccuaccuaugagagggauguggacuuggguacagggacucggcacgucgcuguggaacccgagguagccaaccucgauauuaucggacagagaauagaaaauauuaagcaugagcacaaaucaaccuggcauuacgacgaggauaacccuuauaagacaugggcauaccacggcuccuaugaagugaaaccaucuggcagcgccaguuccaugguuaauggggucgugaagcugcuaacuaagcccugggacgugaucccuauggucacccagaucgcuaugacagauaccacuccauucggacaacagcgcguuuuuaaagagaagguggacacgaggacacccaaagcgaagcgagguaccgcccagauuauggaaguaacugcacgguggcuuuggggcuuccugagcagaaacaaaaagccgaggauauguacccgcgaggaauuuacacguaaggugcggucuaaugcugccaucggggcagucuucguggacgagaaccaauggaacucagccaaagaggcuguugaagaugagagauuuugggaccucgugcauagggaacgcgagcugcacaagcagggaaaaugcgccacgugcgucuacaacaugaugggcaagcgagagaagaaguugggugaguucgggaaggcgaaaggaagucgggcaauuugguacauguggcugggcgccagauuucucgaguucgaagcucuuggcuucaugaaugaggaucacugguuuuccagggaaaacagccugucugggguggagggagaggguuuacauaagcugggcuauaucuugcgcgacauuucgaaaaucccugggggaaauauguacgccgaugacaccgcaggcugggauacuagaauaacagaagacgaucuccagaacgaggcuaagaucaccgacauuauggaaccagagcacgcccugcuagcuaaagccaucuucaaacuuacuuaucagaauaaaguaguucgggugcaaaggcccgcaaagaacgguacagucauggaugugauuucacgucgagaccagcgcgggagcggacaggugggcaccuacggccugaauacauuuacuaacauggaagcgcagcucaucagacaaauggaguccgaggggauauucaguccuucugaacuggagaccccaaacuuggccgaacgggcuuuagauuggcuggagaaguauggagucgaaaggcucaaacgcauggccauuagcggugacgacuguguugugaagcccaucgaugacagauuugcaacggcucuuaccgcccugaaugauaugggcaaaguacggaaggacaucccgcagugggagccuuccaaaggguggaacgauuggcaacaggugcccuucugcucacaucacuuucaccaacuaauuaugaaggacggaagggagauagucgugccaugucgaaaucaggaugaacugguuggccgugcaagagugagucagggugccggguggucucuccgcgagacagcgugcuugggaaagagcuacgcucagauguggcaacugauguauuuccaucggagggaccuuagacuggccgcaaacgccaucuguuccgcugucccuguggauuggguacccacuucacgcaccacauggagcauucacgcccaucaccaguggaugacuaccgaagacaugcucucuguuuggaaucggguguggaucgaggaaaacccauggauggaggauaaaacgcauauuuccaguugggaggacguccccuacuuaggcaagagggaagaccaguggugcggcagccugaucggguugacagcacgagcuaccugggccacuaauauacaaguggcgaucaaccagguuagacggcugauuggaaaugagaacuaccucgauuauaugacaucgaugaaaagguuuaagaaugaauccgacccugagggugcucuuugguga

SEQ ID NO: 13737 - RNA, 9879 nt, Artificial Sequence
  derived and/or modified CDS sequence (opt3) from DENV-1__FJ898373__SS-prME
agcgugacaaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggagaacugugugaagauacuaugaccuacaaaugcccacggauaacagaaguggaaccggacgauguagacuguuggugcaauaccacugauacaugggugaccuaugggacguguagucaaacuggagaacaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgauugcuacaaucacaccccaggccccuacuagcgagauccagcugaccgacuacggggcgcucacacuugauuguucuccaagaaccggacuggacuucaacgaaaugguguugcuaacuaugaaagagaaguccuggcugguacauaaacagugguuucucgaucugccgcuucccuggacaucaggcgccagcacgagucaagagaccuggaauaggcaggaccuguugguuacuuucaagacagcacacgcuaagaaacaggaaguggucgugcucgguucucaagagggggccaugcacaccgcucugacaggcgccacugaaauucagaccacgggaaccacaacuauauuugcaggccauuuaaagugccggcugaaaauggauaagcuaacccucaaagggauguccuaugucauguguacaggcagcuucaagcuggagaaggaaguggccgagacucagcacgguaccguucuugugcagaucaaauacgagggcacggacgcuccuugcaagauuccauucucgacacaagaugaaaaagggguaacccagaacggacguuugaucacugcgaaucccauagucacagacaaggagaaaccugugaacauugaagcagagccacccuuuggcgagucuuauaucguuaucggugccggggaaaaggcucugaagcucuccugguucaaaaagggcucaaguauuggaaaaauguuugaggccaccgcacgcggcgccagaaggauggcuauccugggggauacugccugggacuucggaagcauugguggcguguuuaccuccgucgggaaacuugugcaucagauauucggaacagcauacggcguacuguuuucuggugugagcuggacgaugaaaaucgggauuggcguuuugcucaccuggcugggauuaaauucacggaguacuucccugagcaugacauguaucgcggucggccuaaucacccucuaccugggggugauggugcaggcugauucuggaugcgucauuaacuggaagggccgagaacuuaagugugguucagggauauucguuacaaaugaggugcacacuuggaccgaacaauauaaauuucaggccgacaguccgaagcgcuugagcgcagccgugggaaaggcuugggaggagggcguaugcgguaucagauccgccacgaggcuggaaaacauuauguggcggcagaucucuaacgagcucaaucauauucuguuagaaaacgacaugaaguucacagucgugguuggcgauguggucgggauccuggcacagggcaagaagauggugcgcccucaacccauggagcacaaauacucguggaaaagcuggggcaaggcuaagauaaucggggccgacguucagaauaccacuuuuauuaucgauggaccaaacaccccugaaugucccgacgaucagagagcguggaauauuugggagguggaggacuauggcuucgguaucuuuacaacuaacauauggcuuaaguugagggauuccuacacccagguaugcgaccaccgucucaugucagccgcuauuaaagauaguaaggcaguccaugccgacaugggguauuggaucgaaucugagaaaaaugaaacauggaagcuggcucgggccagcuucauugaggugaagacguguaucuggccaaaaucccacacccuauggucaaacggagugcuggaaagcgagaugauaauccccaagauuuacggcgguccuaucucucaacauaauuaucgaccaggcuacuucacucagacagcagggccguggcaccucggaaaacuggagcuugauuuugacuugugcgaaggcaccacugucguuguggaugagcacugcgggaacagaggacccucccugaggacaaccacgguaacuggcaagauuauccaugaaugguguugccgcaguuguaccuuaccuccacuccgguucaaaggugaggacgggugcugguacggaauggagauaagacccgugaaggaaaaggaggaaaaucuggucaaaagcauggugucugcgggcuccggugagguugacucauuuagucuuggccuguuguguauuagcaucaugaucgaagaggugaugaggucgcgcuggucccgaaagaugcucaugacagggacccuggccgucuucuuucuacugauuaugggacagcucacuuggaacgaucugauccggucuugcauuauggugggcgcuaaugccagcgaccguauggggaugggaacaaccuaucuugcauugauggcuacauucaaaaugagaccuauguuugccguuggccuguuauucaggcgccucacuucacgggaggugcugcuucugaccauaggucuaagucucgucgcauccguagaacugccaaacucuuuggaggaacugggggauggauuagccaugggcaucaugauucucaagcugcuuacggacuuucaaagcuaccagcugugggcuacauugcucucccugaccuucaucaaaacuaccuuuucacuacacuaugcguggaagacaauggccauggugcugagcauuguuagucuucucccccuguguuugucuacuaccucccagaagacgacauggcugccgguguuacucggcagccuggggugcaaaccucuuaccauguuccugaucgcagagaauaagauauggggaagaaaaucguggccauugaacgaagguaucauggcugucggcauugugucaauccuccugucuagucuacugaagaacgauguaccccuugccgggccucucauugccggaggcaugcugaucgcuuguuacgugauauccgguagcucugcagacuugagcuuagagaaagccgcggaggucuccugggaagaggaagcugagcauucaggggccagucacaauauucugguugaagugcaggaugacggaacuaugaagaucaaagaugaggagagggacgauacacucaccauccugcuuaaggcaacucuguuggccgugagcggcgucuauccccuaucuauuccagcuacacuguuugugugguacuucuggcaaaagaaaaagcagcgauccggcguucucugggacaccccuucacccccagaaguagagcgcgcagugcuggaugacgggauauaucggaucaugcagagaggacuuuuagguaggagucaggucggcguggggguuuuccaagaaaacguguuucauacgauguggcacgucacucguggagccgugcugauguaccagggcaaacgccucgagccgagcugggcguccguaaagaaagacuugauuucuuacggugggggauggcggcugcagggcucguggaauaccggcgaggaaguccaggugaucgcuguugagccugggaagaaccccaagaaugugcaaacagccccaggaaccuucaaaacacccgaaggugaggucggcgcaauugcccucgauuuuaagccugggacuagcggaucaccaaucgugaacagagaaggcaaaauaguuggucuguaugggaauggaguggucaccacguccggcacauacgugagugcuaucgcccaggcaaaggcuucucaggagggcccccuuccugagauugaagacgagguauucaggaaacgaaaccugacuaucauggauuugcacccggggagcggaaagacccggcgcuaucuaccagccauugugagagaagcgaucaagaggaaacugcggacacucauauuagcccccacccgaguugucgcauccgagauggcugaagcccugaaggguaugccuauuagauaccaaacuaccgcugugaaaucagagcauacaggccgcgagaucguggaccuuaugugccacgcaacguuuacuaugaggcugcucucuccaguccguguacccaauuauaacaugaucauuauggaugaagcccauuucaccgacccuagcaguaucgccgcucggggguacauauccacaagagugggaaugggcgaggcggcagccauuuuuaugaccgcuacuccgcccgguagcguugaagccuucccacagucuaaugcagugauccaggaugaggaaagggacauuccugagcgcucauggaacuccggguaugaguggaucacagauuuucccggaaagaccgucugguucgugccaaguauaaaaagcggcaaugacauugccaacuguuugcgaaagaauggcaagagaguuauccagcugucgcggaaaacguuugauacugaauaccaaaagaccaagaacaacgacugggacuacguggucaccaccgauaucucugagaugggggcuaauuucagggcggaccgcgugauugauccucguagaugccucaagcccguaauccugaaagacggaccagaacgggugauucuugccgguccgaugccuguuacugucgcauccgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggagaaaagcgccgcgauugauggggaguauaggcugcgcggcgaggcaagaaagacauuuguggaacucaugaggcggggagaccugccaguguggcuuucauacaaagucgccagugagggcuuccaauauucugaucgucgcuggugcuuugacggggaacgaaacaaucagguucuggaggaaaacauggauguggagauauggacuaaggagggagaaaggaaaaagcucaggccccggugguuggacgcucgcacguacuccgacccucuggcccuaagagaguucaaagaauuugcugcagguaggcggagcguaucaggcgaucugauccucgagauugggaaacuuccgcagcaccugacccagcgagcccaaaaugcuuuagacaacuuggugaugcugcauaauagugaacagggaggcagagccuaucgccacgcaauggaggagcucccagauacaaucgaaacucugaugcuucuggcgcucauugccgucuugaccgguggggugacacuguucuuuuuaagcggcaggggacuaggcaagaccuccaucgggcugcucuguguuauggcuucuagcgcccuucuguggauggcauccguggagccccauuggauagcugccucaaucauuuuggaguucuuucugaugguccuccugaucccugagcccgaccggcagcguacuccacaggauaaccaacuugcauacguagugauuggacuccuguucaugaucuugacgguugccgcuaaugagaugggucuguuagaaaccaccaaaaaggaccuaggcauagggcacguggcggucgagaaccaccaucacgccacuaugcuggauguggaccuccauccugcaucugcuuggacccuuuacgccgucgccacaaccauuaucacucccaugaugagacacacaauugaaaacacgaccgcaaauaucagucugacugcuauagccaaccaggcggcuaucuugaugggacuggauaaaggcuggccaauuucgaagauggacaucggugugccucuccuggcccuugggugcuauagccagguuaauccguuaacacugaccgcagccgugcucauguugguagcucauuacgcaauuaucggccccggacugcaagccaaagcgaccagggaggcucagaagcgcacagccgcaggcauaaugaagaacccaacuguggaugggauugucgccaucgaccuagauccuguuguguaugacgcuaaauuugaaaagcagcugggacagaucaugcuccuuauucuguguacgucccaaaucuugcugaugcggaccacaugggcccucugcgagucuauaacucuggcaaccggccccuuaacaacccuuugggaggguucaccagggaaauucuggaauacuacgauugcugucagcauggccaacaucuuucgaggauccuaccuggcgggcgccggucucgcauucagucuaaugaagucucugggcgggggaagaaggggcacaggggcucagggagaaaccuugggcgagaaauggaagcgccagcugaaucagcucagcaagucagaguucaacacuuauaaacgguccgguauuauggagguggacagaagugaagccaaggaggggcuucguaggggagagaccacaaaacacgcaguaagccggggcacugcuaagcugcgcugguuuguggaacgaaauuugguuaaaccugaggguaaggugaucgaucugggcugugggagaggaggcuggucuuacuauugcgccgggcucaagaaagucaccgaagugaagggauacacaaaaggcggucccgggcacgaggaaccgauaccaauggccacguacggauggaacuuagucaagcugcauuccggcaaagacguguucuuuaucccucccgagaagugugauacccuucugugcgacauuggcgagucaagcccaaaucccacuaucgaagaggggaggacacuacggguucucaaaaugguagaaccuuggcugcgcggaaaccaauucuguauuaagaucuugaauccguauaugcccucgguggucgagacccuggagcacaugcagagaaagcaugguggcaugcucgugaggaacccacuuucucgaaauaguacucacgaaauguacuggguuuccugcgggacaggaaacauugugagcgcggucaauaugaccucacggaugcuguuaaaccguuuuacgauggcucacagaaaaccuaccuaugagcgcgauguggaccugggcgcagguacaaggcauguagccguggaacccgagguugcuaacuuggauaucauagggcagcggauugaaaauaucaagcacgagcauaaauccacuuggcacuacgacgaggauaacccuuauaagaccugggccuaccauggaucuuaugaagucaaaccaagcggcagugcauccagcauggugaauggcguggucaagcuccugacaaagcccugggacguuaucccuauggugacucagauugccaugaccgauacaaccccauucgggcaacagagaguauuuaaagagaagguggacacucgcacgcccaaagcuaagaggggaacagcgcagauaauggaagucaccgcccgauggcuaugggguuuccuuucucggaacaaaaagccgagaaucuguacuagggaggaauuuacccgcaaggugcguucaaaugcagcuauuggcgccguuuucguggacgagaaccaauggaauagugcaaaagaggccgucgaagaugagcgguuuugggaccuggugcacagagaaagggagcuccacaagcaggggaaaugcgcuacaugcguauacaacaugaugggaaagcgcgagaaaaagcugggcgaguucgguaaggccaaagggucccgagcgaucugguacaugugguugggagcacgguuucuggaguucgaagcccucggcuucaugaaugaggaucauugguuuagcagagaaaacucucuuucgggcguugagggggagggacugcacaaguuagguuauauucugagggacaucucaaaaauaccuggcgggaauauguacgcugaugacacggccggaugggauacccgcaucacugaagacgauuugcagaacgaggcaaagauuacagacaucauggaaccagagcaugcucuccuggccaccagcauuuucaaacuaacuuaucagaauaagguggucagagugcaacggcccgcuaaaaacggcacagugauggaugucaucuccaggcgugaccagcgagguagugggcagguuggaaccuacggccuuaauacauuuacuaacauggaagcccagcugauacgccaaauggagucugagggcauuuucagcccuuccgaacucgagaccccaaaccuggcagaaagaguguuggauugguuagagaaguaugggguagaacggcugaagaggauggcgaucucaggagacgacuguguggucaaacccaucgaugaccgcuuugccacggcucucaccgcccuuaaugauauggguaaggugagaaaagacauuccgcagugggagccuaguaagggcuggaacgauuggcagcagguucccuucugcucucaccacuuucaucaacugauaaugaaagacgggcgggagaucguggucccauguaggaaucaggaugagcuagugggacgagcacguguaagccagggcgcugguuggucccugagagagacagccugccucgggaagucauacgcacagauguggcaauugauguauuuccaccgccgggaccugaggcuugccgcgaacgcuauuuguagcgccguuccuguggauuggguccccacuucuagaaccacaugguccauccaugcacaccaucaguggaugacuaccgaagacaugcugaguguguggaaucgcguuuggauugaggaaaacccauggauggaggauaagacgcacaucagcucguggggagacgugcccuaccucggcaaacgggaggaccaguggugcggcuccuuaauagggcugacagccagggcuaccugggccacuaauauccaagucgcaauuaaccaggugcgaagauugaucggaaaugaaaacuaccuggauuauaugacaucuaugaagcgguuuaaaaaugagucagacccugaaggugcucucugguga

SEQ ID NO: 13738 - RNA, 9879 nt, Artificial Sequence
  derived and/or modified CDS sequence (opt3) from DENV-1__FJ898374__SS-prME
uccgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguugacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccguaacgcggcuggaaaacauuauguggaaacagaucucuaacgagcucaaucauauucuguuagaaaacgacaugaaguucacagucgugguuggcgauguggucgggauccuggcccagggcaaaaagaugauacgcccucaacccauggagcacaaauacucguggaaaagcuggggcaaggcaaagaucauuggggcugacgugcagaauaccacuuuuaucauugauggaccaaacaccccugaaugucccgacgaucagagagccuggaauaucugggagguugaggacuauggcuucgguauauuuacaacuaacauuuggcuuaaguugagggauuccuacacccaggcgugcgaccaccgucucaugucagccgcuaucaaagauaguaaggcagugcaugccgacaugggguauuggauugaaucugagaaaaaugaaacauggaagcuggcucgggccagcuucaucgagguaaagacguguauauggccaaaaucccacacccuauggucaaacggaguccuggaaagcgagauggugauccccaagauuuacggcgguccuaucucucaacauaauuaucgaccaggcuacuucacucagacagcagggccguggcaccucggaaaacuggagcuugauuuugacuugugcgaaggcaccacuguggucguugaugagcacugcgggaacagaggacccucccugaggacaaccacggugacuggcaagauuauccaugaaugguguugccgcaguuguaccuuaccuccacuccgguucaaaggugaggacgggugcugguacggaauggagauaagacccguaaaggaaaaggaggaaaaucuggugaaaagcauggucucugcgggcuccggugagguggacucauuuagucuuggccuguuguguauuagcaucaugaucgaagagguuaugaggucgcgcuggucccgaaagaugcucaugacagggacccuggccguguuccuacugcucauuaugggacagcugacuuggaacgaucuuauccgguugugcauuauggucggcgcuaaugccucugaccguauggggaugggaacaaccuaucuggcauuaauggcuacauuuaaaaugagaccuauguucgccgugggccuccuguuuaggcgccuuacuagccgggagguucugcuacucaccauaggucugucauugguggcaagugucgaacugccaaacuccuuagaggaacucggggauggacuggccaugggcaucaugauucuuaagcuguugacggacuuccaaucucaccagcucugggcuacacugcuaagccugaccuuuaucaaaacuacccuuucccuccauuacgcguggaagacaauggccaugguacugucaauugugagcuuguucccccuguguuuaaguacuaccucucagaagacgacauggcucccgguucugcuuggcucccuggggugcaaaccuuugaccauguuucucaucgcagagaauaagauauggggaagaaaaagcuggccacugaacgaagguaucauggcugugggcgucgugucgauucuacugucaucucuucucaagaacgauguaccccuggccgggccuuugaucgccggaggcauguuaauugcuuguuaugugaucagugguuccagcgcagaccugucucucgagaaagccgcggaggucagcugggaagaggaagcugagcacuccggggccucacauaauauacugguugaagugcaggaugacggaacuaugaagauuaaagaugaggagagggacgauacacuuaccauccuguugaaggcaacucuacuggccgugaguggcgucuacccccucagcaucccagcuacacuguucgugugguauuuuuggcaaaagaaaaagcagcgaucuggcguucuuugggacaccccuucacccccagaaguagagcgcgcaguguuagaugacgggauuuaccggauaaugcagagaggacugcucgguaggagccaggucggcguggggguuuuccaagaaaacguguuccacacgauguggcacgucacucguggagccguguugauguaucagggcaaacgccuggagccgaguugggcgagcguaaagaaagaccucaucuccuacggugggggauggcggcugcagggcucuuggaauaccggcgaggaaguccaggugauugcuguugagccugggaagaaccccaagaaugugcaaacagccccaggaaccuuuaaaacacccgaaggugaggucggcgcaaucgcccuugauuucaagccugggacuucgggaagcccaauugugaacagagaaggcaaaaucguuggucuguacgggaauggaguggucaccacgucaggcacauauguguccgcuauagcccaggcaaaggcuagucaggagggccccuugccugagaucgaagacgagguauuuaggaaacgaaaccuaacuauuauggaucugcauccggggucuggaaagacccggcgcuaccucccagccaucgugagagaagcgauuaagaggaaauuacggacacugauccuugcccccacccgaguugucgcaagcgagauggcugaagcccugaaggguaugccuauaagauaucaaacuaccgcugugaaauccgagcacacaggcaaggagauuguggaccucaugugccaugcaacguucacuaugcgcuugcugucaccagucaggguacccaauuacaacaugaucaucauggaugaagcccacuuuaccgacccuucuagcauugccgcucguggguauaucaguacacgggugggaaugggcgaggcggcagccauauucaugaccgcuacuccgcccgguuccguugaagccuuuccacagagcaaugcagugauucaggaugaggaaagagacaucccugagaggucuuggaacucaggguacgaguggauuacagauuuccccggaaaaaccgucugguuugugccauccaucaagaguggcaaugacauagccaacugucuccgcaagaauggcaaacgaguuauucagcugagcagaaagacguucgauacugaauaucagaaaaccaagaacaacgacugggacuacguggucaccaccgauaucucggagaugggggcuaauuuucgggcggacagggugaucgauccucgccguugccuuaaacccguaauucuaaaggacggaccagaaagagugauccuggccgguccgaugccuguuacugucgcaucugcugcccagcggaggggccgcauugggcgaaaccauaauaaggagggagaucaguacauauauaugggccagcccuugaacaaugacgaggaucacgcacacuggacagaagccaaaauguuacuggacaacaucaauaccccagaggguauuauccccgcucucuucgaaccugagagagaaaaguccgccgcgaucgauggggaguaccggcugaggggcgaggcacgcaaaacauucguggaacuuaugagaaggggagaccugccaguguggcucagcuauaaggucgccucagagggcuuucaauacagugaucggcguuggugcuucgacggggaacgcaacaaucagguuuuggaggaaaacauggauguggagauuuggacuaaagagggagaacgaaagaaacugagacccagguggcuagacgcucggacguauucugacccucuggcccuccgcgaguuuaaggaguucgcugcagguagaagguccguaagcggcgaucuuauacuggagaucgggaaguuaccgcagcauuugacccagcgggcccaaaaugcucuggacaaccucgugaugcugcacaauucagaacagggaggccgagccuacagacaugcaauggaggagcuuccagauacaauugaaacucugaugcucuuggcgcugaucgccgucuuaaccgguggggugacacuauuuuuccugaguggccgcggacucggcaaaaccagcauugggcuucuguguguuauggcuuccucuguguugcuguggauggccagcgucgagccccacuggaucgcagcuuccauaauccucgaauuuuuccugaugguacuucucauuccugagcccgacaggcagcggacuccacaggauaaccaacuggccuaugugguuaucggauugcuguuuaugauuuuaacgguggcagccaaugagaugggucuacuggaaaccacaaagaaagaccucggcaucgggcacgucgcuguggagaaccaucaccaugcgacuaugcuugaugucgaccugcacccugccucagcauggaccuuguacgcuguggccacaaccauaauuacucccaugaugcgucauacaaucgaaaacacgaccgccaauauuucucugacugcaaucgcuaaccaggccgcgauacucaugggacuggauaagggcuggccaaucaguaaaauggacauugguguuccucuuuuagcucuggggugcuacagccaggugaauccgcucacauugaccgccgcaguacugaugcuaguggcccacuaugcuaucauuggccccggacugcaagcaaaggccaccagagaggcgcagaagaggacagcugccggcaucaugaaaaacccaacugucgaugggauaguugcaauugaccucgauccuguggucuacgacgccaaguucgaaaaacagcuuggacagaucaugcuguugauccuguguacgagccaaauucuccugaugcgcaccacaugggcuuuaugcgaguccaucacucuugccaccggcccccugacaacccucugggaggguucuccagggaaguuuuggaauacuacgauagcagugucaauggcuaacauuuuccggggaagcuaucuagccggcgcgggucuggccuuuuccuugaugaaaagucugggcgggggacgaagaggcacaggggcacagggagaaacccucggcgagaaguggaagaggcagcuuaaucagcugucuaaaagcgaguucaacaucuacaagcgcucagguauuauggagguagaccgguccgaagcuaaagagggguugaagagaggagagacuacccgucacgccgugaguaggggcacagcaaaacugcggugguucguugaacgcaaucucgugaagccugaggguaaggucaucgauuuaggcugugggcgaggaggcuggagcuauuacugcgcugggcugaaaaaggugacugaagucaaaggauauaccaagggcggucccgggcaugaggaaccgauaccaauggccacauacggauggaaccuugugaaacugcacucuggcaaggacguauuuuucacgccucccgagaaaugugauacccuacucugcgacaucggcgaguccucaccaaaucccacuauugaagaggggagaacacugaggguauugaagaugguggaaccuuggcugcggggaaaccaauuuuguaucaagauucucaauccguacaugcccagcgucguggagacccuugagcagaugcagcgcaaacaugguggcaugcugguuagaaacccauuaucgagaaauucuacucacgaaauguauugggugaguugcgggacaggaaacaucgucuccgccgugaauaugaccagccgaaugcuguugaaccgguucacgauggcgcaccguaagccuaccuacgagagagauguagaccucggcgcugguacacgccauguggcaguugaacccgaggucgccaaccuggauauuaucgggcagaggauagaaaauauuaaacacgagcauaagucaacuuggcacuaugacgaggauaacccuuacaaaaccugggcuuaucauggauccuacgaagugaagccaucuggcagcgccaguuccauggugaauggcgucguuaagcuacuuacaaaacccugggacgugaucccuaugguaacucaaaucgcaaugaccgauacaaccccauuugggcagcagcggguguucaaggagaaagucgacacuagaacgcccaaggccaaacgcggaacagcucaaauuauggaagugaccgcgagguggcugugggguuuucucagccgaaacaagaagccgcggauauguacuagagaggaguucaccaggaaaguucgcucuaaugccgcaaucggcgcuguguuugucgacgagaaccaguggaacucagccaaggaggcaguggaagaugagcguuucugggaccugguacagaaagaacgggaguugcacaagcaggggaaaugcgccacaugcguuuauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguggagggggagggacugcauaaguuggguuacauccuccgggacauuucgaaaaucccuggcgggaauauguaugccgaugacacggcuggaugggauaccagaauaacugaagacgaucugcaaaacgaggccaagaucacagacauuauggaaccagagcacgcacuacuugcuaccucaaucuuuaaacugacuuaccagaauaaggucgugagggugcagcgccccgccaagaacggcacagucauggauguuauuagcagacgggaccagagggguuccgggcaagugggaaccuauggccucaauacauucacuaacauggaagcucagcugauccgucagauggagagugagggcauauuuuugccuucugaauuagagaccccaaaccuggccgaacgaguacucgauuggcuugagaaacaugggguggaacgccugaagagaauggcaauuagcggagacgacugugucgugaaacccaucgaugaccgguucgcgacggcccuaaccgcucugaaugauauggguaagguuaggaaagacaucccgcagugggagccuuccaagggcuggaacgauuggcaacaggugcccuuuugcucacaccacuuccaucagcucauuaugaaggacgggcgcgagauagucgugccauguagaaaucaggaugaauugguaggacgggccaggguuagucaaggcgcagguuggucucugcgagagacagcuugccuugggaaaagcuacgcccagauguggcagcugauguauuuucaccguagagaccuccgcuuagcagccaacgcgaucuguuccgcugugccugucgauugggugcccacuucacggaccacauggagcauucaugcccaccaucaauggaugacuaccgaagacaugcugucuguuuggaauaggguguggaucgaggaaaacccauggauggaggauaagacgcacgucuccaguuggggagacgugcccuacuugggcaaaagagaggaccaguggugcggcagccugauugggcucacagcacgcgccaccugggcuucgaauauccagguagccauaaaccaggugcggaggcuuaucggaaaugaaaacuaucuggauuacaugacuuccaugaagcgauucaaaaaugagggugacccugaaggcgcacuaugguga

SEQ ID NO: 13739 - RNA, 9879 nt, Artificial Sequence
  derived and/or modified CDS sequence (opt3) from DENV-1__FJ898375__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauggcacucuuccuggcccaugcuauuggcacaucgaucacccagaagggcauuaucuuuauacugcucauguuagugacgccaucaauggccaugcgcugcgucgggaucggaagcagagauuucguggagggucugaguggcgcgacuuggguagacguugugcuugagcacggguccugugucacaaccauggcaaaggauaaacccacuuuggacauugaacugcuaaagacagaggugaccaacccugccgugcucaggaaacugugcaucgaagcuaagauuucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugaucacuugcgcuaaguucaagugcguaaccaaacucgaggggaagacagugcaguacgaaaaccugaaauauucagucauagugaccguucacacuggagaccagcaucaaguggguaaugagaguacggaacacggcacaaccgccacuauuacaccccaggcgccuagcacagagauccaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauucaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagaucaaauacgagggcacagacgcgccuugcaagauuccauuuucuacccaggaugaaaaaggggugacucaaaacggacgccuuauaacagcaaaucccaucguaaccgacaaggagaaaccugucaacauugaagccgagccacccuucggcgaguccuauaucgugauaggugcuggggaaaaggccuugaagcugucaugguuuaaaaagggcaguagcauuggaaaaauguucgaggcaacugccagaggcgcuaggcggauggccauccucggggauaccgcaugggacuuuggauccaucgguggcguuuucacaucuguggggaagcugguccaucagauuuuuggaacggcguacggcgugcuuuucagcgguguaucauggaccaugaaaaucgggauuggcgugcuguugacuuggcucggacugaauagucgauccacuagcuuaucuaugaccuguauagcuguuggccuggucacacuauaccucggggugauggugcaggccgauucaggaugcgucaucaacuggaagggccgcgaacugaagugugguagugggauuuuuguuacuaaugaggugcacaccuggacggaacaguauaaauuccaagcagacagcccgaagagacuuuccgccgcuaucggaaaagccugggaggagggcgugugcgguaucaggucugcaacacgguuggaaaacauuauguggaagcagauaucgaacgagcugaaucauauccuccuggaaaacgacaugaaauuuaccguagucgugggcgauguugcugggauuuuagcccagggaaagaaaaugauccgcccucagcccauggaguacaaguauagcuggaaguccuggggcaaagcgaagauuaucggggccgacgugcaaaauacuaccuucauaaucgauggaccaaacacaccugaaugucccgacgaucagagagcuuggaauauuugggaggucgaggacuacggcuuugguaucuucacuaccaacauuuggcugaaacuuagggauucauauacacaggugugcgaccaccguuugaugagugcagccaucaaggauucuaaagcuguucacgccgacaugggguacuggauagaaagcgagaagaaugaaacguggaagcucgcacgggcguccuucauugaggugaaaaccuguaucuggccaaagucacauacucuguggagcaacggaguacuagaaucugagaugauuauccccaaaauauauggcgguccuaucucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaauuauccacgaaugguguugccgcagcuguacacugccuccauuacgguuuaagggugaggacgggugcugguauggaauggagauuagacccguuaaggaaaaagaggaaaaucucgugaagucuaugguauccgcuggcucaggugagguggacaguuucagccugggccuucuguguaucucgauaaugauugaagaggucaugaggucccgcuggucucgaaaaauguugaugaccgggacucucgccguguuuuuccugcuaaucaugggacagcugacauggaacgaucucauccggcugugcauuaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgaucggucuaagucucguggcuuccguugaacugccaaacucuuuggaggaacugggggauggauuagcgaugggcauuaugauacucaaacugcuuacagacuuccagagccaucaacugugggccaccuugcucucccugacuuuuaucaagaccacauucucacuacacuaugcauggaagacuauggcuauggugcugagcauugucagucuuuuuccccucugucugucuaccacgucccagaaaacaaccugguugccgguacuguuaggcagccucgggugcaagccucugacuauguuccuuaucgccgagaauaaaauuuggggaagaaagucguggccacugaacgaagguaucauggccgugggcauaguuucaaucuugcucucuagucugcucaagaacgaugugccccuggcugggccucuuauugcaggaggcaugcucaucgccuguuacgucauuuccgguagcucugcggaccugagcuuggagaaggcugccgagguguccugggaagaggaagcagagcauucaggggccagucacaauaucuuaguagaagugcaggaugacggaacaaugaaaauaaaggaugaggagagggacgauacccugacuauucuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggaucuaucggauuaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucauaucuuacggugggggauggcgguugcagggcucguggaauacaggcgaggaaguccaggugaucgcaguagagccugggaagaaccccaaaaauguccagaccgccccaggaacauucaagacuagcgaaggugaggugggcgcuauugcccuggauuuuaaacccgggaccucaggauccccuaucguuaacagagaaggcaagauugugggucucuaugggaauggagucgugacgacaaguggcacuuacguuucugcaaucgcucaagccaaagcgagccaggagggcccacugcccgagauagaagacgagguguucaggaagcgaaaccuuaccaucauggaucugcacccuggguccggaaagacacggcgcuauuugccggccauugucagagaagcaaucaaaaggaagcuacggacccugauucucgcuccaacucgagugguagccucagagauggcugaagcauuaaaagguaugcccaucagauaccagaccacagccgugaagucugagcauacgggcaaagagauaguugaccugaugugccacgccacuuuuaccaugcgccuucugagcccugucagggugccaaauuauaacaugauuaucauggaugaagcucauuucacagaccccaguuccaucgcggcacguggguacauuagcacccgggugggaaugggcgaggccgcugccaucuuuaugacugcaacaccuccggguucugucgaagccuucccccaaucaaaugcuguaauacaggaugaggaaagagacauuccagagagguccuggaacaguggguaugaguggaucaccgauuuuccuggaaagacggugugguucguucccagcauuaagucgggcaaugacaucgcgaacugucuccgcaaaaauggcaagcgagugauacaguugucuagaaaaacuuucgauacagaauaccagaagaccaaaaacaacgacugggacuacgucgugaccacugauauuuccgagaugggggccaauuuucgggcagacaggguuaucgauccacgccguugccugaagccugugauccucaaggacggacccgaaagagucauucuggcugguccaaugccggugacaguagccagcgcagcccaacggaggggccgcaucgggcgaaaccacaauaaagagggagaucaguauauuuacaugggccagccucuuaacaaugacgaggaucaugcucacuggaccgaagccaagaugcuacuggacaacauaaauacacccgaggguaucauuccagcguuguucgaacccgagagagaaaaaucagcagccaucgauggggaguaucgguuaaggggcgaggcucgcaagacuuuuguggaacugaugagaaggggagaccucccuguuuggcugagucacaaagucgccucugagggcuuccaguacuccgaucggcguuggugcuuugacggggaacgcaacaaucaagugcuugaggaaaacauggauguggagaucuggacgaaggagggagaacgaaagaaacugagaccaagguggcucgacgcucggaccuauagcgaccccuuggcacugcgcgaguucaaagaauuugccgcugguagaaggucagucaguggcgaucuaauucuggagauagggaaacucccucagcaucuuacacagcgggcccagaaugcacuggacaacuuaguuauguugcacaauagcgaacaaggaggccgagcguacagacaugccauggaggagcugccggauacuaucgaaacccucaugcugcuugcucugauugccgugcucacaggugggguaaccuuguucuuucuguccggccgcggauuaggcaagacuucuaucgggcuacugugugugauggcaagcuccguccuccuuuggauggcuucaguggagccacacuggauugccgcaucuaucauacuggaguucuuuuugaugguucugcucauccccgagccugacaggcagcggacgccccaggauaaccagcuggccuauguggucauuggacuucucuucaugauccugaccguagcugcgaaugagauggguuugcuggaaacaacuaaaaaggacuuaggcauugggcacguggccguugagaaacaucaccaugcagcuaugcuagauguggaccugcacccagccagugccuggacccucuacgcagucgcuacaaccaucauaacuccuaugaugcgucauacaauugaaaacacgaccgccaacaucucgcuuacugcgauugcuaaucaagccgcaauccugaugggauuggauaagggcuggcccauaagcaagauggacaucggugugccacugcucgcccuggggugcuacucccaggucaacccucuuacauuaaccgcugcagugcugaugcucguugcccacuaugcgauuaucggcccgggauugcaggcuaaagccaccagagaggcacaaaagaggacagccgcuggcauuaugaaaaaucccacuguggaugggaucguagccauagaccuggauccaguggucuacgacgcaaaguuugaaaaacagcuaggacagauuaugcugcucauccuuuguacgucucagauccuguugaugcgcaccacaugggcucugugcgagucaauuacucucgccaccggcccucugacaaccuuaugggaggguagccccgggaaguucuggaacacuacgaucgcgguuuccauggccaauauauuccggggaaguuaucuugcaggcgcuggucuggccuuuucucucaugaaaagccuaggcgggggacgaagaggcacaggggcacaaggagaaacccugggcgagaaauggaagaggcaguugaaccagcugucaaaauccgaguucaauacuuacaagcgcagugguauuauggagguggaccggagcgaagcuaaagaggggcucaagagaggagagaccacaaagcacgccgucucucguggcacugccaaacuuaggugguuuguggaacggaaccugguaaagccagaggguaaagugaucgauuugggcugugggcgcggaggcugguccuauuacugcgcggggcugaagaaaguuaccgaagugaagggauauacaaaaggcgguccugggcaugaggaacccauuccgauggcuacguacggauggaaucucgucaaguuacacucaggcaaggacguguucuuuaucccaccugagaaaugugauacccugcuuugcgacauaggcgagagcucgcccaacccaacuaucgaagaggggcgaacacugagaguccuaaagaugguggaacccuggcucaggggaaaucaguucuguauuaaaauccugaacccuuacaugccgucuguuguagagaccuuggagcaaaugcagcggaagcaugguggcaugcuggugcgcaauccccucaguagaaacuccacucacgaaauguauugggucagcugcgggacaggaaauauugugucagcaguuaacaugaccuccaggaugcuucugaaucgauuuacgauggcccaccggaaaccaaccuacgagcgugauguggacuuaggcgcugguacaagacaugucgccguggaaccugagguagcaaaccuggauaucauugggcagcgcaucgaaaacauaaagcacgagcauaagucuacuuggcacuaugacgaggauaaucccuacaaaaccugggccuaucauggaagcuacgaagugaagccuaguggcuccgcuagcucuaugguuaacggcgucgugaaauugcucacaaagccaugggacgugauucccauggucacucagaucgcgaugaccgauacaaccccuuucgggcaacagaggguuuuuaaagagaagguggacacucggacgccaaaggccaaaagaggaacagcacagaucauggaaguaaccgcuaaguggcugugggguuuccuaucacgcaauaaaaagcccaggauuuguacucgagaggaauuuacccggaaagugagaaguaacgccgcaauaggcgccgucuucguggacgagaaucaauggaacuccgcuaaggaggccguugaagaugagagguuuugggaccuugugcaccgcgaacgugagcugcacaagcaggggaaaugcgcgacaugcgucuauaauaugaugggaaagcgggagaagaagcucggcgaguucgguaaagcaaaggggagcagagccaucugguacauguggcugggagcuagguucuuggaguuugaagcccugggcuucaugaacgaggaucauugguuuucucgcgaaaauucgcucucaggcguggagggggagggacuucacaaacuggguuacauuuuacgagacaucagcaagauuccgggcgggaacauguaugcagaugacacggcuggaugggauacccggaucacugaagacgaucugcagaaugaggccaagauaacagacaucauggaaccugagcaugcuuugcucgccaaauccauuuucaagcugaccuaccagaacaaaguaguuagagugcaaaggccagcaaagaauggcacugucauggaugugaucagucgcagagaccagcgggguucuggacaggugggaacauauggccuaaacaccuuuacaaauauggaagcgcagcuuauuaggcaaauggagagcgagggcaucuucucccccucagaacuggagacuccuaaccucgccgggcguguccuggauugguuggaaaaacacggaguugagcgauuaaagcgcauggcuauaaguggugacgacugugugguaaagccaauugaugacagauuugccaccgcacugacggcucucaacgauaugggcaaagugcggaaggacaucccccagugggaaccgucuaaaggguggaaugauuggcagcaggucccuuucugcagccaccauuuucaccaacuuaucaugaaggacggaagggagauugugguucccugucgcaaccaggaugagcuggugggcagagcccgggucucccagggugcaggguggucacuaagggaaaccgccugccugggaaaaagcuacgcgcagauguggcaacucauguauuuccaucgacgugacuugagacuggcugccaaugcaauauguucugccgugccaguagauuggguuccuacaucccgcacuaccuggaguauccacgcucaucaccaguggaugacaacugaggacaugcuuagcguguggaaccgggucuggauugaagagaaucccuggauggaagauaagacccacaucucguccuggggcgacgugccauaccugggcaagagggaggaccaguggugcgggucucucauuggauuaacggccagagcaacaugggcuaccaacauccaaguugccauaaaucaggugcgccggcugaucgguaacgagaauuauuuggauuacaugacuucaaugaaaagguuuaagaacgaaagcgaccccgagggcgcgcugugguga

SEQ ID NO: 13740 - RNA, 9879 nt, Artificial Sequence
  derived and/or modified CDS sequence (opt3) from DENV-1__FJ898376__SS-prME
agcgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugugaucggcaccucuauuacgcagaagggcaucauauucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuacaccccaggccccuacaagugagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacugguagcuucaaacuggagaaggaagucgccgagacccagcacggaacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauagggaucggcguguugcucacuuggcugggauuaaauucacgaaguacaucccugagcaugaccuguauugcgguuggccuagucacacucuaccugggggugauggugcaggcugauucuggaugcgucaucaacuggaaaggccgcgaacuuaagugugguucagggaucuucguuacuaaugaggugcacaccuggacggaacaauauaaguuucaggccgacaguccgaaaagauugagcgcagccauuggaaaggcuugggaggagggcgugugcgguauaagguccgccacacggcuggaaaacaucauguggaaacagauuucuaacgagcucaaucauauccuguuagaaaacgacaugaaguucaccguagucgugggcgauguuguggggauucuggcacagggcaaaaagaugauccgcccucaacccauggagcacaaauacucguggaaaagcuggggcaaggcuaagauaaucggggccgacguccagaauacuaccuuuauuaucgauggaccaaacacaccugaaugucccgacgaucagagagcguggaauauuugggagguggaggacuauggcuucgguaucuuuacuaccaacauauggcuuaaguugagggauucccacacacagguuugcgaccaucgucucaugucagccgcuauuaaagauaguaaggcagugcacgccgacaugggguacuggaucgaaucugagaaaaaugaaacguggaagcuggcucgggccagcuucauugagguaaagaccuguaucuggccaaaaucccauacucuauggucaaacggaguccuggaaagcgagaugauaauccccaagauuuauggcgguccuaucucucaacacaauuaccgaccaggcuauuucacacagaccgcagggccguggcaccucggaaaacuggagcuugauuuugacuugugcgaaggcacuacagugguggucgaugagcauugcgggaacagaggacccucccugaggaccacgacuguuaccggcaagauuauccacgaaugguguugccgcaguuguacauuaccuccacuccgguucaaaggugaggacgggugcugguacggaauggagauaagacccgugaaggaaaaggaggaaaaucugguaaaaagcauggugucugcgggcuccggugaggucgacucauuuagucuuggccuguuguguauuagcaucaugaucgaagaggugaugaggucgcgcuggucccgaaagaugcucaugaccgggacucuggccguuuuccuacugcucauuaugggacagcugacauggaacgaucuuauccgguugugcauuauggugggcgcuaaugccucugaccguauggggaugggaaccacauaccuggcauuaauggcuacuuuuaaaaugagaccuauguucgccgucggccuccuguuuaggcgccuuaccagccgggaggugcugcuacucacgauaggucugucauugguugcaaguguggaacugccaaacuccuuagaggaacucggggauggacuggccaugggcaucaugauucuuaagcuguugacagacuuccaaucucaucagcucugggcuacccugcuaagccugacuuuuaucaaaaccacacuuucccuccacuaugcguggaagacuauggccaugguccugucaauuguauccuuguucccccuguguuuaaguaccacgucucagaagacaaccuggcucccggugcugcuuggcucccuggggugcaaaccuuuggcaauguuucucaucgcugagaauaagauauggggaagaaaaagcuggccacugaacgaagguaucauggccguuggcguggucucgauucuacugucaucucuucucaagaacgaugugccccuggccgggccuuugaucgcuggaggcauguuaauugcauguuacguaaucagugguuccagcgccgaccugucucucgagaaagcggcugaggugagcugggaagaggaagccgagcauuccggggcaucacacaauauacuggucgaaguucaggaugacggaacuaugaagauuaaagaugaggagagggacgauacacuuaccauccuguugaaggccacucuacuggcugugaguggcguguauccccucagcaucccagcaacacuguucgucugguacuuuuggcaaaagaaaaagcagcgaucuggcgugcuuugggacaccccuucacccccagaaguugagcgcgccguauuagaugacgggauuuaucggauaaugcagagaggacugcucgguaggagccaggugggcgucgggguguuccaagaaaacguuuuccacacgauguggcaugugacucguggagcggucuugauguaccagggcaaacgccuggagccgaguugggcuagcgugaagaaagaccucaucuccuauggugggggauggcggcugcagggcucuuggaauaccggcgaggaaguacaggucauugccguggagccugggaagaaccccaagaauguucaaacagcaccaggaaccuuuaaaacacccgaaggugaggugggcgccaucgcucuugauuucaagccugggacuucgggaagcccaauugucaacagagaaggcaaaaucgugggucuguacgggaauggaguugugaccacgucaggcacauacgucuccgccauagcacaggcuaaggccagucaggagggccccuugccugagaucgaagacgagguguuuaggaaacgaaaccuaacuauuauggaucugcacccggggucuggaaagacccggcgcuaucucccagcgaucguaagagaagccauuaagaggaaauuacggacacugauccuugcacccacccgagugguugcuagcgagauggccgaagcucugaaggguaugccuauaagauaccaaacuaccgcagucaaauccgagcauacaggcaaggagauuguggaccucaugugccacgccacguucacuaugcgcuugcugucaccagugaggguccccaauuauaacaugaucaucauggaugaagcccauuuuaccgacccuucuagcauugcugcgcguggguacaucaguacacggguaggaaugggcgaggcagccgcuauauucaugaccgccacuccgcccgguuccguggaagcauuuccacagagcaaugccguuauucaggaugaggaaagagacaucccugagaggucuuggaacucaggguaugaguggauuacagauuuccccggaaaaaccgugugguuugucccauccaucaagaguggcaaugacauagcuaacugucuccgcaagaauggcaaacgagugauucagcugagcagaaagacguucgauacugaauaccagaaaaccaagaacaacgacugggacuauguugugaccaccgauaucucggagaugggggcgaauuuucgggccgacagggucaucgauccucgccguugccuuaaacccgugauucuaaaggacggaccagaaagaguaauccuggcagguccgaugccugugacuguugcuucugccgcacagcggaggggccgcauugggcgaaaccacaauaaggagggagaucaguacauauacaugggccagcccuugaacaaugacgaggaucacgcccauuggacagaagcuaaaauguuacuggacaacaucaauaccccagaggguauuauccccgcccucuucgaaccugagagagaaaaguccgcggcaaucgauggggaguaucggcugaggggcgaggcccgcaaaacauucgucgaacuuaugagaaggggagaccugccaguguggcucagcuacaagguggcuucagagggcuuucaauauagugaucggcguuggugcuucgacggggaacgcaacaaucaggucuuggaggaaaacauggauguugagauuuggacuaaagagggagaacgaaagaaacugagacccagguggcuagacgcccggacguacucugacccucuggcucuccgcgaguuuaaggaguucgcagccgguagaagguccgugagcggcgaucuuauacuggagaucgggaaguuaccgcagcacuugacccagcgggcucaaaaugcccuggacaaccucguaaugcugcauaauucagaacagggaggccgagcauauagacacgcgauggaggagcuuccagauacaauugaaacucugaugcucuuggcccugaucgcuguguuaaccgguggggucacacuauuuuuccugaguggccgcggacucggcaaaaccagcauugggcuucugugugugauggccuccucuguuuugcuguggauggcaagcguggagccccacuggaucgcugccuccauaauccucgaauuuuuccugaugguccuucucauuccugagcccgacaggcagcggacuccacaggauaaccaacuggcauacguagugaucggauugcuguuuaugauuuuaacgguugccgcuaaugagaugggucuacuggaaaccacaaagaaagaccucggcaucgggcauguggcggucgagaaccaccaucacgccacuaugcuugauguggaccugcauccugcaucagcuuggaccuuguaugccgucgccacaaccauaauuacucccaugaugcgucacacaaucgaaaacacgaccgcaaauauuucucugacugcuaucgccaaccaggcggcuauacucaugggacuggauaagggcuggccaaucaguaaaauggacauuggugugccucuuuuagcccuggggugcuacucgcagguuaauccgcucacauugaccgcagccgugcugaugcuaguagcucacuacgcaaucauuggccccggacugcaagccaaggcgaccagagaggcucagaagaggacagccgcaggcaucaugaaaaacccaacuguggaugggauagucgccauugaccucgauccuguuguguaugacgcuaaguucgaaaaacagcuuggacagaucaugcuguugauccuguguacgagccaaauucuccugaugcgcaccacaugggccuuaugcgaguccaucacucuugcaaccggcccccugacaacccucugggaggguucuccagggaaguuuuggaauacuacgauagcugucucaauggccaacauuuuccggggaagcuaccuagcgggcgccggucuggcauuuuccuugaugaaaagucugggcgggggacgaagaggcacaggggcucagggagaaacccucggcgagaaguggaagaggcagcuuaaucagcugucuaaaagcgaguucaacaucuauaagcgcucagguauuauggagguggaccgguccgaagccaaagagggguugaagagaggagagacuacccgucaugcaguaaguaggggcacagcuaaacugcggugguucguggaacgcaaucucguuaagccugaggguaaggugaucgauuuaggcugugggcgaggaggcuggagcuacuauugcgccgggcugaaaaaggucacugaagugaaaggauacaccaagggcggucccgggcacgaggaaccgauaccaauggccacauauggauggaaccuugucaaacugcauucuggcaaggacguguuuuucacgccucccgagaaaugugauacccuacucugcgacaucggcgaguccucaccaaaucccacuauugaagaggggagaacacugaggguuuugaagaugguagaaccuuggcugcggggaaaccaauuuuguaucaagauucucaauccguacaugcccagcguggucgagacccuugagcagaugcagcgcaaacacgguggcaugcuggugagaaacccauuaucgagaaauucuacucacgaaauguacuggguuaguugcgggacaggaaacaucguguccgcggucaauaugaccagccgaaugcuguugaaccgguucacgauggcucaucguaagccuaccuaugagagagauguggaccucggcgcagguacacgccacguagccguggaacccgagguugcuaaccuggauauuaucgggcagaggauagaaaauauuaaacaugagcacaagucaacuuggcauuacgacgaggauaacccuuauaaaaccugggccuaccacggauccuaugaagucaagccaucuggcagcgcaaguuccauggugaauggcguggucaagcuacuuacaaaacccugggacguuaucccuauggugacucaaaucgccaugaccgauacaaccccauuugggcagcagcggguauucaaggagaaaguggacacuagaacgcccaaggcuaaacgcggaacagcgcaaauuauggaagucaccgccagguggcugugggguuuucucagccgaaacaagaagccgcggauauguacuagagaggaguucaccaggaaagugcgcucuaaugcagcuaucggcgccguuuuuguggacgagaaccaguggaacucagcaaaggaggccgucgaagaugagcguuucugggaccuggugcagaaagaacgggaguugcacaagcaggggaaaugcgcuacaugcguauacaacaugaugggaaagagagaaaagaaacugggcgaguuugguaaggccaaagggaguagggcgauuugguauauguggcucggagcacgcuuccuugaguuugaagcccugggcuucaugaaugaggaucauugguucucccgagaaaacagcuuaucuggcguugagggggagggacugcacaaguuggguuacauccuccgggacauuucgaaaaucccuggcgggaauauguacgcugaugacacggccggaugggauaccagaauaacugaagacgaucugcaaaacgaggcaaagaucacagacauuauggaaccagagcaugcucuacuugccaccucaaucuuuaaacugacuuaucagaauaagguggucagggugcagcgccccgcuaagaacggcacagugauggaugucauuagcagacgggaccagagggguuccgggcaaguuggaaccuacggccucaauacauucacuaacauggaagcccagcugauccgucagauggagagugagggcauauuuuugccuucugaauuagagacccagaaccuggcagaacgagugcucgauuggcuugagaaauaugggguagaacgccugaagagaauggcgauuagcggagacgacuguguggucaaaccaaucgaugaccgguucgccacggcucuaaccgcccugaaugauauggguaaggugaggaaagacaucccccaaugggagccguccaagggcuggaacgauuggcagcagguuccuuuuugcucacaccacuuccaucagcucauuaugaaggacgggcgcgagauagugguccccuguagaaaucaagaugaauuggugggacgggcaaggguaagucagggcgcugguuggucucugcgagagacagccugccuugggaaaagcuacgcacagauguggcaacugauguauuuucaccguagagaccuccgcuuagccgcgaacgcuaauuguuccgccguuccaguggauugggucccuacuucacggaccacauggagcauccaugcacaccaucaguggaugacuaccgaagacaugcugucuguguggaacaggguuuggauugaggaaaaucccuggauggaggauaagacgcacguguccaguuggggagacgucccauacuugggcaaaagagaggaccaguggugcggcagccugaucgggcucacagcccgcgcuaccugggccucgaacauucagguggcaaucaaucaaguacggaggcuuauaggaaacgaaaauuaucuggauuacaugacuuccaugaagcgauucaaaaacgagggugaccccgaaggcgcucuaugguga

SEQ ID NO: 13741 - RNA, 9879 nt, Artificial Sequence
  derived and/or modified CDS sequence (opt3) from DENV-1__FJ898379__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaagacgcuaacuucgugugccgccgaacuuuuguagauagaggcugggguaauggguguggauuguucggcaaaggcucccucauaaccugcgccaaguuuaagugcgugacaaaacuggaggggaagauuguccaguacgaaaacuuaaaauauucagugaucguuaccgugcacacuggagaccagcaucaagucgguaaugagaguacggaacacggcacaaccgcaacuauuacaccccaagcuccuaccaccgagauccagcugacugacuacggggcccucacacuugauuguagcccaaggacgggacuggacuucaacgaaaugguguugcuaaccaugaaggagaaaucuuggcugguacauaagcagugguuucucgaucugccgcuucccuggacuuccggcgcgucaacaagccaagagaccuggaaucggcaggaccuguugguuacauucaaaacugcccacgcaaagaagcaggaaguggucgugcucgguagucaagagggggcuaugcacaccgcccugacgggcgcuaccgaaauccagacaucuggaacuaccacaauuuuugccggccauuuaaaaugccgucugaagauggauaaacuaacucucaaggggauguccuaugucauguguaccgggagcuucaaacuggagaaggaaguggcagagacgcagcacgguacaguucuugugcagauaaaguacgagggcaccgacgccccuugcaaaaucccauucucgacucaagaugaaaaggggguaacacagaacggacgcuugauuaccgcuaaucccaucgucacugacaaagagaagccugugaacauagaagcggagccacccuuuggcgagucuuauauuaucaucggugcaggggaaaaagcccugaagcucuccugguucaagaaaggcucaaguauuggaaagauguuugaggcuaccgccagaggcgcaaggcggauggccauccugggggauacagcuugggacuucggaagcauugguggcguuuuuacguccguggggaaacuuguccaucagauauucggaaccgccuacggcgugcuguuuucugguguaagcuggacuaugaagaucgggauuggcguguugcucacauggcugggauuaaauucacgaaguaccucccugagcaugacauguaucgcaguuggccuagucacucucuaccugggggugauggugcaggcggauucuggaugcgucaucaacuggaaaggccgcgaacuuaagugugguucagggauuuucguuaccaaugaggugcacacguggacagaacaauauaaguuucaggcugacaguccgaaaagauugagcgccgcaauaggaaaggccugggaggagggcgugugcgguaucagguccgcuacccggcuggaaaacauuauguggaaacagaucucuaacgagcucaaucauauucuguuagaaaacgacaugaaguucacuguagucgugggcgauguugccgggauccuggcacagggcaaaaagaugauacgcccucaacccauggaguacaaauauucguggaaaagcuggggcaaggcuaagaucauuggggccgacgugcagaauaccacauuuaucauugauggaccaaacacuccugaaugucccgacgaucagagagcguggaauaucugggaggucgaggacuacggcuucgguauauuuaccacaaacauuuggcuuaaguugagggauuccuauacacaggugugcgaccaccgucucaugucagccgcuaucaaagauaguaaggcaguucacgccgacaugggguacuggauugaaucugagaaaaaugaaaccuggaagcuggcucgggccagcuucaucgaggugaagacuuguauauggccaaaaucccauacacuauggucaaacggaguacuggaaagcgagaugaucauucccaagaucuauggcgguccuauuucucaacacaauuaccgaccaggcuacuucacccagacugcagggccguggcaucucggaaaacuggagcuugauuuugacuugugcgaaggcacaaccgucgugguggaugagcacugcgggaacagaggacccucccugaggacgacuaccgucacaggcaagaucauacacgaaugguguugccgcaguuguaccuuaccuccacuccgguucagaggugaggacgggugcugguauggaauggagauuaggcccguuaaagaaaaggaggaaaaucuggugaaguccaugguaucugcgggcuccggugagguggacucauuuagucuuggccuguuguguaucagcaucaugauugaagaggucaugcgcucgcgauggucccggaaaaugcucaugacugggacacuggccguguucuuucuacugaucaugggacagcucaccuggaacgaucugauucgucuuugcauaaugguuggcgcuaaugccucugacagaauggggaugggaacaacuuacuuggcacugauggcuaccuucaagaugaggccuauguuugccgugggcuuacucuuccgccggcugacgagcagagagguccuucugcuaacaaucggucucucacugguggcaaguguugaauugccaaacucccuggaggaauuaggggauggacucgccaugggcauuaugauccugaaacuucugaccgacuuucaaucucaucaguugugggcuacucuccugagccuaaccuucauuaagacaacuuuuucccugcacuaugcguggaaaaccauggccauggugcuuucaaucgucagccucuucccccuguguuugaguacgacaucucagaagaccacuuggcugccgguauuacucggcucccuggggugcaagccucuuacaauguuucugauagcagagaauaaaaucuggggaaggcgaagcuggccauugaacgaagguauuauggcugugggcaucguuucgauucuccugucaucucuacugaagaacgaugugccccuugccgggccucucaucgccggaggcaugcugauagcuuguuacgucauuagugguuccagcgcagacuugucuuuagagaaagccgcggaggugagcugggaagaggaagcugagcauuccggggccucacacaauauccugguagaagugcaggaugacggaaccaugaagaucaaagaugaggagcgcgacgauacucucacaauucugcuuaaggcaacccuguuggccgucaguggcguuuauccccuaagcauaccagcuacgcuguucgugugguacuucuggcagaaaaagaagcagcggucuggcgugcucugggacacuccuucacccccagaagucgagagagcagugcuggaugacgggaucuauaggauuaugcagcguggacuuuuaggucgcagccagguuggcguagggguguuucaagaaaacgucuuccauaccauguggcacgugacacggggagccguucugauguaccagggcaaaagacucgagccgaguugggcgagcgugaagaaagacuugaucuccuacggugggggauggaggcugcagggcucuuggaauaccggcgaggaaguccaggugauugcuguagagccugggaagaaccccaaaaauguccaaacagccccaggaacuuuuaagacccccgaaggugaggugggcgcaaucgcccucgauuucaagccugggacgucgggaagcccaauaguuaaccgagaaggcaaaaucgugggucuguaugggaauggagucgugacaacuucaggcaccuacguuuccgcuauugcccaggcaaaggcuagucaggagggcccccuuccugagaucgaagacgagguguuucggaaacgcaaccugacaauuauggauuugcacccggggucuggaaagaccagaagguaucuaccagccaucguccgggaagcgauaaaacgaaagcugagaacucucauuuuagcccccacccgcgugguagcaagcgagauggcugaagcccugaaggguaugccuaucagguaccaaacaacggcugugaaauccgagcauacuggcaaggagaucguugaccuuaugugccacgcaaccuucacaaugcgucugcucucaccaguccgggugcccaauuauaacaugauuaucauggaugaagcccauuuuaccgacccuucuagcauagccgcuagaggguacauuaguacuagggugggaaugggcgaggcggcagccaucuucaugacagcuaccccgcccgguuccgucgaagccuuuccacagagcaaugcaguaauucaggaugaggaacgcgacaucccugagcgaucuuggaacucaggguaugaguggauaacggauuuccccggaaaaacugugugguuuguuccauccauuaagaguggcaaugacaucgccaacuguuugaggaaaaauggcaagcgggugauccagcugagcaggaagacauucgauaccgaauaccagaaaaccaagaacaacgacugggacuacgucgugacuacagauauuucggagaugggggcuaauuuccgcgcggaccguguuaucgauccuagacggugccucaaacccgugauucugaaggacggaccagaaagggucauacuugccgguccgaugccugugaccguagcaucugcugcccagcgccgaggcagaaucgggcggaaccacaauaaagagggagaucaguauauuuacaugggccagccccuaaacaaugacgaggaucaugcacacuggacagaagccaagaugcuguuggacaacaucaauacuccagaggguaucauucccgcuuuauuugaaccugagagggaaaaguccgccgcgauagauggggaguaucgccugagaggcgaggcaaggaaaacguucguggaacucaugcggcguggagaccugccaguuuggcuuagcuacaaggucgccucagagggcuuucaauauagugaucgccgauggugcuucgacggggaaagaaacaaucaggugcuggaggaaaacauggauguggagaucuggaccaaagagggagaaaggaagaaacuccggccccgcugguuggacgcuagaacauacucugacccucuggcccuaagggaguuuaaggaguucgcugcaggucggcgauccgucagcggcgaucugauucucgagaucgggaaacuuccgcagcaccugacucagagagcccaaaaugcuuuagacaacuugguuaugcugcauaauucagaacagggaggccgcgccuauaggcacgcaauggaggagcucccagauaccauugaaacacugaugcuucuggcgcucaucgccguguugaccggugggguaacucuguuuuucuuaaguggccggggacuaggcaagacgagcauagggcugcucugugugauggcuuccucuguccuucuguggauggccagcguggagccccauuggaucgcagcuuccauuaucuuggaauuuuuccugaugguucuccugauuccugagcccgaccgucagagaaccccacaggauaaccaacuugccuacguggucaucggacuccuguuuaugauauugacaguagcagccaaugagaugggucuguuagaaacuaccaagaaagaccuaggcauugggcacguggcuguugagaaccaccaucacgcggccaugcuggauguggaccuccauccugcaucagcuuggacacuuuacgccgucgccaccacuaucauuacacccaugaugaggcacacgaucgaaaacaccacugcaaauauaucucugacagcuaucgccaaccaggcggcuauuuugaugggacuggauaagggcuggccaaucaguaaaauggacauuggugugccucuccuggcccuugggugcuauucgcaggucaauccguuaacccugaccgcagccgugcucauguugguugcucauuacgcaaucauaggccccggacugcaagccaaggcgacacgcgaggcucagaaacggacugccgcaggcauuaugaagaacccaacgguggaugggaucguagccaucgaccuagauccuguggucuaugacgcuaaguucgaaaaacagcugggacagauuaugcuccuuauccuguguaccagccaaauauugcugaugcgaacaacuugggcccucugcgaguccauuacccuggcaacaggccccuuaaccacucuuugggaggguucuccagggaaguuuuggaauacgacaaucgcuguuucaauggccaacauuuucagaggaagcuaccuggcgggcgccggucucgcauucucccuaaugaaaagucugggcgggggaaggcgcggcaccggggcucagggagaaacuuugggcgagaaguggaaacggcagcugaaucagcucucuaagagcgaauuuaacaccuauaagagaucagguaucauggagguggaccguuccgaagccaaagaggggcuuaagaggggagagacaacuaaacacgcagucagucggggcaccgcuaagcugcgcugguucguggaacgaaauuugguaaaaccugaggguaaggugauagaucugggcugugggagaggaggcuggagcuacuauugcgccgggcucaagaaaguuacagaagugaagggauacacgaaaggcggucccgggcacgaggaaccgaucccaauggccaccuacggauggaacuuagucaagcugcauucuggcaaagacguguuuuucauuccucccgagaagugugauacucuucugugcgacaucggcgaguccucaccaaaucccacaauugaagaggggaggacccuacggguccucaaaaugguggaaccuuggcugcgcggaaaccaauuuuguaucaagauuuugaauccguauaugcccagcguuguagagacucuggagcagaugcagagaaagcacgguggcaugcucgugaggaacccacuuucgcgaaauucuacacaugaaauguacugggucaguugcgggaccggaaacaucguguccgcgguuaauaugacgagccggaugcuguuaaaccguuucaccauggcucacagaaaaccuacauaugagcgcgauguggaccugggcgcagguacuaggcacgucgccguggaacccgagguagcuaacuuggauauaauugggcagcggaucgaaaauaucaagcaugagcacaaaucaaccuggcauuacgacgaggauaacccuuauaagacaugggccuaccacggauccuaugaagugaaaccaucuggcagcgcaaguuccaugguuaauggcgucgugaagcuccugacuaagcccugggacgugauuccuauggucacccaaauagccaugacagauaccacuccauuugggcagcagagaguuuucaaagagaagguggacacgcgcacacccaaagcuaagaggggaaccgcgcaaaucauggaaguaacugccaaauggcuaugggguuuucuuagccgaaacaagaagccgcggauuuguaccagagaggaguucacaaggaaagugcgcucuaaugcagcuaucggcgccgucuuuguggacgagaaccaguggaacucagcaaaggaggccguugaagaugagcguuucugggaccuggugcaucgggaaagagagcuccacaaacaggggaagugcgcuacgugcgucuacaacaugaugggaaaaagggaaaagaagcugggcgaguuugguaaagccaaggggagucgcgcgauuugguacaugugguugggagcacgauuccuggaguucgaagcccucggcuuuaugaaugaggaucacugguucucccgggaaaacagccuuucuggcguggagggggagggacugcauaaauuagguuauauccugagagacauaucgaagaucccuggcgggaauauguacgcugaugacaccgccggaugggauacuaggauuacagaagacgauuugcagaacgaggcacgcaucaccgacauuauggaaccagagcacgcucuccuggccaaaucaaucuuuaagcuaacuuaucaaaauaaaguaguuagagugcagcggcccgcuaagaacggcacagucauggaugugauaagcaggcgugaccagcgagguuccggacaggugggaaccuacggccuuaauacauucacuaacauggaagcccaacugauucgccagauggagagugagggcaucuuuucuccuagcgaacucgagaccccaaaccuggcagaaagagucuuggauugguuagagaaguaugggguugaacggcugaaaaggauggcgaucuccggagacgacugugugguaaagcccauugaugaccgcuucgccacggcucucaccgcccuuaaugauauggguaaagugagaaaggacauaccgcagugggagccuucaaaaggcuggaacgauuggcagcaaguccccuuuugcagucaucacuuccaccagcugaucaugaaggacgggcgggagauugugguuccauguaggaaucaggaugagcuagugggacgagcacgugucucucagggcgcugguuggagccugagagagacagccugccucgggaaguccuacgcacaaauguggcaguugauguauuuucaucgccgggaccugaggcuugccgcgaacgcuaucuguucagccgugccuguagauuggauucccacuagcagaaccacauggucuauccacgcacaucaccaguggaugacuaccgaagacaugcuguccguuuggaaucgcguguggauagaggaaaacccauggauggaggauaaaacgcauaucaguagcuggggagacguccccuaccucggcaagcgggaggaccaauggugcggcucguuaauugggcugacagccagggcuaccugggccacuaauauccagguggcaauuaaccagguucgaagauugaucggaaaugaaaacuaccuggauuauaugacauccaugaaacgguucaagaaugagucugacccugaaggugcucucugguga

SEQ ID NO: 13742 - RNA, 9879 nt, Artificial Sequence
  derived and/or modified CDS sequence (opt3) from DENV-1__GQ199773__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucaccgugacuguucacacgggagaccagcaucaaguggguaaugagaguacagaacacggcaccacugccaccauuacaccccaggcgccuagcaccgagauccaguuaacugacuacggggcccugacacucgauuguucuccaaggacgggacuugacuuuaacgaaaugguccuguugaccaugaaggagaaauccuggcuagugcauaagcagugguuccuggaucucccgcugcccuggacuucaggcgcaagcacaagucaagagaccuggaaucggaaagaccuucugguaacauuuaagacugcucacgccaagaaacaggaaguuguggucuuggguucucaggagggggcuaugcacaccgcccucacgggcgcaaccgaaauucaaacauccggaacuaccacaaucuucgccggccaucugaagugccguuuaaaaauggauaagcugacucuaaaagggaugagcuaugugauguguaccggaucguucaagcucgagaaggaagucgcugagacgcagcacgguacagugcugguucagaucaaauacgagggcaccgacgcgccuugcaagauuccauuuucuacucaggaugaaaaaggggugacacaaaacggacgccuuauaaccgcaaaucccaucguaacugacaaggagaaaccugucaacauugaagccgagccacccuucggcgaguccuauaucgugauaggugcuggggaaaaggccuugaagcugucaugguuuaaaaagggcaguagcauuggaaaaauguucgaggcaaccgccagaggcgcuaggcggauggccauccucggggauacagcaugggacuuuggauccaucgguggcguuuucacgucuguggggaagcugguccaucagauuuuuggaaccgcguacggcgugcuuuucagcgguguaucauggacuaugaaaaucgggauuggcgugcuguugacauggcucggacugaauagucgauccaccagcuuaucuaugacauguauagcuguuggccuggucacucuauaccucggggugauggugcaggccgauucaggaugcgucaucaacuggaagggccgcgaacugaagugugguagugggauuuuuguuaccaaugaggugcacacguggacagaacaguauaaauuccaagcagacagcccgaagagacuuuccgccgcuaucggaaaagccugggaggagggcgugugcgguaucaggucugcaacccgguuggaaaacauuauguggaagcagauaucgaacgagcugaaucauauccuccuggaaaacgacaugaaauuuacuguagucgugggcgauguugcugggauuuuagcccagggaaagaaaaugauccgcccucagcccauggaguacaaguauagcuggaaguccuggggcaaagcgaagauuaucggggccgacgugcaaaauaccacauucauaaucgauggaccaaacacuccugaaugucccgacgaucagagagcuuggaauauuugggaggucgaggacuacggcuuugguaucuucaccacaaacauuuggcugaaacuuagggauucauauacgcaggugugcgaccaccguuugaugagugcagccaucaaggauucuaaagcuguucacgccgacaugggguacuggauagaaagcgagaagaaugaaaccuggaagcucgcacgggcguccuucauugaggugaaaacuuguaucuggccaaagucacauacacuguggagcaacggaguacuagaaucugagaugauuauccccaaaauauauggcgguccuaucucccagcacaauuaccgaccaggcuacuuuacccaaacugccgggccguggcaucugggaaagcucgagcuggauuucgaccuuugcgaaggcacaaccgucgugguggaugagcacugcgggaacagaggacccaguuugaggacgacuaccgucacaggcaaaauuauccacgaaugguguugccgcagcuguacccugccuccauuacgguuuaagggugaggacgggugcugguauggaauggagauuagacccguuaaggaaaaagaggaaaaucucgugaagucuaugguauccgcuggcucaggugagguggacaguuucagccugggccuucuguguaucucgauaaugauugaagaggucaugaggucccgcuggucucgaaaaauguugaugacugggacacucgccguguuuuuccugcuaaucaugggacagcugaccuggaacgaucucauccggcugugcauuaugguuggcgcaaaugcuagcgaccguauggggaugggaacaacuuaccuugccuugauggcaaccuuuaagaugagaccuauguucgccgugggccuguuauuuaggcgccucacgucacgggagguccugcuucugacaaucggucuaagucucguggcuuccguugaacugccaaacucuuuggaggaacugggggauggauuagcgaugggcauuaugauacucaaacugcuuaccgacuuccagagccaucaacugugggccacuuugcucucccugaccuuuaucaagacaacuuucucacuacacuaugcauggaagaccauggcuauggugcugagcauugucagucuuuuuccccucugucugucuacgacaucccagaaaaccacuugguugccgguacuguuaggcagccucgggugcaagccucugacaauguuccuuaucgccgagaauaaaauuuggggaagaaagucguggccacugaacgaagguaucauggccgugggcauaguuucaaucuugcucucuagucugcuaaaaaacgaugugccccuggcugggccucuuauugcaggaggcaugcucaucgccuguuacgucauuuccgguagcucugcggaccugagcuuggagaaggcugccgagguguccugggaagaggaagcagagcauucaggggccagucacaauaucuuaguagaagugcaggaugacggaaccaugaaaauaaaggaugaggagagggacgauacucugacaauucuccugaaggcuacccuucuggcagucagcggcguuuaucccuugucuaucccagccacgcuauucgugugguacuuuuggcagaaaaagaaacaacgauccggcgugcugugggacacuccuucacccccagaagucgagcgcgcggugcucgaugacgggaucuaucggauuaugcagagaggacugcuugguaggagucagguuggcguagggguguuccaggaaaacgucuuucauaccauguggcacgugacacguggagcuguuuuaauguaccaaggcaagcgccuggagccgagcugggccuccgugaaaaaggaccucauaucuuacggugggggauggcgguugcagggcucguggaauaccggcgaggaaguccaggugaucgcaguagagccugggaagaaccccaaaaauguccagacagccccaggaacuuucaagaccagcgaaggugaggugggcgcuauugcccuggauuuuaaacccgggacgucaggauccccuaucguuaacagagaaggcaagauugugggucucuaugggaauggagucgugacaacuaguggcaccuacguuucugcaaucgcucaagccaaagcgagccaggagggcccacugcccgagauagaagacgagguguucaggaagcgaaaccuuacaaucauggaucugcacccuggguccggaaagacccggcgcuauuugccggccauugucagagaagcaaucaaaaggaagcuacggacucugauucucgcuccaacccgagugguagccucagagauggcugaagcauuaaaagguaugcccaucagauaccagacaacggccgugaagucugagcauacuggcaaagagauaguugaccugaugugccacgccaccuuuacaaugcgccuucugagcccugucagggugccaaauuauaacaugauuaucauggaugaagcucauuucaccgaccccaguuccaucgcggcacguggguacauuagcacucgggugggaaugggcgaggccgcugccaucuuuaugacagcaaccccuccggguucugucgaagccuucccccaaucaaaugcuguaauacaggaugaggaaagagacauuccagagagguccuggaacaguggguaugaguggaucacggauuuuccuggaaagacugugugguucguucccagcauuaagucgggcaaugacaucgcgaacugucuccgcaaaaauggcaagcgagugauacaguugucuagaaaaacauucgauaccgaauaccagaagaccaaaaacaacgacugggacuacgucgugacuacagauauuuccgagaugggggccaauuuucgggcagacaggguuaucgauccacgccguugccugaagccugugauccucaaggacggacccgaaagagucauucuggcugguccaaugccggugaccguagccagcgcagcccaacggaggggccgcaucgggcgaaaccacaauaaagagggagaucaguauauuuacaugggccagccucuuaacaaugacgaggaucaugcucacuggacagaagccaagaugcuacuggacaacauaaauacucccgaggguaucauuccagcguuguucgaacccgagagagaaaaaucagcagccaucgauggggaguaucgguuaaggggcgaggcucgcaagacguuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagaucuggaccaaggagggagaacgaaaaaagcugagaccaagguggcucgacgcucggacauacagcgaccccuuggcacugcgcgaguucaaggaauuugccgcugguagaaggucagucaguggcgaucuaauucuggagauagggaaacucccucagcaccuuacucagcgggcccagaaugcacuggacaacuuaguuauguugcauaauagcgaacaaggaggccgagcguauagacacgccauggaggagcugccggauaccaucgaaacacucaugcugcuugcucugauugccgugcucaccggugggguaacuuuguucuuucuguccggccgcggauuaggcaagacgucuaucgggcuacugugugugauggcaagcuccguccuccuuuggauggcuucaguggagccacauuggauugccgcaucuaucauacuggaauucuuuuugaugguucugcucauccccgagccugacaggcagcggaccccccaggauaaccagcuggccuacguggucauuggacuucucuucaugauccugacaguagcugcgaaugagauggguuugcuggaaacuaccaaaaaggacuuaggcauugggcacguggccguugagaaccaccaucacgcagcuaugcuagauguggaccugcauccagccagugccuggacacucuacgcagucgcuaccacuaucauaacaccuaugaugcgucacacgauugaaaacaccacugccaauaucucgcuuacagcgauugcuaaccaagccgcaauccugaugggauuggauaaaggcuggcccauaagcaagauggacaucggugugccacugcucgcccuggggugcuauucccaggucaauccucuuaccuuaaccgcugcagugcugaugcucguugcccauuacgcgauuaucggcccgggauugcaggcuaaggccacaagagaggcacaaaaaaggacugccgcuggcauuaugaagaaccccacgguggaugggaucguagccauagaccuggauccaguggucuaugacgcaaaauuugaaaagcagcuaggacagauuaugcugcucauccuuuguaccucucagauccuguugaugcgcacaacuugggcucugugcgagucaauuacccucgccacaggcccucugaccacuuuaugggaggguagccccgggaaauucuggaauacgacaaucgcgguuuccauggccaacauauuccggggaaguuaccuugcaggcgcuggucuggccuuuucucucaugaagagccuaggcgggggacgaagaggcaccggggcacaaggagaaacucugggcgagaaguggaaaaggcaguugaaucagcugucaaaguccgaauucaacaccuauaaacgcagugguauuauggagguggaccggagcgaagcuaaggaggggcucaaaagaggagagacaacuaagcacgccgucucucguggcaccgccaagcuuaggugguuuguggaacggaaucugguaaaaccagaggguaaggugaucgauuugggcugugggcgcggaggcugguccuacuauugcgcggggcugaaaaagguuacagaagugaaaggauacacgaagggcgguccugggcacgaggaacccauuccgauggcuaccuacggauggaaccucgucaaauuacauucaggcaaggacguguucuuuaucccaccugagaagugugauacucugcuuugcgacauaggcgagagcucgcccaauccaacaaucgaagaggggcgaacccugagaguccuaaaaaugguggaacccuggcucaggggaaaccaguucuguauuaagauccugaauccuuauaugccgucuguuguagagacuuuggagcaaaugcagcggaaacacgguggcaugcuggugcgcaacccccucaguagaaauuccacacaugaaauguacugggucagcugcgggaccggaaacauugugucagcaguuaauaugacguccaggaugcuucugaaccgauuuaccauggcccaccggaagccaacauaugagcgugauguggacuuaggcgcugguacuagacacgucgccguggaaccugagguagcaaaccuggauaucauugggcagcgcaucgaaaauauaaaacaugagcacaagucuaccuggcauuacgacgaggauaaccccuauaagacaugggccuaccacggaagcuaugaagugaaaccuaguggcuccgcuagcucuaugguuaauggcgucgugaaguugcucacuaaaccaugggacgugauucccauggucacccagaucgcgaugacagauaccacuccuuucgggcaacagaggguuuuuaaggagaaaguggacacgcggacaccaaaggccaagagaggaaccgcacagaucauggaaguaacugcuaaauggcugugggguuuccuaucacgcaacaagaaacccaggauuuguacccgagaggaauuuacacggaaggugagaaguaaugccgcaauaggcgccgucuucguggacgagaaccaauggaauuccgcuaaagaggccguugaagaugagagguuuuggaaccuugugcaucgcgaacgugagcugcacaagcaggggaagugcgcgacgugcgucuacaauaugaugggaaaacgggaaaagaaacucggcgaguucgguaaggcaaaagggagcagagccaucugguacauguggcugggagcuagguucuuggaguuugaagcccugggcuucaugaacgaggaccacugguuuucucgcgaaaauucgcucucaggcguggagggggagggacuucauaagcuggguuauauuuuacgagauaucagcaaaauuccgggcgggaacauguacgcagacgauaccgcuggaugggacacucggaucacagaagaugaccugcagaaugaggccaagauaaccgauaucauggaaccugagcacgcuuugcucgccaaguccauuuucaaacugacuuaucagaacaagguaguuagagugcaaaggccagcaaaaaauggcacagucauggacgugaucagucgcagagaucagcgggguucugggcaggugggaaccuacggccuaaacacauuuacuaacauggaagcgcagcuuauuaggcaaauggagagcgagggcaucuucucccccucagaacuggagaccccuaaucucgccgggcguguccuggacugguuggaaaagcauggaguugagcgauuaaaacgcauggcuauaaguggugaugacugugugguaaagccaauugacgauagauuugccacggcacugaccgcucucaacgacaugggcaaggugcggaaagauaucccccagugggaaccgucuaagggguggaaugacuggcagcaggucccuuucugcagccaccacuuucaucaacuuaucaugaaagauggaagggagauugugguucccugucgcaaccaggacgagcuggugggcagagcccgggucucccagggugcaggguggucacuaagggaaacagccugccugggaaagagcuaugcgcagauguggcaacucauguacuuccaccgacgugauuugagacuggcugccaaugcaauauguucugccgugccaguagacuggguuccuacuucccgcaccacauggaguauccaugcucaccaucaguggaugacuaccgaggauaugcuuagcguguggaaccgggucuggauugaagagaaucccuggauggaagacaaaacgcacaucucguccuggggcgaugugccauaucugggcaagagggaggaccaguggugcgggucucucauuggauuaacagccagagcaaccugggcuacuaacauccaaguugccauaaaucaggugcgccggcugaucgguaacgagaauuacuuggacuacaugacaucaaugaagagguuuaaaaacgaaagcgaucccgagggcgcgcugugguga

SEQ ID NO: 13743 - RNA, 9879 nt, Artificial Sequence
  derived and/or modified CDS sequence (opt3) from DENV-1__JF937596__SS-prME
agcgugaccaugcugcucaugcuuaugcccaccgcacuggcuuuccacuugacuacgaggggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccgccacgcggcuggaaaacauuauguggaaacagaucucuaacgagcucaaucauauucuguuagaaaacgacaugaaguucacaguagucgugggcgauguuguggggauccuggcacagggcaaaaagaugauacgcccucaacccauggagcacaaauacucguggaaaagcuggggcaaggcuaagaucauuggggccgacguccagaauaccacuuuuaucauugauggaccaaacaccccugaaugucccgacgaucagagagcguggaauaucugggagguggaggacuauggcuucgguauauuuacaacuaacauuuggcuuaaguugagggauuccuacacccaggccugcgaccaccgucucaugucagcugcaaucaaagauaguaaggccguucaugcugacaugggguauuggauugaaucugagaaaaaugaaacauggaagcuggcccgggcauccuucaucgaggugaagacguguauauggccaaaaucccacacccuauggucaaacggaguacuggaaagcgagauggucauccccaagauuuacggcgguccuaucucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagauuauccaugaaugguguugccgcaguuguaccuuaccuccacuccgguucaaaggugaggacgggugcugguacggaauggagauaagacccgugaaggaaaaggaggaaaaucugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaacgaucuuauccgguugugcauuauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguccugucaauugucagcuuguucccccuguguuuaaguacuaccucucagaagacgacauggcucccggugcugcuuggcucccuggggugcaaaccuuugaccauguuucucaucgcugagaauaagauauggggaagaaaaagcuggccacugaacgaagguaucauggccguuggcguggucucgauucuacugucaucucuucucaagaacgaugugccccuggccgggccuuugaucgcuggaggcauguuaauugcauguuauguaaucagugguuccagcgccgaccugucucucgagaaagcggcugaggugagcugggaagaggaagccgagcacuccggggcaucacauaauauacuggucgaaguucaggaugacggaacuaugaagauuaaagaugaggagagggacgauacacuuaccauccuguugaaggccacucuacuggcugugaguggcguguacccccucagcaucccagcaacacuguucgucugguauuuuuggcaaaagaaaaagcagcgaucuggcgugcuuugggacaccccuucacccccagaaguugagcgcgccguauuagaugacgggauuuaccggauaaugcagagaggacugcucgguaggagccaggugggcgucgggguguuccaagaaaacguuuuccacacgauguggcacgugacucguggagcggucuugauguaucagggcaaacgccuggagccgaguugggcuagcgugaagaaagaccucaucuccuacggugggggauggcggcugcagggcucuuggaauaccggcgaggaaguacaggucauugccguggagccugggaagaaccccaagaauguucaaacagcaccaggaaccuuuaaaacacccgaaggugaggugggcgccaucgcucuugauuucaagccugggacuucgggaagcccaauugucaacagagaaggcaaaaucgugggucuguacgggaauggaguugugaccacgucaggcacauaugucuccgccauagcacagacuaaggcuagucaggagggccccuugccugagaucgaagacgagguguuuaggaaacgaaaccuaaccauuauggaucugcauccggggucuggaaagacacggcgcuaccucccagccaucguaagagaagcgauuaagaggaaauuacggacccugauccuugcccccacucgagugguugcaagcgagauggcugaagcccugaaggguaugccuauaagauaucaaaccacagcugucaaauccgagcacacgggcaaggagauuguggaccucaugugccaugcaacuuucaccaugcgcuugcugucaccagugaggguccccaauuacaacaugaucaucauggaugaagcccacuuuacagacccuucuagcauugccgcucguggguauaucaguacccggguaggaaugggcgaggcggcagccauauucaugacugcuacaccgcccgguuccguggaagccuuuccacagagcaaugcaguuauucaggaugaggaaagagacaucccugagaggucuuggaacucagggcaugaguggauuaccgauuuccccggaaaaacggugugguuugucccauccaucaagaguggcaaugacauagccaacugucuccgcaagaauggcaaacgagugauucagcugagcagaaagacuuucgauacagaauaccagaaaaccaagaacaacgacugggacuauguugugaccacugauaucucggagaugggggcuaauuuucgggcggacagggucaucgauccucgccguugccuuaaacccgugauucuaaaggacggaccagaaagaguaauccuggccgguccgaugccugugacaguugcaucugcugcccagcggaggggccgcauugggcgaaaccacaauaaggagggagaucaguacauauacaugggccagcccuugaacaaugacgaggaucacgcacauuggaccgaagccaaaauguuacuggacaacaucaauacaccagaggguauuauccccgcucucuucgaaccugagagagaaaaguccgccgcgaucgauggggaguaucggcugaggggcgaggcacgcaaaacuuucgucgaacuuaugagaaggggagaccugccaguguggcucagcuacaagguggccucagagggcuuucaauauagugaucggcguuggugcuucgacggggaacgcaacaaucaggucuuggaggaaaacauggauguugagauuuggacgaaagagggagaacgaaagaaacugagacccagguggcuagacgcucggaccuacucugacccucuggcccuccgcgaguuuaaggaguucgcugcagguagaagguccgugagcggcgaucuuauacuggagaucgggaaguuaccgcagcacuugacacagcgggcccaaaaugcucuggacaaccucguaaugcugcauaauucagaacagggaggccgagccuauagacacgcaauggaggagcuuccagauacuauugaaacccugaugcucuuggcgcugaucgccguguuaacagguggggucacccuauuuuuccugaguggccgcggacucggcaaaacuagcauugggcuucugugugugauggcuuccucuguuuugcuguggauggccagcguggagccccacuggaucgcagcuuccauaauccucgaauuuuuccugaugguccuucucauuccugagcccgacaggcagcggacgccacaggauaaccaacuggccuacguagugaucggauugcuguuuaugauuuuaaccguugcagccaaugagaugggucuacuggaaacaacuaagaaagaccucggcaucgggcauguggcugucgagaaccaccaucacgcgaccaugcuugauguggaccugcauccugccucagcauggacauuguaugcugucgccaccacuauaauuacacccaugaugcgucacacgaucgaaaacaccacugccaauauuucucugacagcaaucgcuaaccaggccgcgauacucaugggacuggauaagggcuggccaaucaguaaaauggacauuggugugccucuuuuagcucuggggugcuacucgcagguuaauccgcucaccuugaccgccgcagugcugaugcuaguagcccacuacgcuaucauuggccccggacugcaagcaaaggccacaagagaggcgcagaagaggacugcugccggcaucaugaaaaacccaacgguggaugggauagucgcaauugaccucgauccuguuguguaugacgccaaguucgaaaaacagcuuggacagaucaugcuguugauccuguguaccagccaaauucuccugaugcgcacaacuugggcuuuaugcgaguccaucacccuugccacaggcccccugaccacucucugggaggguucuccagggaaguuuuggaauacgacaauagcagucucaauggcuaacauuuuccggggaagcuaccuagccggcgcgggucuggccuuuuccuugaugaaaagucugggcgggggacgaagaggcaccggggcacagggagaaacucucggcgagaaguggaagaggcagcuuaaucagcugucuaaaagcgaguucaacaucuauaagcgcucagguauuauggagguggaccgguccgaagcuaaagagggguugaagagaggagagaccacacgucaugccguaaguaggggcacugcaaaacugcggugguucguggaacgcaaucucguuaagccugaggguaaggugaucgauuuaggcugugggcgaggaggcuggagcuacuauugcgcugggcugaaaaaggucaccgaagugaaaggauacacaaagggcggucccgggcacgaggaaccgauaccaauggccacguauggauggaaccuugucaaacugcauucuggcaaggacguguuuuucgccccucccgagaaaugugauacccuacucugcgacaucggcgaguccucaccaaaucccacuauugaagaggggagaacacugaggguuuugaagaugguagaaccuuggcugcggggaaaccaauuuuguaucaagauucucaauccguacaugcccagcguggucgagacccuugagcagaugcagcgcaaacacgguggcaugcuggugagaaacccauuaucgagaaauucuacucacgaaauguacuggguuaguugcgggacaggaaacaucguguccgcggucaauaugaccagccgaaugcuguugaaccgguucacgauggcucaucguaagccuaccuaugagagagauguggaccucggcgcagguacacgccacguagccguggaacccgagguugcuaaccuggauauuaucgggcagaggauagaaaauauuaaacaugagcacaagucaacuuggcauuacgacgaggauaacccuuauaaaaccugggccuaccacggauccuaugaagucaagccaucuggcagcgcaaguuccauggugaauggcguggucaagcuacuuacaaaacccugggacguuaucccuauggugacucaaaucgccaugaccgauacaaccccauuugggcagcagcggguauucaaggagaaaguggacacuagaacgcccaaggcuaaacgcggaacagcgcaaauuauggaagucaccgccagguggcugugggguuuucucagccgaaacaagaagccgcggauauguacuagagaggaguucaccaggaaagugcgcucuaaugcagcuaucggcgccguuuuuguggacgagaaccaguggaacucagcaaaggaggccgucgaagaugagcguuucugggaccuggugcagaaagaacgggaguugcacaagcaggggaaaugcgcuacaugcguauacaacaugaugggaaagagagaaaagaaacugggcgaguuugguaaggccaaagggaguagggcgauuugguauauguggcucggagcacgcuuccuugaguuugaagcccugggcuucaugaaugaggaucauugguucucccgagaaaacagcuuaucuggcguugagggggagggacugcacaaguuggguuacauccuccgggacauuucgaaaaucccuggcgggaauauguacgcugaugacacggccggaugggauaccagaauaacugaagacgaucugcaaaacgaggcaaagaucacagacauuauggaaccagagcaugcucuacuugccaccucaaucuuuaaacugacuuaucagaauaagguggucagggugcagcgccccgcuaagaacggcacagugauggaugucauuagcagacgggaccagagggguuccgggcaaguuggaaccuacggccucaauacauucacuaacauggaagcccagcugauccgucagauggagagugagggcauauuuuugccuucugaauuagagaccccaaaccuggcagaacgagugcucgauuggcuugagaaacacgggguagaacgccugaagagaauggcgauuagcggagacgacuguguggucaaacccaucgaugaccgguucgccacggcucuaaccgcccugaaugauauggguaaggugaggaaagacaucccgcagugggagccuuccaagggcuggaacgauuggcaacagguucccuuuugcucacaccauuuccaccagcucauuaugaaggacgggcgcgagauaguggucccauguagaaaucaggaugaauuggugggacgggcaaggguaagucaaggcgcugguuggucucugcgagagacagccugccuugggaaaagcuaugcacagauguggcagcugauguacuuucaucguagagaccuccgcuuagccgcgaacgcuaucuguuccgccguuccuguggauuggguccccacuucacggaccacauggagcauucacgcacaucaccaauggaugacuaccgaagacaugcugucuguguggaauaggguuuggaucgaggaaaacccauggauggaggauaagacgcacguguccaguuggggagacguccccuauuugggcaaaagagaggaccaguggugcggcagccugauugggcucacagcccgcgcuaccugggccucgaauauccagguggcaauaaaccagguacggaggcuuaucggaaaugaaaacuaccuggauuauaugacuuccaugaagcgauucaaaaaugagggugacccugaaggcgcucuaugguga

SEQ ID NO: 13744 - RNA, 9879 nt, Artificial Sequence
  derived and/or modified CDS sequence (opt3) from DENV-1__FJ898380__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucaaaggugaggacgggugcugguauggaauggagauaagacccguuaaggaaaaggaggaaaaucuggugaaaagcaugguaucugcuggcuccggugagguggacucauuuagucuuggccuguuguguauuagcaucaugaucgaagaggucaugaggucgcgcuggucccgacggaugcucaugaccgggacucuggccguguucuuucuacugauuaugggacagcucacauggaacgaucugauccgucuuugcauuaugguuggcgcaaaugcuucugacagaauggggaugggaaccacauacuuggcccugauggcaacuuucaagaugaggccuauguuugccgugggcuuacucuuccgccggcugaccagcagagagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaagaccacauuuucccugcacuaugcauggaaaacuauggcuauggugcuuucaauugucagccucuucccccuguguuugaguaccacgucucagaagacaaccuggcugccgguauuacucggcucccuggggugcaagccucuuacuauguuucugaucgccgagaauaaaauauggggaaggcgaagcuggccauugaacgaagguaucauggccgugggcauuguuucgauccuccugucaucucuacugaagaacgaugugccccuugcugggccucucauugcaggaggcaugcugaucgccuguuacgucauaagugguuccagcgcggacuugucuuuagagaaagcugccgaggugagcugggaagaggaagcagagcauuccggggccucacacaauauucugguagaagugcaggaugacggaacaaugaagaucaaagaugaggagcgcgacgauacccucacuauccugcuuaaggcuacacuguuggcagucaguggcguuuauccccuaagcauuccagccacccuguucgugugguacuucuggcagaaaaagaagcagcggucuggcgugcucugggacacgccuucacccccagaagucgagagagcggugcuggaugacgggauauauaggaucaugcagcguggacuuuuaggucgcagccagguuggcguagggguguuucaagaaaacgucuuccauacuauguggcacgugacccggggagcuguucugauguaccagggcaaaagacucgagccgaguugggccagcgugaagaaagacuugauuuccuacggugggggauggaggcugcagggcucuuggaauacaggcgaggaaguccaggugaucgcaguagagccugggaagaaccccaaaaauguccaaaccgccccaggaacauuuaagacucccgaaggugaggugggcgcuauugcccucgauuucaagccugggaccucgggaagcccaaucguuaaccgagaaggcaaaauagugggucuguaugggaauggagucgugacgacaucaggcacuuacguuuccgcaaucgcucaggccaaggcgagucaggagggcccccuuccugagauugaagacgagguguuucggaaacgcaaccugaccaucauggauuugcacccggggucuggaaagacaagaagguaucuaccagccauuguccgggaagcaaucaaacgaaagcugagaacccucauauuagcucccacucgcgugguagccagcgagauggcugaagcacugaaggguaugccuauuagguaccaaaccacagccgugaaauccgagcauacgggcaaggagaucguugaccuuaugugccacgccacuuucaccaugcgucugcucucaccaguccgggugcccaauuauaacaugaucauuauggaugaagcucauuuuacagacccuucuagcaucgcggcaagaggguacauaaguaccagggugggaaugggcgaggccgcugccauuuucaugacugcaacaccgcccgguuccgucgaagccuuuccacagagcaaugcuguaauccaggaugaggaacgcgacauuccugagcgaucuuggaacucaggguaugaguggaucaccgauuuccccggaaaaacggugugguuuguuccauccauaaagaguggcaaugacauugcgaacuguuugaggaaaaauggcaagcgggugauccagcugagcaggaagacuuucgauacagaauaccagaaaaccaagaacaacgacugggacuacgucgugaccacugauaucucggagaugggggccaauuuccgcgcagaccguguuauugauccuagacggugccucaaacccgugauccugaaggacggaccagaaagggucauucuugcugguccgaugccugugacaguagccucugcagcccagcgccgaggcagaauagggcggaaccacaauaaagagggagaucaguauaucuacaugggccagccccuaaacaaugacgaggaucaugcucacuggaccgaagccaagaugcuguuggacaacauuaauacaccagaggguaucauccccgcguuauuugaaccugagagggaaaaguccgcagccauugauggggaguaucgccugagaggcgaggcuaggaaaacuuucguggaacucaugcggcguggagaccugccaguuuggcuuagcuacaaggucgccucagagggcuuucaauauagugaucgccgauggugcuucgacggggaaagaaacaaucaggugcuggaggaaaacauggauguggagauauggacgaaagagggagaaaggaagaaacuccggccccgcugguuggacgcuagaaccuacucugacccucuggcacuaagggaguuuaaggaguucgccgcuggucggcgauccgucagcggcgaucugauccucgagauugggaaacuuccgcagcaccugacacagagagcccaaaaugcauuagacaacuugguuaugcugcauaauucagaacagggaggccgcgcguauaggcacgccauggaggagcucccagauacuaucgaaacccugaugcuucuggcucucauugccguguugacaggugggguaacccuguuuuucuuaaguggccggggacuaggcaagacuagcaucgggcugcucugugugauggcauccucuguccuucuguggauggcuagcguggagccccauuggauagccgcauccaucauuuuggaauuuuuccugaugguucuccugaucccugagcccgaccgucagagaacgccacaggauaaccaacuugccuacguggucauuggacuccuguuuaugaucuugaccguagcugcgaaugagaugggucuguuagaaacaacuaagaaagaccuaggcauagggcacguggccguugagaaccaccaucacgcagcuaugcuggauguggaccuccauccugccucagccuggacccuuuacgcagucgcuacaaccauuaucacucccaugaugaggcacacaauugaaaacacgaccgccaauaucucucugacugcgauagcuaaccaggccgcaaucuugaugggacuggauaagggcuggccaauuaguaaaauggacaucggugugccucuccuggcccuugggugcuauucgcaggucaauccguuaacacugaccgcugcagugcucauguugguugcccauuacgcgauuaucggccccggacugcaagcuaaggccacccgcgaggcacagaaacggacagccgcuggcauaaugaagaacccaacuguggaugggauuguagccaucgaccuagauccuguggucuaugacgcaaaguucgaaaaacagcugggacagaucaugcuccuuauucuguguacgagccaaaucuugcugaugcgaaccacaugggcucucugcgaguccauaacucuggccaccggccccuuaacaacccuuugggaggguucuccagggaaguuuuggaauacuacgauugcgguuucaauggccaacaucuucagaggaagcuaccuggcaggcgcuggucucgccuucucccuaaugaaaagucugggcgggggaaggcgcggcacaggggcacagggagaaaccuugggcgagaaguggaaacggcagcugaaucagcucucuaagagcgaauuuaacacuuauaagagaucagguauuauggagguggaccguuccgaagcuaaagaggggcuuaagaggggagagaccacaaaacacgccgucagucggggcacugccaagcugcgcugguucguggaacgaaauuugguaaaaccugaggguaaggugaucgaucugggcugugggagaggaggcuggagcuacuauugcgcggggcucaagaaaguuaccgaagugaagggauacacaaaaggcggucccgggcacgaggaaccgauaccaauggcuacguacggauggaacuuagucaagcugcauucuggcaaagacguguuuuucaucccucccgagaagugugauacccuucugugcgacauuggcgaguccucaccaaaucccacuaucgaagaggggaggacacuacggguccucaaaaugguggaaccuuggcugcgcggaaaccaauuuuguauuaagaucuugaauccguauaugcccagcguuguagagacccuggagcagaugcagagaaagcacgguggcaugcucgugaggaacccacuuucgcgaaauucuacucaugaaauguacugggucaguugcgggacaggaaacauuguguccgcaguuaauaugaccagccggaugcuguuaaaccguuucacgauggcccacagaaaaccuaccuaugagcgcgauguggaccugggcgcugguacaaggcacgucgccguggaacccgagguagcaaacuuggauaucauagggcagcggauugaaaauaucaagcaugagcacaaaucaacuuggcauuacgacgaggauaacccuuauaagaccugggccuaccacggauccuaugaagugaaaccaucuggcagcgcuaguuccaugguuaauggcgucgugaagcuccugacaaagcccugggacgugaucccuauggucacucaaauugcgaugaccgauacaaccccauuugggcagcagagaguuuucaaagagaagguggacacucgcacgcccaaagccaagaggggaacagcacaaauaauggaaguaaccgcuaaauggcuaugggguuuucuuagccgaaacaagaagccgcggaucuguacuagagaggaguucaccaggaaagugcgcucuaaugccgcaauuggcgccgucuuuguggacgagaaccaguggaacucagcuaaggaggccguugaagaugagcguuucugggaccuggugcaucgggaaagagagcuccacaaacaggggaagugcgcgacaugcgucuacaacaugaugggaaaaagggaaaagaagcugggcgaguuugguaaagcaaaggggagucgcgccaucugguacaugugguugggagcucgauuccuggaguucgaagcccucggcuuuaugaaugaggaucacugguucucccgggaaaacagccuuucuggcguggagggggagggacugcauaaauuagguuauauucugagagacaucucgaagauaccuggcgggaauauguacgcagaugacacggcuggaugggauaccaggaucacugaagacgauuugcagaacgaggcccgcauuacagacaucauggaaccagagcacgcucuccuggccaaaucaauuuuuaagcuaaccuaucaaaauaaaguaguuagagugcagcggcccgcaaagaacggcacugucauggaugugaucagcaggcgugaccagcgagguuccggacaggugggaacauacggccuuaauaccuucacaaacauggaagcgcaacugauacgccagauggagagugagggcauauuuucuccuagcgaacucgagacuccaaaccuggccgaaagagucuuggauugguuagagaaguaugggguugaacggcugaaaaggauggcuaucuccggagacgacugugugguaaagcccaucgaugaccgcuucgccaccgcacucacggcucuuaaugauauggguaaagugagaaaggacauuccgcagugggagccuucaaaaggcuggaacgauuggcagcaaguccccuuuugcagucaucacuuccaccagcugauaaugaaggacgggcgggagaucgugguuccauguaggaaucaggaugagcuagugggacgagcccgugucucucagggcgcagguuggagccugagagagaccgccugccucgggaaguccuacgcgcaaauguggcaguugauguauuuucaucgccgggaccugaggcuugcugccaacgcaauuuguucagccgugccuguagauuggauccccacaagcagaacuaccuggucuauucacgcucaucaccaguggaugacaacugaagacaugcuguccguuuggaaucgcguguggaucgaggaaaacccauggauggaggauaaaacccauauaaguagcuggggagacguccccuaccucggcaagcgggaggaccaauggugcggcucguuaaucgggcugacggccagggcaacaugggcuaccaauauucagguggccaucaaccagguucgaagauugauuggaaaugaaaacuaccuggauuauaugacuuccaugaaacgguucaagaaugagucugacccugaaggugcgcucugguga

SEQ ID NO: 13745 - RNA, 9879 nt, Artificial Sequence
  derived and/or modified CDS sequence (opt3) from DENV-1__FJ898382__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauaacagagaccgaaccggacgauguggacuguuggugcaaugcgacugauacaugggugaccuaugggacguguagucagacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagggauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuuucucuaucgcggcaaggggguacauaagcacccgcgugggaaugggcgaggccgcugccauuuuuaugacugcaacaccgcccgguagugucgaagccuucccacaguccaaugcuguaauccaggaugaggaacgagacauuccugagagaagcuggaacucuggguaugaguggaucaccgauuuucccggaaagacggugugguucguuccaucaauaaaauccggcaaugacauugcgaacuguuugcggaagaauggcaaaagggugauccagcugagucgcaagacuuucgauacagaauaccaaaagaccaaaaacaacgacugggacuacgucgugaccacugauaucagcgagaugggggccaauuuucgugcagacagaguuauugauccucggaggugccucaagcccgugauccugaaagacggaccagaacgcgucauucuugcugguccgaugccugugacaguagccucggcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauucgaaccugagcgcgaaaagucugcagccauugauggggaguauagacugaggggcgaggcucggaagacuuuuguggaacucaugcgucgcggagaccugccaguuuggcuuuccuacaaagucgccagcgagggcuuccaauauucagaucgaagauggugcuuugacggggaaaggaacaaucaggugcuggaggaaaacauggauguggagauauggacgaaggagggagaacggaaaaagcuccgccccagaugguuggacgcuaggaccuacagugacccucuggcacuacgggaguucaaagaauuugccgcuggucgaagaucugucuccagcgaucugauccucgagauuggcaaacuuccgcagcaccugacacagcgcgcccaaaaugcauuagacaacuugguuaugcugcauaauucagaacaagggggaagggcguaucggcacgccauggaggagcucccagauacuaucgaaacccugaugcuucuggcucucauugccguguugacaggcgguguaacccuguucuuuuuaagugggcguggccuaggaaaaacuagcaucggccugcucugugugauggcauccucuguccuucuguggauggcuagcguggagccccauuggauagccgcauccaucauuuuggaguucuuucugaugguucuccugaucccugagcccgacagacagaggacgccacaggauaaccaacuugccuacguggucauugggcuccuguucaugaucuugaccguagcugcgaaugagaugggacuguuagaaacaacuaagaaggaccuagguauaggccacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugauggggcuggauaaaggauggccaauuaguaagauggacaucggcgugccucuccuggcccuugguugcuauucgcaggucaauccguuaacacugaccgcugcagugcucauguugguugcccauuacgcgauuaucgggcccggccugcaagcuaaagccacccgggaggcacagaagcgaacagccgcuggaauaaugaaaaacccaacuguggauggcauuguagccaucgaccuagauccuguggucuaugacgcaaaguuugaaaagcagcuggggcagaucaugcuccuuauucuguguacgagccaaaucuugcugaugagaaccacaugggcucucugcgaguccauaacucuggccaccggacccuuaacaacccuuugggagggcucuccagguaaauucuggaauacuacgauugcgguuucaauggccaacaucuucagggggagcuaccuggcaggagcuggccucgccuuuucccuaaugaagagucuggguggcgggcgccggggaacaggcgcacagggggaaaccuugggagagaaauggaagagacagcugaaucagcucucuaaaagcgaguucaacacuuauaagcguucaggcauuauggagguggacagguccgaagcuaaggagggucuuaaacgcggggaaaccacaaagcacgccgucagucggggaacugccaaacugcgaugguuuguggaaagaaauuugguaaagccugagggcaaagugaucgaucuggguuguggcagagggggauggagcuacuauugcgcgggccucaagaagguuaccgaagugaaaggguacacaaagggaggccccggucacgaggaaccgauaccaauggcuacguacggguggaacuuagucaaacugcauucuggaaaggacguguucuuuaucccucccgagaaaugugauacccuucugugcgacauuggcgaguccucaccaaaucccacuaucgaagagggccggacacuacgcguccucaagaugguggaaccuuggcugagagggaaccaauucuguauuaaaaucuugaauccguauaugcccagcguuguagagacccuggagcagaugcagaggaagcacggagguaugcucgugcgaaacccacuuucgagaaauucuacucaugaaauguacugggucaguugcggcacagggaacauuguguccgcaguuaauaugaccagccguaugcuguuaaacagauuuacgauggcccaccgcaagccuaccuaugagagggauguggaccugggagcuggcacacggcacgucgccguggaacccgagguagcaaacuuggauaucauaggucagagaauugaaaauaucaaacaugagcacaagucaacuuggcauuacgacgaggauaacccuuauaaaaccugggccuaccacggguccuaugaagugaagccaucuggaagcgcuaguuccaugguuaauggcgucgugaaacuccugacaaagcccugggacgugaucccuauggucacucaaauugcgaugaccgauacaaccccauucggccagcagcgcguuuuuaaggagaaaguggacacuaggacgcccaaggccaaacgagggacagcacaaauaauggaaguaaccgcuaaguggcuauggggauuccuuagccggaacaaaaagccgagaaucuguacuagggaggaauuuacccgcaaggugcguucuaaugccgcaauuggugccgucuucguggacgagaaccaguggaacucagcuaaagaggccguugaagaugagcgguuuugggaccuggugcauagagaaagggagcuccacaagcagggcaaaugcgcgacaugcgucuacaacaugauggggaagcgcgagaagaagcugggagaguucggcaaggcaaaagguagucgagccaucugguacaugugguugggggcucgguuccuggaguuugaagcccucggauucaugaaugaggaucacugguuuuccagagaaaacagccuuucuggcguggagggcgaggggcugcauaaguuaggauauauucugagggacaucucgaaaauaccugguggcaauauguacgcagaugacacggcugggugggauacccgcaucacugaagacgauuugcagaacgaggccagaauuacagacaucauggaaccagagcacgcucuccuggccaagucaauuuucaaacuaaccuaucaaaauaagguaguucgggugcagaggcccgccaaaaauggaacugucauggaugugaucagccgucgagaccagcgcggcuccggucagguggggacauacggacuuaauaccuuuacaaacauggaagcgcaacugauaagacagauggagagugagggcauuuucucuccuagcgaacucgagacuccaaaccuggccgaacgggucuuggauugguuagagaaguauggcguugaaaggcugaagcgcauggcuaucuccggggacgacugugugguaaaacccaucgaugacagauuugccaccgcacucacggcucuuaaugauaugggaaaggugcggaaagacauuccgcagugggagccuucaaaggguuggaacgauuggcagcaaguccccuucugcagucaucacuuucaccagcugauaaugaaagacggcagggagaucgugguuccaugucgaaaucaggaugagcuaguggggcgugccagagucucucagggagcaggcuggagccugcgcgagaccgccugccucgguaaguccuacgcgcaaauguggcaguugauguauuuccaucggagggaccugagacuugcugccaacgcaauuuguucagccgugccuguagauuggauccccacaagccgcacuaccuggucuauucacgcucaucaccaguggaugacaacugaagacaugcuguccguuuggaaucggguguggaucgaggaaaacccauggauggaggauaagacccauauaaguagcuggggagacguccccuaccucggaaaaagggaggaccaauggugcggcucguuaaucggccugacggcccgagcaacaugggcuaccaauauucagguggccaucaaccagguuagacgguugauugggaaugaaaacuaccuggauuauaugacuuccaugaagagguuuaaaaaugagucugacccugaaggagcgcucugguga

SEQ ID NO: 13746 - RNA, 9879 nt, Artificial Sequence
  derived and/or modified CDS sequence (opt3) from DENV-1__FJ898383__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccuauaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccaggcggccgggccguggcaucucggaaaacuggagcuugauuuugacuugugcgaaggcacuacaguagucguggaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgucaaagaaaaggaggaaaaucugguuaagagcauggugucugcuggcuccggugagguagacucauuuagucuuggccuguuguguaucagcaucaugauugaagaggugaugcgcucgcgauggucccggcguaugcucaugaccgggacucuggccgucuucuuucuacugaucaugggacagcucacauggaacgaucugauuagacuuugcauaauggugggcgcaaaugcuucugacaggauggggaugggaaccacauacuuggcccugauggcaacuuucaaaaugcgcccuauguuugccguuggcuuacucuuccggagacugaccagcagggaggugcuucugcuaacgaucggucucucacuggucgcuaguguggaauugccaaacucccuggaggaauuaggggauggacucgcgaugggcauuaugauccugaaacuucugacagacuuucaaucucaucaguugugggccacccuccugagccuaacuuucauuaaaaccacauuuucccugcacuaugcauggaagacuauggcuaugguucuuucaaucgugagccucuucccccuguguuugaguaccacgucucagaaaacaaccuggcugccggucuuacucggcucccuggggugcaagccucuuacuauguuucugauagccgagaauaagaucuggggacgacgcagcuggccauugaacgaagguauuauggccguaggcaucgugucgauucuccugucaucucuacugaaaaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacaaugaaaaucaaggaugaggagcgggacgauacccucacuauucugcuuaaagcuacacuguuggcagugaguggcgucuauccccuaagcauaccagccacccuguucguuugguacuucuggcaaaagaaaaagcagagaucuggcgugcucugggacacgccuucacccccagaaguggagagggcgguccuggaugacgggaucuaucguauuaugcagcgcggacuuuuaggucggagccaggugggcguugggguauuucaagaaaacguguuccauacuauguggcacgucaccagaggagcugugcugauguaccagggcaagaggcucgagccgaguugggccagcguuaaaaaggacuugaucuccuacggugggggauggcgacugcagggcucuuggaauacaggcgaggaagugcaggucauugcaguggagccugggaaaaaccccaagaauguacaaaccgccccaggaacauuuaaaacucccgaaggugaggucggcgcuaucgcccucgauuucaagccugggaccucgggaagcccaauagugaaccgggaaggcaagaucguuggucuguaugggaauggaguggucacgacaucaggcacuuacguguccgcaauugcucaggccaaagcgagucaggagggcccccuuccugagaucgaagacgagguuuuucgcaagagaaaccugaccauuauggauuugcacccggggucuggaaaaacaaggcgguaucuaccagccaucgugcgagaagcaauaaagagaaaacugcgcacccucauuuuagcucccacuagggucguggccagcgagauggcugaagcacugaaggguaugccuauccguuaccaaaccacagccguaaaguccgagcauacgggcaaagagaucguggaccuuaugugccacgccacuuucaccaugcggcugcucucaccaguuagaguccccaauuauaacaugauuaucauggaugaagcucauuuuacagacccuucuagcauagcggcaaggggguacauuaguacccgcgugggaaugggcgaggccgcugccaucuucaugacugcaacaccgcccgguuccguggaagccuuuccacagagcaaugcugucauucaggaugaggaacgagacaucccugagagaucuuggaacucaggguaugaguggauaaccgauuuccccggaaagacgguaugguuugugccauccauuaaaaguggcaaugacaucgcgaacuguuugcggaagaauggcaaaaggguuauccagcugagccgcaagacuuucgauacagaauaccaaaagaccaaaaacaacgacugggacuacguggucaccacugauauuucggagaugggggccaauuuccgugcagacagagugaucgauccucggaggugccucaagcccguuauucugaaagacggaccagaacgcgugauacuugcugguccgaugccugucacaguggccucugcagcccagcgaagaggccggaucgggaggaaccacaauaaggagggagaucaguauauuuacaugggccagccccuaaacaaugacgaggaucaugcucacuggaccgaagccaaaaugcuguuggacaacaucaauacaccagaggguaucauucccgcguuauuugaaccugagcgcgaaaaguccgcagccauagauggggaguauagacugaggggcgaggcucggaagacuuucguagaacucaugcgucgcggagaccugccaguguggcuuagcuacaaaguugccucagagggcuuucaauauagugaucgaagauggugcuucgacggggaaaggaacaaucagguccuggaggaaaacauggauguggagaucuggacgaaggagggagaacggaaaaagcuccgccccagaugguuggacgcuaggaccuacucugacccucuggcacuacgggaguuuaaagaguucgccgcuggucgaagauccgugagcggcgaucugauucucgagaucgggaaacuuccgcagcaccugacacagcgcgcccaaaaugcauuagacaacuuggucaugcugcauaauucagaacagggaggcagggcguaucggcacgccauggaggagcucccagauacuauugaaacccugaugcuucuggcucucaucgccguuuugacagguggggugacccuguuuuucuuaaguggccguggacuaggcaaaacuagcauagggcugcucuguguaauggcauccucugugcuucuguggauggcuagcgucgagccccauuggaucgccgcauccauuaucuuggaauuuuuccugauggugcuccugauuccugagcccgacagacagaggacgccacaggauaaccaacuugccuacguugugaucggacuccuguuuaugauauugaccgucgcugcgaaugagaugggucuguuagaaacaacuaagaaggaccuaggcauugggcacguagccguggagaaccaccaucacgcagcuaugcuggauguugaccuccauccugccucagccuggacccuuuacgcaguggcuacaaccaucauuacucccaugaugcgccacacaaucgaaaacacgaccgccaauauaucucugacugcgaucgcuaaccaggccgcaauuuugaugggacuggauaaaggcuggccaaucaguaagauggacauuggugucccucuccuggcccuugggugcuauagccaggugaauccguuaacacugaccgcugcaguccucauguugguggcccauuacgcgaucauaggccccggacugcaagcuaaagccacccgggaggcacagaagcgaacagccgcuggcauuaugaaaaacccaacuguugaugggaucguggccaucgaccuagauccuguaguguaugacgcaaaguucgaaaagcagcugggacagauuaugcuccuuauccuguguacgagccaaauauugcugaugagaaccacaugggcucucugcgaguccauuacucuggccaccggccccuuaacaacccuuugggaggguucuccagggaaauuuuggaauacuacgaucgcggucucaauggccaacauuuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguaucauggagguugacagguccgaagcuaaggaggggcuuaaacggggagagaccacaaagcacgccgugagucgcggcacugccaaacugcgaugguucgucgaaagaaauuuggugaagccugaggguaaaguaauagaucugggcugugggaggggaggcuggagcuacuauugcgcggggcucaagaaggugaccgaaguuaaaggauacacaaagggcggucccgggcacgaggaaccgaucccaauggcuacguacggauggaacuuagugaaacugcauucuggcaaggacgucuuuuucauuccucccgagaaaugugauacccuucugugcgacaucggcgaguccucaccaaaucccacuauugaagaggggcggacacuacgcgugcucaagauggucgaaccuuggcugagaggaaaccaauuuuguaucaaaauuuugaauccguauaugcccagcgugguugagacccuggagcagaugcagaggaagcacgguggcaugcucguacgaaacccacuuucgagaaauucuacucaugaaauguacugggugaguugcgggacaggaaacaucgucuccgcagugaauaugaccagccguaugcuguuaaacagauucacgauggcccaccgcaagccuaccuaugagagggauguugaccugggcgcugguacacggcacguggccgucgaacccgagguggcaaacuuggauauaauugggcagagaaucgaaaauaucaaacaugagcacaagucaacuuggcauuacgacgaggauaacccuuauaaaaccugggccuaccacggauccuaugaaguaaagccaucuggcagcgcuaguuccauggugaauggcguugucaaacuccugacaaagcccugggacgugauuccuauggugacucaaauagcgaugaccgauacaaccccauuugggcagcagcgcgucuucaaggagaaaguugacacuaggacgcccaaggccaaacgaggaacagcacaaaucauggaagugaccgcuaaguggcuaugggguuuucuuagccggaacaaaaagccgagaauuuguacuagggaggaguucacccgcaagguacguucuaaugccgcaaucggcgccguguuugucgacgagaaccaguggaacucagcuaaagaggccguggaagaugagcgguucugggaccugguucauagagaaagggagcuccacaagcaggggaaaugcgcgacaugcguguacaacaugaugggaaagcgcgagaagaagcugggcgaguuugguaaggcaaaagggagucgagccauuugguacaugugguugggagcucgguuccuggaguucgaagcccucggcuuuaugaaugaggaucacugguucuccagagaaaacagccuuucuggcgucgagggggagggacugcauaaguuagguuauauccugagggacauaucgaaaaucccuggcgggaauauguacgcagaugacacggcuggaugggauacccgcauuacugaagacgauuugcagaacgaggccagaaucacagacauuauggaaccagagcacgcucuccuggccaagucaaucuuuaaacuaaccuaucaaaauaaggugguacggguucagaggcccgccaaaaauggcacugugauggaugucauaagccgucgagaccagcgcgguuccggacaggugggaacauacggccuuaauaccuucacaaacauggaagcgcaacugauuagacagauggagagugagggcaucuuuucuccuagcgaacucgagacuccaaaccuggccgaacggguguuggauugguuagagaaguauggggucgaaaggcugaagcgcauggcuaucuccggagacgacuguguugugaaacccauugaugacagauucgccaccgcacucacggcucuuaaugauauggguaagguacggaaagacauaccgcagugggagccuucaaagggcuggaacgauuggcagcaagugcccuuuugcagucaucacuuccaccagcugaucaugaaagacgggagggagauugucgugccaugucgaaaucaggaugagcuaguuggacgugccagagugucucagggcgcagguuggagccugcgcgagaccgccugccucgggaaguccuacgcgcaaauguggcaguugauguauuuucaucggagggaccugagacuugcugccaacgcaaucuguucagccgucccuguggauuggauucccacaagccgcacuaccuggucuauccacgcucaucaccaguggaugacaacugaagacaugcuguccguauggaaucggguuuggauagaggaaaacccauggauggaggauaagacccauaucaguagcuggggagacgugcccuaccucggcaaaagggaggaccaauggugcggcucguuaauugggcugacggcccgagcaacaugggcuaccaauauccaggucgccauuaaccaggugagacgguugaucggaaaugaaaacuaccuggauuauaugacuuccaugaagagguucaaaaaugagucugacccugaaggugcgcucugguga

SEQ ID NO: 13747 - RNA, 9879 nt, Artificial Sequence
  derived and/or modified CDS sequence (opt3) from DENV-1__FJ898384__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcaaucuuccucgcccaugcuauuggcacaucgaucacccagaagggcauaaucuuuauucugcugaugcucgugacgccaucaauggccaugcgcugcgucgggaucggaagcagagauuucguggaggguuuaaguggcgcgacuuggguagacguugugcuggagcacggguccugugucacaaccauggcaaaggauaaacccacucuugacauugaauugcugaagacagaggugaccaacccugccgugcuaaggaaacucugcaucgaagcuaagauaucuaauacgaccacagauagccgguguccaacucaaggagaggccacccuggucgaagagcaggacgcaaacuuuguuugccgccgaacauucguggauagaggcugggguaauggguguggacuuuuuggcaaaggcucccugauuacuugcgcuaaguucaagugcguaaccaaauuggaggggaagaucgugcaguacgaaaaccucaaauauucagucauugugacaguucacaccggagaccagcaucaaguggguaaugagaguacugaacacggcacgacagccaccaucacuccccaggcgccuagcaccgagauccagcugacagacuacggggccuuaacccuggauuguucuccaaggacuggacucgacuuuaacgaaaugguccuucugacaaugaaggagaaauccugguuggugcauaagcagugguuccuagaucugccgcuccccuggacgucaggcgcaagcaccagucaagagacuuggaaucggcaggaccugcuuguaacauuuaaaaccgcucacgccaagaagcaggaaguugugguccuggguucucaagagggggcuaugcacacagccuugacuggcgcaaccgaaauucagacguccggaaccacaacuauauucgccggccaucucaaaugccgucugaagauggauaaauuaacccugaaggggaugagcuaugugauguguacaggaucguucaaacuagagaaggaagucgcugagacucagcacgguaccgugcucguucagaucaaguacgagggcacggacgcgccuugcaaaauuccauuuucuacacaagaugaaaagggggugacccagaacggacgccugaucacugcaaaucccauaguaacagacaaagagaagccugucaacauugaagccgagccacccuucggcgaguccuauaucgugaucggugcuggggaaaaagcccuuaaguugucaugguuuaagaaaggcaguagcauuggaaagauguucgaggcaaccgccagaggcgcuaggcggauggccauccugggggauacugcaugggacuuuggauccauugguggcguuuucaccucuguggggaaacucguccaucagauauuuggaacagcguacggcgugcuguucagcgguguaucauggacgaugaagaucgggauuggcgugcuucugaccugguugggacucaauagucgauccacuagccugucuaugacauguaucgcuguuggcuuagucacccuguaccuaggggugauggugcaggccgauucaggaugcgucaucaacuggaaaggccgcgaacucaagugugguagugggauuuuuguuacaaaugaggugcacacuuggaccgaacaauauaaguuccaggcagacagcccgaaaagacuguccgccgcuauaggaaaggccugggaggagggcgugugcgguaucaggucugcaacgcggcuugaaaacauuauguggaaacagaucucgaacgaguugaaucauauucugcucgaaaacgacaugaagcugacaguagucgugggcgauguugcugggaucuuagcccagggaaaaaagaugauacgcccucaacccauggaguacaaauauagcuggaaguccuggggcaaggcgaaaaucauuggggccgacgugcagaauaccacuuuuaucauugauggaccaaacaccccugaaugucccgacgaucagagagcuuggaauaucugggaggucgaggacuacggcuucgguauauuuacaacuaacauuuggcugaagcuuagggauucauauacccaggugugcgaccaccguuugaugagugcagccaucaaagauucuaaggcuguucacgccgacaugggguacuggauugaaagcgagaaaaaugaaacauggaagcucgcacgggcguccuucaucgaggugaagacguguauauggccaaaaucacauacccuguggagcaacggaguacuagaaucugagaugaucauucccaagaucuauggcgguccuauuucccaacacaauuaccgaccaggcuacuucacucagacagccgggccguggcaucugggaaaacucgagcuggauuuugaccuuugcgaaggcaccacugucgugguggaugagcacugcgggaacagaggacccaguuugaggacaaccacggucacuggcaagaucauacacgaaugguguugccgcagcuguacccugccuccauuacgguucaaaggugaggacgggugcugguauggaauggagauuagacccguuaaggaaaaggaggaaaaucucgugaaaucuaugguauccgcuggcucaggugagguggacaguuuuagccugggccuucuguguaucucgaucaugauugaagaggucaugaggucccgcuggucucgaaagauguugaugacagggacccucgccguguucuuucugcuaaucaugggacagcugacuuggaacgaucucauucggcugugcauaaugguuggcgcaaaugcuagcgaccguauggggaugggaacaaccuaccuugccuugauggcaacauucaaaaugagaccuauguuugccgugggccuguuauucaggcgccucacuucacgggagguccugcuucugaccaucggucuaagucucguggcuuccguugaacugccaaacucuuuggaggaacugggggauggauuagcgaugggcauuaugauccucaagcugcuuacggacuuucaaagccaucagcugugggccacauugcucucccugaccuucauuagaacuaccuuuucacuacacuaugcauggaaaacaauggcuauggugcugagcaucgucagucuuuucccccucugucugucuacuaccucccagaagacgacaugguugccgguacuguuaggcagccucgggugcaagccucugaccauguuucuuauagccgagaauaaaaucuggggaaggaagucguggccacugaacgaagguauuauggccgugggcaucguuucaauuuugcucucuagucugcuaaaaaacgaugugccccuggcugggccucuuaucgcaggaggcaugcucauagccuguuacgucauuuccgguagcucugcggaccugagcuuggagaaggcugccgagguguccugggaagaggaagcagagcauucaggggccagucacaauaucuuaguagaagugcaggaugacggaacuaugaaaaucaaggaugaggagcgagacgauacacugaccauucuccugaaagcuacucuucuggcagucagcggcguuuaucccuugucuauaccagccacacuauucgugugguacuucuggcaaaagaagaaacagcgcuccggcgugcugugggacaccccuucacccccagaagucgagcgggcggugcucgaugacgggaucuauagaauuaugcagaggggacugcuuggucguagucagguuggcguagggguguuucaagaaaacgucuuccauacgauguggcacgugacucgcggagcuguuuuaauguaccagggcaagcggcuggagccgagcugggccuccgugaaaaaggaccucaucucuuacggugggggauggagauugcagggcucguggaauaccggcgaggaaguccaggugauugcaguagagccugggaaaaaccccaagaauguccaaacagccccaggaaccuuuaagacaagcgaaggugaggugggcgcuaucgcccuggauuucaaacccgggacuucaggauccccuauaguuaacagggaaggcaagaucgugggucucuaugggaauggagucgugaccacgaguggcacauacguuucugcaauugcucaggccaaagcgagccaggagggcccacugcccgagaucgaagacgagguguuucgaaagcggaaccuuacuauuauggaucugcacccuggguccggaaaaacccgcagauauuugccggccaucgucagggaagcaauaaagcggcgacuaagaacacugauucucgcuccaacccgcgugguagccucagagauggcugaagcauuaaaggguaugcccaucagguaccaaacuaccgccgugaaaucugagcauacaggcaaggagaucguugaccugaugugccacgccacguucacuaugcgucuucugagcccuguccgggugccaaauuauaacaugauuaucauggaugaagcucauuuuaccgaccccaguuccauagcggcaagaggguacauuagcacaagggugggaaugggcgaggccgcugccaucuucaugaccgcaacuccuccggguucugucgaagccuuuccccagucaaaugcuguaauucaggaugaggaacgcgacaucccagagcgauccuggaacaguggguaugaguggauaacagauuucccuggaaaaaccgugugguuuguucccagcauuaagucgggcaaugacaucgcgaacugucucagaaaaaauggcaagcgggugauccaguugucuaggaagacguucgauacugaauaccaaaaaacaaagaacaacgacugggacuacgucgugaccaccgauauuuccgagaugggggccaauuuccgcgcagaccguguuaucgauccaagacggugccugaaaccugugauucucaaggacggacccgaaagggucauacuggcugguccaaugccggugacuguagccagcgcagcccagcgccgaggcagaaucgggcggaaccacaauaaagagggagaucaguauauuuacaugggccagccucuuaacaaugacgaggaucaugcucacuggacagaagccaagaugcuacuggacaacaucaauacccccgaggguaucauuccagcguuguuugaacccgagagggaaaagucagcagccauagauggggaguaucgcuuaagaggcgaggcuaggaaaacauucguggaacugaugcggcguggagaccucccuguuuggcugaguuacaaggucgccucugagggcuuucaauauuccgaucgccgauggugcuucgacggggaaagaaacaaucaggugcuugaggaaaacauggauguggagaucuggacuaaagagggagaaaggaagaaacugcggccacgcuggcucgacgcuagaacguacagcgaccccuuggcacugagggaguuuaaggaauucgccgcuggucggcgaucagucaguggcgaucuaauucuggagaucgggaaacucccucagcaccuuacccagagagcccaaaaugcacuggacaacuuaguuauguugcauaauagcgaacagggaggccgcgcguauaggcacgccauggaggagcugccggauacaauugaaacucucaugcugcuugcucugaucgccgugcucaccggugggguaacauuguuuuuccuguccggccggggauuaggcaagaccucuauagggcuacugugugugauggcaagcuccguccuccuuuggauggcuucaguggagccacauuggaucgccgcaucuauuauccuggaauuuuucuugaugguucugcucauucccgagccugaccgucagagaacuccccaggauaaccaacuggccuacguggucaucggacuucucuuuaugauacugacgguagcugcgaaugagauggguuugcuggaaaccacaaagaaagacuuaggcauugggcacguggccguugagaaccaccaucacgcagcuaugcuagauguggaccugcauccagccagugccuggacucucuacgcagucgcuaccacaaucauuaccccuaugaugaggcacacuaucgaaaacacaacggccaauauaucgcuuaccgcgaucgcuaaccaggccgcaauucugaugggauuggauaagggcuggcccaucagcaaaauggacauuggugugccacugcucgcccuggggugcuauucccaggucaauccucuuacuuuaacagcugcagugcugaugcucguugcccauuacgcgaucauaggcccgggauugcaagcuaaggccacccgcgaggcacagaaacggaccgccgcuggcauuaugaagaaccccacaguggaugggaucguagccaucgaccuggauccaguggucuaugacgcaaaguucgaaaaacagcuaggacagauuaugcugcucauccuuuguacuucucaaauacuguugaugcgaacgaccugggcucugugcgagucaauuacacucgccacuggcccucugaccacauuaugggaggguagccccgggaaguuuuggaauaccacuaucgcgguuuccauggccaacauuuucagaggaaguuaccuugcaggcgcuggucuggccuucucucucaugaaaagccuaggcgggggaaggcgcggcacgggggcacagggagaaacacugggcgagaaguggaaacggcaguugaaucagcugucaaaguccgaauuuaacaccuauaagagaagugguaucauggagguggaccguagcgaagcuaaagaggggcucaagaggggagagacuaccaaacacgccgucucucggggcacagccaagcuucgcugguucguggaacgaaaucugguaaaaccagaggguaaggugauagauuugggcugugggagaggaggcugguccuacuauugcgcggggcugaagaaaguuacugaagugaagggauacaccaaaggcgguccugggcacgaggaacccaucccgauggcuacauacggauggaaccucgucaaguuacauucaggcaaagacguguuuuucauuccaccugagaagugugauacgcugcuuugcgacaucggcgagagcucgcccaauccaaccauugaagaggggaggacucugcggguccuaaaaaugguggaacccuggcuccgcggaaaccaauuuuguaucaagauucugaauccuuauaugccgucuguuguagagacauuggagcagaugcagagaaagcacgguggcaugcuggugaggaacccccucagucgaaauuccacccaugaaauguacugggucagcugcgggacuggaaacaucgugucagcaguuaauaugacaucccggaugcuucugaaccguuucaccauggcccacagaaaaccaacguaugagcgcgauguggacuuaggcgcugguaccaggcacgucgccguggaaccugagguagcaaaccuggauauaauugggcagcggaucgaaaauaucaagcaugagcacaaaucuacauggcauuacgacgaggauaaccccuauaagacuugggccuaccacggaagcuaugaagugaaaccuaguggcuccgcuagcucuaugguuaauggcgucgugaaguugcucaccaagccaugggacgugauucccauggucacacaaauagcgaugacugauaccacaccuuuugggcagcagagaguuuucaaagagaagguggacacccgcacuccaaaagccaagaggggaacggcacaaaucauggaaguaacagcuaaauggcugugggguuuucuaucacgaaacaagaagccccggauuuguaccagagaggaauucacuaggaaagugcgcaguaaugccgcaaucggcgccgucuuuguggacgagaaccaguggaauuccgcuaaggaggccguugaagaugagcguuucugggaccuugugcaucgggaaagagagcugcacaaacaggggaagugcgcgaccugcgucuacaacaugaugggaaaaagggaaaagaagcucggcgaguuugguaaagcaaaggggagccgcgccauuugguacauguggcugggagcucgauucuuggaguucgaagcccugggcuuuaugaaugaggaucacugguucucucgggaaaacucgcucucaggcguggagggggagggacuucauaaacuggguuauaucuuaagagacauaagcaagaucccgggcgggaauauguacgcagaugacacagcuggaugggauacgaggauuaccgaagacgaucugcagaacgaggccaaaaucacugacauuauggaaccugagcacgcuuugcucgccaaguccaucuuuaaacugacauaucaaaauaagguaguucgcgugcagagaccagcaaagaacggcaccgucauggaugugauaagucggagggaccagcgugguucugggcaggugggaacuuacggccuaaauacauucaccaacauggaagcgcaacuuauucgacagauggagagcgagggcaucuuuucccccucagaacuggagacaccuaaccucgccgggcgcguccuggauugguuggaaaaacauggaguugagagauuaaagcggauggcuaucaguggugacgacugugugguaaaaccaauugaugacagguucgccacugcacugaccgcucucaaugauaugggcaaggugcgcaaagacauaccccagugggaaccgucuaagggguggaacgauuggcagcaagucccuuuuugcagccaccacuuccaucagcuuaucaugaaggacggaagagagauugugguucccugucggaaucaggaugagcuggugggcagggcccgagucucccagggugcaggguggucacuacgugaaacggccugccugggaaaaagcuaugcgcaaauguggcagcucauguacuuucacagacgcgacuugcggcuggcugccaacgcaaucuguucugccgugccaguagauuggguuccuaccuccaggacaacuuggaguauucaugcucaccaucaguggaugaccacagaggacaugcuuagcguguggaauagagucuggaucgaagagaaccccuggauggaagauaagacucacgugucguccuggggcgacguuccauaucugggcaaacgcgaggaccaauggugcgggucucucauaggauuaaccgcccgggcaacgugggcuacaaauauccagguggccauuaaccaggucaggcgacuguuggguaaugagaacuaccuggauuacaugaccucaaugaagagauucaaaaaugaaagcgaccccgagggcgcgcucugguga

SEQ ID NO: 13748 - RNA, 9879 nt, Artificial Sequence
  derived and/or modified CDS sequence (opt3) from DENV-1__FJ898385__SS-prME
agcgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauuaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcggggugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguauuagcaucaugaucgaagaggucaugaggucgcgcuggucccgaaagaugcucaugaccggaacucuggcuguguuccuacugcucauuaugggccagcugacauggaacgaccuuauccgguugugcauuaugguuggggccaaugcaucugaucguaugggaaugggcaccacauaucuggcuuuaauggccacuuuuaaaaugagaccuauguucgcagugggucuccuguuuaggcgccuuaccagccgggagguccugcuacucacgauagggcugucauugguggccaguguugaacugccaaacuccuuagaggaacucggagacggccuggcuaugggcaucaugauucuuaagcuguugacagauuuccaaucucaccagcucugggcgacccugcuaagccugacuuuuaucaaaaccacacuuucccuccauuacgccuggaagacuauggcaaugauucugucaaucgugagcuuguucccccuguguuuaaguaccacgucucagaagacaaccuggcucccgguccugcuugggucccugggaugcaaaccuuugacuauguuucucauagcugagaauaagaucugggguagaaaaagcuggccacugaacgaaggcauuauggccguaggggugguuucgauccuacugucaucucuucucaagaacgacgugccccuggccggaccuuugauugcuggcgguauguuaaucgcauguuaugucauaaguggguccagcgccgaucugucucucgagaaagcggcugaggugagcugggaagaggaagccgagcacuccggagcaucacauaauauucugguagaagugcaggacgauggcacaaugaagaucaaagacgaggagagggaugacacccuuacuauccuguugaaggccacacuacuggcugucaguggcguuuacccccucagcauuccagcaacccuguucgugugguauuuuuggcaaaagaaaaagcagcgaucuggggugcuuugggauacgccuucacccccagaagucgagcgcgccguguuagacgauggaauauaccggaucaugcagagaggucugcucggcaggagccagguugggguaggaguguuccaagaaaacgucuuccacacuauguggcacgugacccguggcgcgguuuugauguaucaggguaaacgccuggagccgaguugggcuagcgugaagaaagaccucauuuccuacgggggaggcuggcggcugcagggcucuuggaauaugggggaggaaguccaggugaucgccguagagccuggaaagaaccccaagaauguccaaacagcaccagguaccuuuaaaacacccgaaggcgaggugggggccauugcucuugacuucaagccuggaacuucgggcagcccaaucguuaacagagaagguaaaauaguggggcuguacggaaauggcgucgugaccacgucaggcacauauguuuccgccaucgcacaggcuaaggccagucaggaggggcccuugccugagauugaagaugagguguuuaggaaacgaaaccuaacuaucauggaccugcauccgggaucugguaagacccggcgcuaccucccagcgauugucagagaagccaucaagaggaaauuacggacacugauacuugcacccacccgagugguagcuagcgagauggccgaagcucugaagggcaugccuauuagauaucaaacuaccgcagugaaauccgagcacacagggaaggagaucguugaucucaugugccaugccacguucacuaugcgcuugcugucaccagucagggugcccaauuacaacaugaucauuauggacgaagcccacuuuaccgauccuucuagcaucgcugcgcguggauauauaaguacacgggugggcaugggugaggcagccgcuauuuucaugaccgccacuccgcccggguccgucgaagcauuuccacagagcaaugccguaauccaggacgaggaaagagauauuccugagaggucuuggaacucaggauacgaguggaucacagacuuccccggcaaaaccgugugguuuguuccauccauaaagaguggcaaugauauugcuaacugucuccgcaagaaugggaaacgagugauccagcugagcagaaagacguucgacacugaauaucagaaaaccaagaacaacgauugggacuacgucgugaccaccgacaucucggagaugggagcgaauuuucgggccgauaggguuauugacccucgccguugccuuaaacccgugauccuaaaggaugguccagaaagagucauucuggcaggcccgaugccugugacuguagcuucugccgcacagcggagggggcgcauaggacgaaaccauaauaaggagggcgaccaguacaucuauaugggucagcccuugaacaaugaugaggaccacgcccacuggacagaagcuaaaauguuacuggauaacauuaauaccccagaggggaucauccccgcccucuucgaaccugagagagaaaaguccgcggcaauugacggcgaguaccggcugaggggagaggcccgcaaaacauucguggaacuuaugagaaggggcgaucugccaguuuggcucagcuauaaggucgcuucagagggguuucaauacagugaccggcguuggugcuucgauggagaacgcaacaaucagguguuggaggaaaacauggacguggagauauggacuaaagagggugaacgaaagaaacugagacccagguggcuagaugcccggacguauucugacccucuggcucuccgcgaguuuaaggaguucgcagccggcagaagguccgucagcggggaccuuauccuggagauuggaaaguuaccgcagcauuugacccagcgggcucaaaaugcccuggauaaccucguuaugcugcacaauucagaacagggcggucgagcauacagacaugcgauggaggagcuuccagacacaaucgaaacucugaugcucuuggcccugauugcuguguuaaccgggggcguaacacuauuuuuccugaguggacgcggccucgggaaaaccagcaucggacuucugugugugauggccuccucugucuugcuguggauggcaagcguggagccccacuggauagcugccuccaucauucucgaauuuuuccugaugguucuucucaucccugagcccgauaggcagcggacuccacaggacaaccaacuggcauauguggucauugguuugcuguuuaugaucuuaacgguagccgcuaaugagaugggccuacuggaaaccacaaagaaagaucucgggauaggacacguggcgguugagaaccaucaccaugccacuaugcuugacguggaucugcacccugcaucagcuuggaccuuguacgccgucgccacaaccauuaucacucccaugaugcgucauacaauugaaaacacgaccgcaaauaucucucugacugcuauagccaaccaggcggcuauccucaugggccuggacaaggguuggccaauuaguaaaauggauaucggggugccucuuuuagcccugggcugcuacucgcaggucaauccgcucacauugaccgcagccgugcugaugcuaguugcucacuaugcaauuaucggacccggccugcaagccaaggcgaccagagaggcucagaagaggacagccgcagggauaaugaaaaacccaacuguggacggaauuguagccaucgaucucgacccuguggucuacgaugcuaaguucgaaaaacagcuuggccagaucaugcuguugauucuguguacgagccaaauccuccugaugcgcaccacaugggccuuaugcgaguccauaacucuugcaaccgguccccugacaacccucugggaggggucuccaggaaaguuuuggaauacuacgauugcuguuucaauggccaacaucuuccggggcagcuaucuagcgggugccggccuggcauuuuccuugaugaaaagucuagggggaggccgaagagggacaggagcucagggcgaaacccucggugagaaguggaagaggcagcuuaaucagcugucuaaaagcgaguucaacauuuacaagcgcucagggaucauggagguggaccgguccgaagccaaagagggauugaagagaggcgagacuacccgucacgcagucaguagggguacagcuaaacugcggugguucguggaacgcaaucucguaaagccugagggcaaggugauagacuuaggguguggacgaggcggguggagcuauuacugcgccggacugaaaaagguuacugaagugaaaggcuauaccaagggugggcccggacaugaggaaccgaucccaauggccacauacggcuggaaccuugucaaacugcacucuggcaaggauguguuuuucacgccucccgagaaaugugacacccuacucugcgauauuggggaguccucaccaaaucccacuaucgaagagggaagaacacugagggucuugaagaugguggaaccuuggcugcgggguaaccaauuuuguauuaagauccucaauccguacaugcccagcguuguagagacccuugagcagaugcagcgcaaacauggcgggaugcuggugagaaacccauuaucgagaaauucuacucacgaaauguauugggucaguugcggaacaggcaacauuguguccgcgguuaauaugaccagccgaaugcuguugaaccgguucacgauggcucaccguaagccuaccuacgagagagacguggaucucggugcagggacacgccaugucgccguggaacccgagguagcuaaccuggacaucauaggacagaggauugaaaauaucaaacacgagcauaagucaacuuggcacuaugaugaggacaacccuuacaaaaccugggccuaucauggcuccuacgaagugaagccaucuggcagcgcaaguuccaugguuaauggggucgugaagcuacuuacaaaacccugggaugugaucccuauggucacucaaauugccaugaccgacacaaccccauuuggacagcagcggguuuucaaggagaaaguggauacuagaacgcccaaggcuaaacgcgguacagcgcaaauaauggaaguaaccgccagguggcuguggggcuuucucagccgaaacaagaagccgcggaucuguacuagagaggaguucaccaggaaagugcgcucuaaugcagcuauuggggccgucuuuguggacgagaaccaguggaacucagcaaaggaggccguugaagacgagcguuucugggaucuggugcagaaagaacgggaguugcacaagcagggaaaaugcgcuacaugcgucuauaacaugaugggcaagagagaaaagaaacugggugaguuugggaaggccaaaggaaguagggcgaucugguacauguggcucggcgcacgcuuccuugaguuugaagcccugggcuucaugaaugaggaccacugguucucccgagaaaacagcuuaucugggguggagggagagggucugcauaaguugggcuacauucuccgggauaucucgaaaauaccugggggaaauauguaugcugacgauacggccggcugggacaccagaaucacugaagaugaccugcaaaacgaggcaaagauuacagauaucauggaaccagagcacgcucuacuugccaccucaauuuuuaaacugacuuaccagaauaagguaguuagggugcagcgccccgcuaagaacgguacagucauggacgugaucagcagacgggaucagaggggguccggacaagugggcaccuauggccucaauacauucacuaacauggaagcccagcugauacgucagauggagagugaggggauauuuucuccuagcgaauuggagaucccaaacuuagcagaacgaguccuggacuggcucgagaaauacggaguugaacgccuuaagagaauggcgaucuccggugaugacugugugguaaaacccauugacgaucgguucgccaccgcucugacggcccuaaaugacaugggcaaggugaggaaagaugucccgcagugggagccuucaaagggguggaacgacuggcaacaggugcccuuuugcagucaucacuuccaccagcugauaaugaaggauggacgcgagaucguugugccauguagaaaucaggacgaacucgucggccgggcaagggugucucaaggugcuggguggagcuugcgagagaccgccugccugggaaaauccuaugcacagauguggcagcuuauguacuuucaucguagagaucugcgccucgccgcgaacgcuauuuguucagccguaccuguugacugggugcccacaagccggacuaccuggucuauccacgcacaucaccaauggaugacaacugaagauauguuauccgucuggaauaggguguggauugaggaaaacccauggauggaggacaagacccauguuaguagcuggggcgaugugcccuaucugggcaaaagagaggaccaguggugcgggucguugaucggacugacggcccgcgcuacaugggccuccaauauacaggucgcaaucaaccaggugcggaggcucauugguaaugaaaacuaccuugacuacaugaccucuaugaagcgauucaaaaaugagggcgauccugaaggggcucugugguga

SEQ ID NO: 13749 - RNA, 9879 nt, Artificial Sequence
  derived and/or modified CDS sequence (opt3) from DENV-1__GQ868608__SS-prME
agcgugaccaugcugcucaugcuuaugcccaccgcacuggcuuuccacuugacuacgagaggaggggagccucauaugaucgucuccaagcaggaaaggggaaaaucuuuacuguuuaagaccucagccgguguuaacaugugcacccugauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaagcauggcuagugcauaagcagugguuccuggaucucccgcugcccuggaccuccggcgcuucaacuagccaagagacauggaaucggaaagaccuucugguaaccuuuaagacagcccacgcuaagaaacaggaaguuguggucuuggguagucaggagggggccaugcacacugcacucaccggcgccacggaaauccaaaccucuggaacaacuaccaucuucgcuggccaucugaagugccguuuaaaaauggauaagcugacacuaaaagggauguccuaugugauguguacugggagcuucaagcucgagaaggaagucgcggagacccagcacgguacggugcugguucagauuaaauacgagggcacagacgcaccuugcaagauaccauuuucgacccaggaugaaaaaggggugacucaaaacggacgccuuaucacagccaaucccauuguaaccgacaaggagaaaccugucaacaucgaagcugagccacccuucggcgagucuuauauagugauuggugccggggaaaaggcauugaagcuguccugguuuaaaaagggcucaaguaucggaaaaauguucgaggccacugcuagaggcgccaggcggauggcaauccucggggauaccgcgugggacuuuggaagcauugguggcguuuucacauccguggggaagcugguccaucagaucuuuggaacggcuuacggcgugcuuuucucugguguaagcuggaccaugaaaauugggauaggcgugcuguugacuuggcucggacuaaauucacgaaguacauccuuaagcaugaccuguaucgccguuggccuggucacacuauaccucggggugauggugcaggcagauucuggaugcgucauuaacuggaagggccgcgaacugaagugugguucagggaucuuuguuacuaaugaggugcacaccuggacggaacaguauaaauuccaagccgacaguccgaagagacuuagcgcugccaucggaaaagcauggaaggagggcgugugcgguauuagguccgcuacacgguuggagaacauaauguggaaacagaucucuaacgaacugaaucauauucuccuggagaacgacaugaaguuuaccguagucgugggcgauguugccgggaucuuagcgcagggcaagaagaugauucgcccucagcccauggaauacaaguauucguggaaaagcuggggcaaggccaaaaucauaggggcugacgugcaaaaugcaacuuucaucauugauggaccaaacaccccugagugucccgacgaucagagagccuggaauaucugggaagucgaggacuacggcuuugguauuuucacaacuaacaucuggcugaaacuuagggauuccuauacccaggugugcgaccaccguuugaugucagcugccauaaaagauaguaaggcaguucacgcggacaugggguacuggauugagucugaaaagaaugagacauggaaacucgcccgggcuagcuucaucgaagugaagacguguauuuggccaaaaucccauacccuguggucaaacggaguacuagagagcgaaaugaucauacccaagaucuauggcgguccuauuucucagcacaauuaccgaccaggcuacuuuacucaaacagccgggccguggcaucugggaaaacucgagcuggauuucgaccuuugcgagggcaccacugucgugguggaugaacacugcgggaacagaggacccuccuugaggacaaccacggucacuggcaagaucauucacgagugguguugccgcaguuguacccugccuccauuacgguuuaagggugaagacgggugcugguauggaauggagaucagacccguuaaagagaaggaagagaaucucgugaaaagcaugguaucugcaggcuccggugaaguggacucauucagucugggccuucuguguauaagcauuaugaucgaggaagucaugaggucgcgcuggucccgaaagauguugaugacagggacccucgcuguguuuuuccugcuaaucaugggacagcugacuuggaacgaucucauucggcugugcaucaugguuggcgccaaugcaucugaccguauggggaugggaacaaccuaccuugccuugauggcuacauuuaaaaugagaccuauguucgcggugggccuguuauuuaggcgccucacuagccgggagguccugcuucugaccauuggucuaucacucguggccaguguugagcugccaaacuccuuggaagaacugggggauggauuagcaaugggcauaaugauccucaagcugcuuacggacuuccagucucaucaacugugggcuacauugcucagccugaccuuuauuaagacuaccuucucccuacacuaugccuggaaaacaauggccauggugcugucaaucgucagccuuuuuccccucugucugaguacuaccucucagaagacgacaugguugccgguacuguuaggcucccucgggugcaaaccucugaccauguuccuuauugcugaaaauaagaucuggggaagaaaaagcuggccacugaacgaggguauaauggcagugggcaucguuucgauuuugcucucaucucugcuaaagaacgaugugccccuggccgggccucuuaucgcgggaggcaugcucauugcuuguuacgucaucagugguuccagcgccgaccugucuuuggaaaaagcagccgaggugagcugggaggaagaggcugaacauuccggggcaucacacaauauauuaguagaggugcaggaugacggaacuaugaagauuaaggaugaagagagggacgauaugcugacaauccuccugaaagccacccuucuggcggucaguggcguuuaucccuugagcaucccagcuacucuauucgugugguacuuuuggcagaagaaaaagcaacgaucuggcgugcugugggacacaccuucacccccagaggucgaacgcgccgugcucgaugacgggauuuaucggauaaugcagagaggacugcuugguaggagccagguuggcguagggguguuccaggagaacgucuuucauaccauguggcacgugacgcguggagcaguuuuaauguaccaaggcaaacgccuggaaccgaguugggccagcgugaagaaggaccucaucuccuacggugggggauggcgguugcagggcucuuggaauacuggcgaggagguccaggugauugcuguagaaccugggaaaaaccccaagaauguccagaccgccccaggaacauucaaaaccucggagggugaagugggcgcaaucgcucuggauuuuaagcccgggacaagcggaucaccuauuguuaacagagagggcaaaaucgugggucucuaugggaauggagucgugacuaccuccggcacguacguuagugccauagcgcaagccaaggcaucucaggaaggcccacugcccgagaucgaggacgaaguguucaggaagcgaaaccuuacaauuauggaucugcacccugggagcggaaaaacucggcgcuauuugccggcuaucgucagagaggccauuaagaggaaacuacggacccugauccucgcuccaacacgagugguagcauccgaaauggccgaggccuuaaaggguaugcccauaagauaccagaccacugcugugaaaucagaacauaccggcaaggagauuguugaccugaugugccacgcgacauuuacgaugcgccuucugucuccugucagggugccaaauuauaacaugaucaucauggaugaggcacauuucacugaccccagcaguauugccgcucguggguacaucuccacccgggugggaaugggcgaagccgcagccauauuuaugacagcuaccccuccggguagcgucgaggcguucccccaaucuaaugccguaauucaggaugaagagagagacaucccagaaaggucauggaacuccggguaugaguggauuacugauuuuccuggaaagacagugugguucguucccaguaucaaaagcggcaaugacauagcaaacugucuccgcaagaauggcaaacgagugauucaguugucgagaaagaccuucgauacggaguaccagaaaacuaagaacaacgacugggacuacgucgugacaaccgauaucucugaaaugggggcuaauuuucgggccgacaggguuaucgauccacgccguugccugaagccugugauucucaaagacggacccgagagagucauccuggcagguccaaugccggugaccguagccuccgcugcccaacggaggggccgcauugggcgaaaccacaauaaggaaggagaucaguauauauacaugggccagccucuuaacaaugacgaggaucaugcgcacuggacugaggcaaaaaugcuacuggacaacaucaauacacccgaagguauuaucccagccuuguucgagcccgaaagagaaaaguccgcugccaucgauggggaauaucgguuaaggggcgaggcucgcaaaaccuuuguggagcugaugagaaggggagaccucccuguuuggcugucauacaaggucgcaagugaaggcuuccaguauucugaucggcguuggugcuuugacggggagcgcaacaaucaagugcuugaagagaacauggauguggaaauuuggacaaaagagggagagcgaaagaagcugagaccaagguggcucgacgcccggacuuacuccgaccccuuggcucugcgcgaguucaaagaguuugccgcagguagaaggagcgucucaggcgaucuaauacuggaaaucgggaagcucccucagcaccuuacgcagcgggcgcagaaugcccuggacaacuuaguuauguugcauaauagugagcaaggaggccgagcuuauagacacgccauggaggaacugccggauaccauugagacacucaugcugcuugcacugaucgcugugcucacuggugggguaaccuuguucuuucugagcggccgcggauuaggcaaaacauccauugggcuacugugugugauggccucuagcguccuccuuuggauggcauccguggaaccacauuggaucgccgcuucaauaauccuggaguucuuuuugaugguucugcucauucccgaaccugacaggcagcggacaccccaggauaaccagcuggcguacguggucaucggacuucucuucaugauucugacuguagccgcaaaugagauggguuugcuggagacgaccaagaaagacuuaggcaucgggcacguggcuguugaaaaccaccaucacgccgccaugcuagauguggaccugcauccagcaucugcuuggacacucuacgccgucgcgacuaccauaauuacaccuaugaugcgucacaccaucgagaacacuacagcuaauauuagucuuacggccaucgcaaaccaagccgcuauacugaugggauuggauaagggcuggcccaucucgaagauggacauuggugugccacugcucgcacuggggugcuauagccaggucaauccucuuaccuuaacugccgcggugcugaugcucguugcucauuacgccaucauuggcccgggauugcaggcaaaagccacaagagaagcucaaaagaggaccgccgcaggcaucaugaaaaaccccaccguggaugggauaguagcuauugaccuggauccaguggucuaugacacaaaguuugagaaacagcuaggacagaucaugcugcucauccuuuguacuucccagauucuguugaugcgcacgaccugggcccugugcgaaucuaucacacucgcgacuggcccucugaccacauuaugggaggguucacccgggaaguucuggaauaccacuauagccguuagcauggcaaacauuuuccggggauccuaccuugcuggcgccggucuggcauuuagucucaugaagucucuaggcgggggacgaagaggcacgggggcucaaggagagacacugggcgaaaaauggaagaggcaguugaaucagcugagcaaaucagaguucaacaccuauaagcgcuccgguaucauggaaguggaccggagugaggccaaagaagggcucaagagaggagagacuaccaagcacgccgucagccguggcacagcgaaacuuaggugguuuguggagcggaaucugguaaagccagaagguaaagugauugauuugggcugugggcgcggaggcuggucuuacuauugcgcugggcugaagaaaguuacugaggugaagggauacaccaaaggcgguccugggcacgaggagcccaucccgauggcaacauacggauggaaccucgucaaguuacauuccggcaaggacguguucuuuauaccaccugaaaaaugugauacgcugcuuugcgacaucggcgagucaagccccaauccaaccauugaggaagggcgaacucugagaguccuaaagaugguggagcccuggcucaggggaaaccaguucuguaucaaaauucugaauccuuauaugccgucgguuguagaaacauuggagcaaaugcagcggaagcacgguggcaugcuggugcgcaacccccucucuagaaauaguacccaugagauguacugggucuccugcgggacuggaaacaucgugagcgccguuaauaugacaucaaggaugcuucugaaccgauuuaccauggcucaccggaaaccaacguaugaacgugauguggacuuaggcgccgguaccagacacgucgcaguggagccugaaguagccaaccuggauauuaucgggcagcgcauagagaauauuaagcaugaacacaaguccacauggcauuacgacgaggauaaccccuauaaaacuugggcuuaccacggaucuuaugaggugaagccuagcggcagugcguccagcaugguuaauggcgucgugaaauugcucaccaagccaugggacgugauccccauggucacacagaucgccaugacugauaccacaccuuucgggcaacagaggguuuuuaaagaaaagguggacacccggacuccaaaggcaaaaagaggaacggcucagauuauggagguaacagccaaguggcugugggguuuccuaucucgcaacaaaaagcccaggauauguacccgagaagaguuuacucggaaagugagaucaaaugcagccaucggcgcugucuucguggacgaaaaccaauggaauagugccaaggaggcgguugaggaugaaagguuuugggaccuugugcaucgcgagcgugaacugcacaagcaggggaaaugcgcaaccugcgucuacaacaugaugggaaagcgggagaaaaagcucggcgaguucgguaaagccaagggguccagagcuauuugguacauguggcugggagccagguucuuggaguuugaggcacugggcuucaugaaugaagaucacugguuuagccgcgagaacucucucucgggcguggaaggggagggacuucauaaacuggguuauaucuuacgagacauuucaaagaucccgggcgggaauauguacgcugaugacacagccggaugggauacgcggauaaccgaggacgaucugcagaacgaagcuaagaucacugacauuauggagccugaacacgccuugcucgcaaaaagcaucuucaagcugacauaucagaauaaaguaguuagagugcaaaggccagcgaagaacggcaccgucauggaugugauuucccgcagagaccagcgggguaguggacaggugggaacuuacggccuaaauacauuuaccaacauggaggcccagcuuaucaggcaaauggaaucugagggcauauucagccccuccgagcuggaaacaccuaaccucgcugggcguguccuggauugguuggagaaacauggaguugaacgauuaaagcgcauggccauuucaggugacgacugugugguaaagccaaucgaugacagauuugcaacugcucugaccgcccucaaugauaugggcaaagugcggaaggacaucccccagugggagccgaguaaaggguggaacgauuggcagcaggucccuuucugcucucaccacuuucaucaacuuauuaugaaggacggaagggaaauagugguucccugucgcaaucaggaugagcuggugggcagagcacgggucagccagggugccggguggucccuaagggagacggcgugccugggaaaaucauaugcucagauguggcaacucauguacuuccaccgacgugacuugagacuggccgcaaacgccaucuguagcgcugugccaguagauuggguuccuaccucucgcacaacuugguccauucaugcccaccaucaguggaugaccacagaagacaugcuuaguguguggaaucgggucuggaucgaggaaaaccccuggauggaggauaagacucacauuagcucguggggcgacgugccauaucugggcaagagggaagaccaguggugcgggucccucaucggauuaaccgcaagagcuacgugggccacaaauauacaaguugcgaucaaccaggugcgccggcugauugguaaugagaacuacuuggauuacaugaccucuaugaaaagguuuaagaaugagaucgaccccgaaggcgcucugugguga

SEQ ID NO: 13750 - RNA, 9879 nt, Artificial Sequence
  derived and/or modified CDS sequence (opt3) from DENV-1__GQ199774__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggagaacugugugaagauacuaugaccuacaaaugcccacggauaacagagguggaaccggacgauguggacuguuggugcaauaccacugauacaugggugaccuaugggacguguagucagacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaagacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgauugcuacaaucacaccccaggccccuacuagcgagauccagcugaccgacuacggggcgcucacacuugauuguucuccaagaaccggacuggacuucaacgaaaugguguugcuaacuaugaaagagaaguccuggcugguacauaaacagugguuucucgaucugccgcuucccuggacaucaggcgccagcacgagucaagagaccuggaauaggcaggaccuguugguuacuuucaagacagcacacgcuaagaaacaggaaguggucgugcucgguucucaagagggggccaugcacaccgcucugacaggcgccacugaaauucagaccacgggaaccacaacuauauuugcaggccauuuaaagugccggcugaaaauggauaagcuaacccucaaagggauguccuaugucauguguacaggcagcuucaagcuggagaaggaaguggccgagacucagcacgguaccguucuugugcagaucaaauacgagggcacggacgcuccuugcaagauuccauucucgacacaagaugaaaaagggguaacccagaacggacguuugaucacugcgaaucccauagucacagacaaggagaaaccugugaacauugaagcagagccacccuuuggcgagucuuauaucguuaucggugccggggaaaaggcucugaagcucuccugguucaaaaagggcucaaguauuggaaaaauguuugaggccaccgcacgcggcgccagaaggauggcuauccugggggauacugccugggacuucggaagcauugguggcguguuuaccuccgucgggaaacuugugcaucagauauucggaacagcauacggcguacuguuuucuggugugagcuggacgaugaaaaucgggauuggcguuuugcucaccuggcugggauuaaauucacggaguacuucccugagcaugacauguaucgcggucggccuaaucacccucuaccugggggugauggugcaggcugauucuggaugcgucauuaacuggaagggccgagaacuuaagugugguucagggauauucguuacaaaugaggugcacacuuggaccgaacaauauaaauuucaggccgacaguccgaagcgcuugagcgcagccaucggaaaggcuugggaggagggcgugugcgguauuagauccgccacgaggcuggaaaacaucauguggcggcagauuucuaacgagcucaaucauauccuguuagaaaacgacaugaaguucacaguagucgugggcgauguuguggggauacuggcacagggcaagaaaaugguccgcccucaacccauggagcacaaauacucguggaaaagcuggggcaaggcuaagaucauuggggccgacgugcagaauaccacuuuuaucauugauggaccaaacaccccugaaugucccgacgaucagagagcguggaauaucugggagguugaggacuauggcuucgguauauuuacaacuaacauuuggcuuaaguugagggauuccuacacccaggugugcgaccaccgucucaugucagccgcuaucaaagauaguaaggcaguacaugccgacaugggguauuggauugaaucugagaaaaaugaaacauggaagcuggcucgggccagcuucaucgaggucaagacguguauauggccaaaaucccacacccuauggucaaacggagugcuggaaagcgagaugaucauucccaagaucuacggcgguccuauuucucaacauaauuaucgaccaggcuacuucacucagacagcagggccguggcaccucggaaaacuggagcuugauuuugacuugugcgaaggcaccacuguggucguugaugagcacugcgggaacagaggacccucccugaggacaaccacggugacuggcaagaucauacaugaaugguguugccgcaguuguaccuuaccuccacuccgguucaaaggugaggacgggugcugguacggaauggagauuagacccguaagggaaaaggaggaaaaucugguaaagagcauggucucugcgggcuccggugagguggacucauuuagucuuggccuguuguguaucagcaucaugauugaagagguuaugcgcucgcgauggucccggaaaaugcucaugacagggacccuggccguguucuuucuacugaucaugggacagcucacuuggaacgaucugauucguucuugcauaauggucggcgcuaaugccagcgacagaauggggaugggaacaaccuaucuugcauugauggcuacauucaagaugaggccuauguuugccgugggccuguuauuccgccggcucacuucaagagagguucugcuucugaccaucggucuaagucucguggcauccgucgaacugccaaacucuuuggaggaacugggggauggauuagccaugggcauuaugauccucaaacugcuuacggacuuucaaagcuaccagcugugggcuacauugcucucccugaccuucauuaagacuaccuuuucacuacacuaugcguggaaaacaauggccaugguacugagcaucgugagucuucucccccuguguuugucuacuaccucccagaagacgacauggcugccgguuuuacucggcagccuggggugcaagccucuuaccauguuccugauagcagagaauaaaaucuggggaaggaagucguggccauugaacgaagguauuauggcugugggcaucgucucaauucuccugucuagucuacugaaaaacgaugugccccuugccgggccucucaucgccggaggcaugcugauagcuuguuacguaauuuccgguagcucugcagacuugagcuuagagaaggccgcggagguguccugggaagaggaagcugagcauucaggggccagucacaauauccuggucgaaguucaggaugacggaacuaugaaaaucaaggaugaggagcgagacgauacacucaccauucugcuuaaagcaacucuguuggccgugagcggcguguauccccuaucuauaccagcuacacuguuugucugguacuucuggcaaaagaagaaacagcgcuccggcgugcucugggacaccccuucacccccagaaguugagcgggcaguacuggaugacgggaucuauagaauuaugcagaggggacuuuuaggucguagucaggugggcgucgggguguuccaagaaaacguuuuucauacgauguggcacgugacucgcggagccguccugauguaccagggcaagcggcucgagccgagcugggcguccgugaaaaaggacuugaucucuuacggugggggauggagacugcagggcucguggaauaccggcgaggaaguacaggucauugcuguggagccugggaaaaaccccaagaauguucaaacagccccaggaaccuucaagacacccgaaggugaggugggcgcaaucgcccucgauuuuaaaccugggacuagcggaucaccaauagucaacagggaaggcaagaucgugggucuguaugggaauggaguugugaccacguccggcacauacgucagugcuauugcccaggcaaaggcuucucaggagggcccccuuccugagaucgaagacgagguguuccgaaagcggaaccugacuauuauggauuugcacccggggagcggaaaaacccgcagauaucuaccagccaucguaagggaagcgauaaagcggaagcugcgaacacucauuuuagcccccaccagagugguugcauccgagauggcugaagcccugaaagguaugccuauccgcuaccaaacuaccgcugucaagucagagcauacaggcagggagaucguggaccuuaugugccacgcaacguuuacuaugcgucugcucucuccagugcggguccccaauuauaacaugauuaucauggaugaagcccauuucaccgacccuagcaguauagccgcuagaggguacauuuccacaaggguaggaaugggcgaggcggcagccaucuuuaugaccgcuacuccgcccgguagcguggaagccuucccacagucuaaugcaguuauucaggaugaggaacgcgacaucccugagcgaucauggaacuccggguaugaguggauaacagauuuucccggaaaaaccgugugguucgucccaaguauuaagagcggcaaugacaucgccaacuguuugaggaaaaauggcaagcgggugauccagcugucgaggaagacguuugauacugaauaccagaaaaccaagaacaacgacugggacuacguugugaccaccgauauuucugagaugggggcuaauuuccgcgcggaccgugucaucgauccuagacggugccucaaacccgugauucugaaggacggaccagaaaggguaauacuugccgguccgaugccugugacuguugcauccgcugcccagcgccgaggcagaaucgggcggaaccacaauaaagagggagaucaguauauuuacaugggccagccccuaaacaaugacgaggaucaugcacacuggacagaagccaagaugcuguuggacaacaucaauaccccagaggguaucauucccgcuuuauucgaaccugagagggaaaagagcgccgcgauagauggggaguaucgccugagaggcgaggcaaggaaaacauuugucgaacucaugcggcguggagaccugccaguguggcuuucauacaagguggccagugagggcuuccaauauucugaucgccgauggugcuuugacggggaaagaaacaaucagguccuggaggaaaacauggauguugagaucuggacuaaagagggagaaaggaagaaacuccggccccgcugguuggacgcuagaacguacuccgacccucuggcccuaagggaguucaaggaauuugcugcaggucggcgaagcgugucaggcgaucugauucucgagaucgggaaacuuccgcagcaccugacccagagagcccaaaaugcuuuagacaacuugguaaugcugcauaauagugaacagggaggccgcgccuauaggcacgcaauggaggagcucccagauacaauugaaacucugaugcuucuggcgcucaucgccguguugaccgguggggucacacuguucuuuuuaagcggccggggacuaggcaagaccuccauagggcugcucugugugauggcuucuagcgcccuucuguggauggcauccguugagccccauuggaucgcugccucaauuaucuuggaguucuuucugauggugcuccugauuccugagcccgaccgucagagaacuccacaggauaaccaacuugcauacgucguaaucggacuccuguucaugauauugacgguggccgcuaaugagaugggucuguuagaaaccacaaagaaagaccuaggcauugggcacguugcgguggagaaccaccaucacgccacuaugcuggaugucgaccuccauccugcaucugcuuggacccuuuacgccguggccacaaccaucauuacucccaugaugaggcacacaaucgaaaacacgaccgcaaauauaagucugacugcuaucgccaaccaggcggcuauuuugaugggacuggauaagggcuggccaaucucgaaaauggacauuggugucccucuccuggcccuugggugcuauagccaggugaauccguuaacacugaccgcagccguucucauguugguggcucauuacgcaaucauaggccccggacugcaagccaaggcgacccgcgaggcucagaaacggacagccgcaggcauuaugaagaacccaacuguagaugggaucguggccaucgaccuagauccugucguuuaugacgcuaaguuugaaaaacagcugggacagauuaugcuccuuauccuguguacgucccaaauauugcugaugcgaaccacaugggcccucugcgagucuauuacucuggcaaccggccccuuaacaacccuuugggaggguucaccagggaaguucuggaauacuacgaucgcugugagcauggccaacauuuuuagaggauccuaccuggcgggcgccggucucgcauucagucuaaugaaaucucugggcgggggaaggcgcggcacaggggcucagggagaaaccuugggcgagaaguggaaacggcagcugaaucagcucagcaagucagaguucaacacuuauaagagauccgguaucauggaggucgaccguagugaagccaaagaggggcuuaggcggggagagaccacaaagcacgcagugagccgcggcacugcuaaacugcgaugguuuguagaaagaaauuuggugaagccugaggguaaaguuauagaucugggcugugggaggggaggcuggucuuacuauugcgccgggcucaagaaggugaccgaagucaaaggauacacaaagggcggucccgggcacgaggaaccgaucccaauggccacguacggauggaacuuagugaaacugcauuccggcaaggacgucuucuuuauuccucccgagaaaugugauacccuucugugcgacaucggcgagucaagcccaaaucccacuauugaagaggggcggacacuacgcgugcucaagaugguugaaccuuggcugagaggaaaccaauucuguaucaaaauuuugaauccguauaugcccucgguaguggagacccuggagcacaugcagaggaagcaugguggcaugcucguccgaaacccacuuucucggaauaguacucacgaaauguacuggguguccugcgggacaggaaacaucguuagcgcggugaauaugaccucacguaugcuguuaaacagauuuacgauggcucaccgcaagccuaccuaugagagggaugucgaccugggcgcagguacacggcauguggccguagaacccgagguggcuaacuuggauauaauugggcagagaaucgaaaauaucaaacacgagcauaaguccacuuggcacuacgacgaggauaacccuuauaaaaccugggccuaccauggaucuuaugaaguuaagccaagcggcagugcauccagcauggucaauggcguggugaaacuccugacaaagcccugggacgucauuccuaugguuacucagauagccaugaccgauacaaccccauucgggcaacagcgcguguuuaaggagaaaguagacacuaggacgcccaaggcuaaacgaggaacagcgcagaucauggaagugaccgcccgguggcuaugggguuuccuuucuagaaacaagaaaccgaggauuuguacucgcgaggaauuuacccguaagguccggucaaaugcagcuaucggcgccguguucguugacgagaaccaauggaauagugcaaaggaggccguggaagaugagagauuuugggaccugguccacagggaacgcgagcuccacaaacaggggaagugcgcuacaugcguguacaacaugaugggaaaacgagaaaagaaacugggcgaguucgguaaggccaaggggucccgggcgauuugguacaugugguugggagcaagauuucuggaguucgaagcccucggcuucaugaaugaggaucauugguuuagcagggaaaacucucuuucgggcguagagggggagggacugcacaaauuagguuauauccugcgcgacauaucaaagaucccuggcgggaauauguacgcugaugacacggccggaugggauaccagaauuacugaagacgauuugcagaacgaggcaaaaaucacagacauuauggaaccagagcaugcucuccuggccaccagcaucuucaagcuaacuuaucagaauaaaguugugcggguccaaaggcccgcuaagaacggcacagugauggaugugauaucccgucgagaccagcgcgguagugggcaggucggaaccuacggccuuaauacauuuacuaacauggaagcccagcugauuagacaaauggagucugagggcaucuucagcccuuccgaacucgagaccccaaaccuggcagaacggguuuuggauugguuagagaaauaugggguggaaaggcugaagcgcauggcgaucucaggagacgacuguguagugaagcccauugaugacagauuugccacggcucucaccgcccuuaaugauauggguaaaguccggaaggacauaccgcagugggagccuaguaaaggcuggaacgauuggcaacaggugcccuucugcucucaccacuuucaucaacugaucaugaaggacgggagggagauuguugugccaugucgaaaucaggaugagcuagucggacgugcaagagugagccagggcgcugguuggucccugcgcgagacagccugccucgggaaaucauacgcacagauguggcaauugauguauuuccaccggagggaccugagacuugccgcgaacgcuaucuguagcgccguaccuguugauugggugcccacuucucgcaccacaugguccauucaugcacaccaucaguggaugacuaccgaagacaugcugagugucuggaaucggguguggaucgaggaaaacccauggauggaggauaagacgcacauaagcucguggggagacguucccuaccucggcaagagggaggaccaguggugcggcuccuuaaucgggcugacagcccgagcuaccugggccacuaauauucaaguggcaaucaaccaggucagacgguugauuggaaaugaaaacuaccuggauuauaugacaucuaugaaaagguuuaagaaugagucagacccugaaggugcucucugguga

SEQ ID NO: 13751 - RNA, 9879 nt, Artificial Sequence
  derived and/or modified CDS sequence (opt3) from DENV-1__GQ199775__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacuaauugccauggaccucggagaacugugugaagauacuaugaccuacaaaugcccacggauaacagagguggaaccggacgauguggacuguuggugcaauaccacugauacaugggugaccuaugggacguguagucagacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaagacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgauugcuacaaucacaccccaggccccuacuagcgagauccagcugaccgacuacggggcgcucacacuugauuguucuccaagaaccggacuggacuucaacgaaaugguguugcuaacuaugaaagagaaguccuggcugguacauaaacagugguuucucgaucugccgcuucccuggacaucaggcgccagcacgagucaagagaccuggaauaggcaggaccuguugguuacuuucaagacagcacacgcuaagaaacaggaaguggucgugcucgguucucaagagggggccaugcacaccgcucugacaggcgccacugaaauucagaccacgggaaccacaacuauauuugcaggccauuuaaagugccggcugaaaauggauaagcuaacccucaaagggauguccuaugucauguguacaggcagcuucaagcuggagaaggaaguggccgagacucagcacgguaccguucuugugcagaucaaauacgagggcacggacgcuccuugcaagauuccauucucgacacaagaugaaaaagggguaacccagaacggacguuugaucacugcgaaucccauagucacagacaaggagaaaccugugaacauugaagcagagccacccuuuggcgagucuuauaucguuaucggugccggggaaaaggcucugaagcucuccugguucaaaaagggcucaaguauuggaaaaauguuugaggccaccgcacgcggcgccagaaggauggcuauccugggggauacugccugggacuucggaagcauugguggcguguuuaccuccgucgggaaacuugugcaucagauauucggaacagcauacggcguacuguuuucuggugugagcuggacgaugaaaaucgggauuggcguuuugcucaccuggcugggauuaaauucacggaguacuucccugagcaugacauguaucgcggucggccuaaucacccucuaccugggggugauggugcaggcugauucuggaugcgucauuaacuggaagggccgagaacuuaagugugguucagggauauucguuacaaaugaggugcacacuuggaccgaacaauauaaauuucaggccgacaguccgaagcgcuugagcgcagccaucggaaaggcuugggaggagggcgugugcgguauuagauccgccacgaggcuggaaaacaucauguggcggcagauuucuaacgagcucaaucauauccuguuagaaaacgacaugaaguucacaguagucgugggcgauguuguggggauacuggcacagggcaagaaaaugguccgcccucaacccauggagcacaaauacucguggaaaagcuggggcaaggcuaagaucauuggggccgacgugcagaauaccacuuuuaucauugauggaccaaacaccccugaaugucccgacgaucagagagcguggaauaucugggagguugaggacuauggcuucgguauauuuacaacuaacauuuggcuuaaguugagggauuccuacacccaggugugcgaccaccgucucaugucagccgcuaucaaagauaguaaggcaguacaugccgacaugggguauuggauugaaucugagaaaaaugaaacauggaagcuggcucgggccagcuucaucgaggucaagacguguauauggccaaaaucccacacccuauggucaaacggagugcuggaaagcgagaugaucauucccaagaucuacggcgguccuauuucucaacauaauuaucgaccaggcuacuucacucagacagcagggccguggcaccucggaaaacuggagcuugauuuugacuugugcgaaggcaccacuguggucguugaugagcacugcgggaacagaggacccucccugaggacaaccacggugacuggcaagaucauacaugaaugguguugccgcaguuguaccuuaccuccacuccgguucaaaggugaggacgggugcugguacggaauggagauuagacccguaagggaaaaggaggaaaaucugguaaagagcauggucucugcgggcuccggugagguggacucauuuagucuuggccuguuguguaucagcaucaugauugaagagguuaugcgcucgcgauggucccggaaaaugcucaugacagggacccuggccguguucuuucuacugaucaugggacagcucacuuggaacgaucugauucguucuugcauaauggucggcgcuaaugccagcgacagaauggggaugggaacaaccuaucuugcauugauggcuacauucaagaugaggccuauguuugccgugggccuguuauuccgccggcucacuucaagagagguucugcuucugaccaucggucuaagucucguggcauccgucgaacugccaaacucuuuggaggaacugggggauggauuagccaugggcauuaugauccucaaacugcuuacggacuuucaaagcuaccagcugugggcuacauugcucucccugaccuucauuaagacuaccuuuucacuacacuaugcguggaaaacaauggccaugguacugagcaucgugagucuucucccccuguguuugucuacuaccucccagaagacgacauggcugccgguuuuacucggcagccuggggugcaagccucuuaccauguuccugauagcagagaauaaaaucuggggaaggaagucguggccauugaacgaagguauuauggcugugggcaucgucucaauucuccugucuagucuacugaaaaacgaugugccccuugccgggccucucaucgccggaggcaugcugauagcuuguuacguaauuuccgguagcucugcagacuugagcuuagagaaggccgcggagguguccugggaagaggaagcugagcauucaggggccagucacaauauccuggucgaaguucaggaugacggaacuaugaaaaucaaggaugaggagcgagacgauacacucaccauucugcuuaaagcaacucuguuggccgugagcggcguguauccccuaucuauaccagcuacacuguuugucugguacuucuggcaaaagaagaaacagcgcuccggcgugcucugggacaccccuucacccccagaaguugagcgggcaguacuggaugacgggaucuauagaauuaugcagaggggacuuuuaggucguagucaggugggcgucgggguguuccaagaaaacguuuuucauacgauguggcacgugacucgcggagccguccugauguaccagggcaagcggcucgagccgagcugggcguccgugaaaaaggacuugaucucuuacggugggggauggagacugcagggcucguggaauaccggcgaggaaguacaggucauugcuguggagccugggaaaaaccccaagaauguucaaacagccccaggaaccuucaagacacccgaaggugaggugggcgcaaucgcccucgauuuuaaaccugggacuagcggaucaccaauagucaacagggaaggcaagaucgugggucuguaugggaauggaguugugaccacguccggcacauacgucagugcuauugcccaggcaaaggcuucucaggagggcccccuuccugagaucgaagacgagguguuccgaaagcggaaccugacuauuauggauuugcacccggggagcggaaaaacccgcagauaucuaccagccaucguaagggaagcgauaaagcggaagcugcgaacacucauuuuagcccccaccagagugguugcauccgagauggcugaagcccugaaagguaugccuauccgcuaccaaacuaccgcugucaagucagagcauacaggcagggagaucguggaccuuaugugccacgcaacguuuacuaugcgucugcucucuccagugcggguccccaauuauaacaugauuaucauggaugaagcccauuucaccgacccuagcaguauagccgcuagaggguacauuuccacaaggguaggaaugggcgaggcggcagccaucuuuaugaccgcuacuccgcccgguagcguggaagccuucccacagucuaaugcaguuauucaggaugaggaacgcgacaucccugagcgaucauggaacuccggguaugaguggauaacagauuuucccggaaaaaccgugugguucgucccaaguauuaagagcggcaaugacaucgccaacuguuugaggaaaaauggcaagcgggugauccagcugucgaggaagacguuugauacugaauaccagaaaaccaagaacaacgacugggacuacguugugaccaccgauauuucugagaugggggcuaauuuccgcgcggaccgugucaucgauccuagacggugccucaaacccgugauucugaaggacggaccagaaaggguaauacuugccgguccgaugccugugacuguugcauccgcugcccagcgccgaggcagaaucgggcggaaccacaauaaagagggagaucaguauauuuacaugggccagccccuaaacaaugacgaggaucaugcacacuggacagaagccaagaugcuguuggacaacaucaauaccccagaggguaucauucccgcuuuauucgaaccugagagggaaaagagcgccgcgauagauggggaguaucgccugagaggcgaggcaaggaaaacauuugucgaacucaugcggcguggagaccugccaguguggcuuucauacaagguggccagugagggcuuccaauauucugaucgccgauggugcuuugacggggaaagaaacaaucagguccuggaggaaaacauggauguugagaucuggacuaaagagggagaaaggaagaaacuccggccccgcugguuggacgcuagaacguacuccgacccucuggcccuaagggaguucaaggaauuugcugcaggucggcgaagcgugucaggcgaucugauucucgagaucgggaaacuuccgcagcaccugacccagagagcccaaaaugcuuuagacaacuugguaaugcugcauaauagugaacagggaggccgcgccuauaggcacgcaauggaggagcucccagauacaauugaaacucugaugcuucuggcgcucaucgccguguugaccgguggggucacacuguucuuuuuaagcggccggggacuaggcaagaccuccauagggcugcucugugugauggcuucuagcgcccuucuguggauggcauccguugagccccauuggaucgcugccucaauuaucuuggaguucuuucugauggugcuccugauuccugagcccgaccgucagagaacuccacaggauaaccaacuugcauacgucguaaucggacuccuguucaugauauugacgguggccgcuaaugagaugggucuguuagaaaccacaaagaaagaccuaggcauugggcacguugcgguggagaaccaccaucacgccacuaugcuggaugucgaccuccauccugcaucugcuuggacccuuuacgccguggccacaaccaucauuacucccaugaugaggcacacaaucgaaaacacgaccgcaaauauaagucugacugcuaucgccaaccaggcggcuauuuugaugggacuggauaagggcuggccaaucucgaaaauggacauuggugucccucuccuggcccuugggugcuauagccaggugaauccguuaacacugaccgcagccguucucauguugguggcucauuacgcaaucauaggccccggacugcaagccaaggcgacccgcgaggcucagaaacggacagccgcaggcauuaugaagaacccaacuguagaugggaucguggccaucgaccuagauccugucguuuaugacgcuaaguuugaaaaacagcugggacagauuaugcuccuuauccuguguacgucccaaauauugcugaugcgaaccacaugggcccucugcgagucuauuacucuggcaaccggccccuuaacaacccuuugggaggguucaccagggaaguucuggaauacuacgaucgcugugagcauggccaacauuuuuagaggauccuaccuggcgggcgccggucucgcauucagucuaaugaaaucucugggcgggggaaggcgcggcacaggggcucagggagaaaccuugggcgagaaguggaaacggcagcugaaucagcucagcaagucagaguucaacacuuauaagagauccgguaucauggaggucgaccguagugaagccaaagaggggcuuaggcggggagagaccacaaagcacgcagugagccgcggcacugcuaaacugcgaugguuuguagaaagaaauuuggugaagccugaggguaaaguuauagaucugggcugugggaggggaggcuggucuuacuauugcgccgggcucaagaaggugaccgaagucaaaggauacacaaagggcggucccgggcacgaggaaccgaucccaauggccacguacggauggaacuuagugaaacugcauuccggcaaggacgucuucuuuauuccucccgagaaaugugauacccuucugugcgacaucggcgagucaagcccaaaucccacuauugaagaggggcggacacuacgcgugcucaagaugguugaaccuuggcugagaggaaaccaauucuguaucaaaauuuugaauccguauaugcccucgguaguggagacccuggagcacaugcagaggaagcaugguggcaugcucguccgaaacccacuuucucggaauaguacucacgaaauguacuggguguccugcgggacaggaaacaucguuagcgcggugaauaugaccucacguaugcuguuaaacagauuuacgauggcucaccgcaagccuaccuaugagagggaugucgaccugggcgcagguacacggcauguggccguagaacccgagguggcuaacuuggauauaauugggcagagaaucgaaaauaucaaacacgagcauaaguccacuuggcacuacgacgaggauaacccuuauaaaaccugggccuaccauggaucuuaugaaguuaagccaagcggcagugcauccagcauggucaauggcguggugaaacuccugacaaagcccugggacgucauuccuaugguuacucagauagccaugaccgauacaaccccauucgggcaacagcgcguguuuaaggagaaaguagacacuaggacgcccaaggcuaaacgaggaacagcgcagaucauggaagugaccgcccgguggcuaugggguuuccuuucuagaaacaagaaaccgaggauuuggacucgcgaggaagucacccguaaggugcggucaaaugcaggcaucggggcuggaguuggcgacgagaaccaauggaauagugccaagaaagguguggaggaugaaagauuuugggaccugguccacagggagcgcgaacuccacaagcaggggaaaugugcaacaugcguguacaacaugaugggaaagcgagagaaaaagcugggcgaguucggcaaggccaaagggucccgggcuauuugguacaugugguugggagccagauuucuggaguucgaggcgcucgguuuuaugaaugaagaucauugguucagcagggagaacucucuuucgggcguagaaggggagggacugcacaaguuaggcuauauccugcgcgacauaucaaaaaucccuggugggaauauguacgcagaugacacggccggaugggauaccagaauuacugaggacgauuugcagaacgaagcuaagaucacagacauuauggagccagaacaugcccuccuggcaaccagcaucuucaaacuaacuuaucagaauaagguugugcggguccaaaggcccgcuaaaaacggcacagugauggaugugauaucccgucgagaccagcgcggcagugggcaggucggaaccuacggucuuaauacauuuacuaacauggaggcccagcugauuagacaaauggaaucugagggcaucuucagcccuuccgagcucgaaaccccaaaccuggcugagcggguuuuggauugguuagaaaaguaugggguggagaggcugaagcgcauggccaucucaggagacgacugcguagugaaacccauugaugacagauuugcaacggcgcucaccgcccuuaaugauaugggcaagguccggaaagacauaccgcagugggaaccuaguaaggguuggaacgauuggcaacaggugcccuucuguucucaccacuuucaucaacugaucaugaaagacgggagggagauuguugugccaugccgaaaucaggaugagcuagucggacgugcuagagugagccagggcgccggcuggucccugcgcgaaacagcaugucucgggaagucauacgcucagauguggcaauugauguauuuccaccggagggaccugagacuugccgcaaacgccaucugcagcgcgguaccuguugauugggugcccacuucucgcaccacaugguccauucaugcucaccaucaguggaugacuaccgaggacaugcugagugucuggaaucggguguggaucgaagagaacccauggauggaagauaagacgcacauaagcucguggggagacguucccuaccucgguaaaagggaggaccagugguguggcuccuuaaucgggcugacagcccgagcaaccugggccacuaauauucaaguggcuaucaaccaggucagacgguugauuggaaaugagaacuaccuggauuauaugacaucuaugaagagguuuaaaaaugaaucagacccugagggcgcccucugguga

SEQ ID NO: 13752 - RNA, 9876 nt, Artificial Sequence
  derived and/or modified CDS sequence (opt3) from DENV-1__FJ882546__SS-prME
agcgugaccaugcugcucaugcuuaugcccacagcccuggcuuuccacuugacuacgaggggaggggaaccucauaugaucgucuccaagcaggaaaggggaaaaucuuuacuguuuaagaccucagccgguguuaacaugugcacauugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaagauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccggaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaagaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguucaaagaauuugccgcuggccggaaguccgucagcggggaucucauacuugagaucggaaagcugccgcagcacuuaacacagcgagcccagaaugcauuggacaaccugguuaugcuccauaauucagaacaaggcgguagagcguaucgccacgccauggaggagcugccagauacuauugaaacccuuaugcugcucgcuuugaucgccgugcugacagggggcguaaccuuauucuuucuaaguggaaggggccuggggaaaacuagcauuggacuccuuugugugauggcauccucuguccuguuguggauggcuagcguggagccccauuggaucgccgcauccauaauccuggaguucuuucucaugguucugcuuauuccugagcccgaccggcagcguacgccacaggauaaccagcucgccuacguggucaucggucuguuguucaugauucugaccguagcugcgaaugagaugggcuuacuagaaacaacuaagaaagaccuggggaucggacacguggccguugagaaccaccaucacgcagcuaugcucgauguggaccuucauccugccucagccuggacccuguacgcagucgcuacaaccauaauuacucccaugaugagacacacaaucgaaaacacgaccgccaauauuucuuugacugcgaucgcuaaccaagccgcaauacugaugggccucgauaaggguuggccaaucaguaaaauggacauuggggugccucugcuugccuuaggcugcuauucgcaggucaauccgcugacacucaccgcugcaguguugaugcugguugcccauuacgcgaucauuggacccggccuacaggcuaaggccaccagggaggcacaaaagcgcacagccgcugggaucaugaaaaacccaacuguggauggaauaguagccauugaccuggauccuguggucuaugacgcaaaguuugaaaaacagcucggccagaucaugcuucugaucuuguguacgagccagauucugcucaugcggaccacaugggcucugugcgaguccaucacuuuagccaccgguccccuuacaacccugugggaggggucuccaggaaaguucuggaauacuacgauagcgguuucaauggccaacauuuuucgaggcagcuaccucgcaggagcuggccuagccuucucccugaugaaaagucuaggggguggcagaagggggacaggagcacaaggcgaaacccugggugagaaguggaagcgccagcucaaucagcuuucuaaaagcgaguucaacacuuauaagcggucagggaucauggagguggacagauccgaagcuaaagagggacugaagcguggcgagaccacaaaacacgccgucaguagggguacugccaaguugcggugguuuguggaacgcaaucugguaaagccugagggcaaagugauugaucucggguguggacgaggcggguggagcuacuauugcgcgggauuaaagaaaguuaccgaagugaagggcuacacaaaaggugggcccggacacgaggaaccgaucccaauggcuacguacggcuggaaccuggucaaacuucauucuggcaaagacguguucuuuauaccucccgagaagugugauacccugcuaugcgacaucggggaguccucaccaaaucccacuauugaagagggaagaacacucaggguccugaagaugguggaaccuugguugcgggguaaccaguucuguaucaaaauucugaauccguauaugcccagcguuguagagacccucgagcaaaugcagcgcaagcacggcgggaugcuugugagaaacccacugucgagaaauucuacucaugaaauguacugggucaguugcggaacaggcaacaucguguccgcaguuaauaugaccagccgaauguuacugaaccgguuuacgauggcccaccguaaaccuaccuaugagagagauguggacuuggguacagggacucgccacgucgcuguggaacccgagguagccaaccucgauauuaucggacagaggauagaaaauauuaagcaugagcacaaaucaaccuggcauuacgacgaggauaacccuuauaagacaugggcauaccacggcuccuaugaagugaagccaucuggcagcgccaguuccaugguuaauggggucgugaaacugcuaacuaagcccugggacgugaucccuauggucacccagaucgcuaugacagagcuucaucugggacaacagcggguuuucaaagaaaagguggauaccagaacuccacgcgcgaaaagggguacggcccagauuauggagaugacagcacgauggcucuggggcuuucugagccggaacaagauacccagaaucuguaccagggaagaguucacucgcaagguacguucuaaugcugccauuggggcaguguuugucgacgagaaccaauggaacucagccaaagaagcuguggaggacgaacgguucugggauuugguucacagagagagggaacugcacaagcagggaaaaugcgcaaccugcguguacaacaugaugggcaagcgcgagaaaaagcucggugaguuugggaaggcgaaaggaagucgagcaaucugguacauguggcuuggcgcccgguuccuggaauuugaggcuuuaggcuucaugaaugaagaccauugguucuccagagagaacagccugucuggggucgagggagaagguuugcacaagcucggcuauauucugagggauaucucgaaaauaccagggggaaauauguacgccgacgauacagcaggcugggacacgcgcaucaccgaggaugaccuacagaacgaagcuaagauuacugauaucauggagccugaacaugcccuucuggcuaaagccauuuuuaagcucacauaucagaauaaagugguaagaguucaacggccagcaaagaacgguaccgugauggacgucaucucaaggcgugaucagcgagggagcggacaggugggcacuuacggccugaauacauucaccaacauggaggcgcaguugauacgccaaauggaguccgaagagauuuuuagucccucugaauuagagacaccuaaccuggccgaaagagcucucgacuggcuugagaaguaugggguggagcggcugaaaaggauggccaucagcggagaugacugugucguuaagccaaucgacgaucgcuucgcaacugcucuaaccgcccugaaugacauggguaaagugagaaaggauauuccccagugggaaccguccaaaggcuggaacgacuggcagcagguaccuuuuugcucacaccacuuccaucaacucauaaugaaggaugggcgggagaucgugguccccuguaggaaucaggacgaauuggugggacgagcacguguuagucagggcgccgguuggucucugagagagacggcgugccuuggaaagagcuacgcucagauguggcaacugauguauuuucaccgccgggaucucagguuagccgcaaacgccauuuguuccgcugugccagucgacugggugccuaccucaagaacaacuuggagcauccaugcccaccaucaguggaugaccacagaagauaugcugucuguauggaaucgcguuuggauugaggagaaccccuggauggaagacaaaacucacaucuccaguugggaggaugugccauacuugggaaagcgggaagaccaguggugcggcagccugauaggccucaccgcaagggcuacgugggccacaaauauccaagucgcgauuaaccaggugcgaagacuuaucgggaaugagaacuaccuggacuauaugaccucgaugaaacgguucaagaaugaguccgaucccgaaggagcucuaugguga

SEQ ID NO: 13753 - RNA, 9879 nt, Artificial Sequence
  derived and/or modified CDS sequence (opt3) from DENV-1__KF921935__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugccccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagagcaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuaccccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggaagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggaaaagagaugauacgcccucaacccauggaauacaaguauucuuggaaaucguggggcaaggccaagaucauuggggcggacguucagaauaccacauuuaucauugauggaccaaacacuccugagugucccgacgaucagagagccuggaauaucugggagguggaagacuacggcuucgguauauuuaccacaaacauuugguugaaacucagggauagccacacgcaggucugcgaccaccgucugauguccgcugcaaucaaggauucaaaagccgugcaugcugacaugggguauuggauugagagugaaaagaaugagaccuggaaacuagcccgggcaucuuucaucgaaguuaagacuuguauauggccaaagagccacacacugugguccaacggagugcucgagucagagaugaucauucccaaaaucuacggcgguccuauuagccaacauaauuaucgaccaggcuacuucacccagacugcggggccguggcaccugggaaagcuugaauuggauuuugaccugugcgagggcacaaccguagucguggaugaacacugcgggaacagaggacccucuuuaaggacgacuaccgugacaggcaaaaucauacaugagugguguugccgcuccuguacccucccuccacugcgguucagaggugaggacgggugcugguacggaauggaaauuaggcccgucaaggagaaagaagagaaucuuguuaagaguauggugagcgccggcucuggugaaguagacuccuuuucacugggcuugcucuguaucaguaucaugauugaggaggugaugcgcagccgauggucgcggaagaugcugaugacugggacacuagcugucuucuuucugcucaucaugggacagcugaccuggaacgaucuuauucguuugugcauaauggugggcgccaaugcauccgacagaauggggaugggaacaacuuaucuggcuuuaauggccaccuucaaaaugaggccuauguuugcaguuggccuccuguuccgccggcuuacgucuagagaagugcugcuacucacaaucggucugagcuuggucgccucaguggagcugccaaacaguuuagaagagcucggggauggacuggcuaugggcauuaugauccuuaagcuguugaccgacuuucaaucccaccagcucugggcgacucugcuaucucugaccuucauuaaaacaacuuuuagccuucauuacgccuggaagaccauggcaaugguucucuccaucgugucacuguuccccuugugucugagcacgacaagucagaaaaccacuugguuaccgguccuccugggcucucuugggugcaagccucugacaauguuuuugauagcugaaaauaagaucuggggaaggcgauccuggccacucaacgaggguauuauggccguaggcaucgugagcauucugcuaucgucacugcuuaaaaacgauguuccccucgccgggccucugaucgcuggaggcauguugauagcauguuaugugauuucugguaguuccgccgacuuaagccuggagaaggcggcugaagucucuugggaggaagaggccgaacacagcggggcaucccauaauauccucguggagguacaggaugacggaaccaugaaaaucaaggaugaggaacgcgacgauacucugacaauucuucugaaagccaccuugcuagcugugucaggcgucuacccccugaguauaccagcaacgcucuucguuugguauuucuggcaaaagaaaaagcagcggagcggcgugcugugggacacuccuucucccccagagguggaaagagccguccuugaugacgggaucuacaggauuaugcagcguggauuacugggucgcucccaggugggcguugggguauuucaagagaacguguuccacaccauguggcacgucacacggggagcggugcucauguaucagggcaagagauuggagccgucaugggcuaguguuaaaaaggaccugaucagcuacggugggggauggaggcuccagggcuccuggaauaccggcgaagaggugcaggucauugccguggaaccugggaaaaaccccaagaauguacaaacagcaccaggaacuuuuaaaacccccgagggugaagucggcgccaucgcucuggauuucaagccugggacgucuggaucgccaauagugaaccgagagggcaagaucguuggucuuuacgggaauggaguggucacaacuagcggcaccuaugugucagccauugcacaggcuaaagccucccaggagggcccccugccugaaaucgaggacgaaguuuuucggaagcgcaacuugacaauuauggaucuacauccggggaguggaaaaaccagaagguaccugccagcgaucgugcgggaggccauaaagcgaaaacucagaacuuuaauucuggcacccacccgcgucguggcuucugaaauggccgaggcucuuaaggguaugccuaucagguaucaaacaacggcaguaaagagcgagcacacuggcaaagaaaucguggaccugaugugccaugccaccuucacaaugcgucucuuguccccaguucggguccccaauuacaacaugauuaucauggaugaggcccacuuuaccgacccuucaucuauagcugcgagaggguauauuagcacuagggugggaaugggcgaagcagccgcuaucuucaugacagccaccccgcccgguaguguggaggcauuuccacaguccaaugccgucauucaggaugaagagcgcgacaucccugagcgaagcuggaacucuggguacgaauggauaacggauuuccccggaaagacuguaugguuugugccaucaauuaaauccggcaaugacaucgcuaacugucugagaaagaauggcaaacggguuauccagcucaguaggaagacauucgauaccgaguaucaaaagaccaaaaacaacgacugggacuacguggucacuacagauauuagcgaaaugggggcgaauuuccgcgccgaccgugugaucgauccuagacggugccugaagcccguuauucuuaaagacggaccagagagggugauacuagcagguccgaugccugucaccguggcuucggccgcacagcgccgaggcagaaucgggcggaaccauaauaaggagggagaucaguacauuuauaugggccagccccugaacaaugacgaagaucacgcccacuggacagaggcuaaaauguuguuagacaacaucaauacuccagaagguaucauucccgcccuguuugagccugaaagggagaagucugcggcaauagauggggaguaccgccucagaggcgaagccaggaagacguucguagagcugaugcggcguggagaccuuccaguguggcuguccuauaaaguugcuagcgaaggcuuucaauacucagaucgccgauggugcuucgacggggagagaaacaaucagguccucgaagagaacauggauguggagaucuggaccaaggaaggagagaggaaaaaguugcggccccgcuggcuggacgccagaacauauagugacccucuagcucugagggaauuuaaagaguucgcagccggucggcgaucuguguccggcgaucucauucuugaaaucgggaagcugccgcagcauuuaacucagagagcucaaaaugccuuggacaaccuggucaugcuccacaauagcgagcagggaggccgcgcauacaggcaugcgauggaggaacugccagauaccauugagacacuuaugcugcucgccuugaucgcuguucugaccgguggggugacuuuauuuuuccuaucaggccggggacugggcaaaacgaguauagggcuccuuuguguaauggccagcuccgugcuguuguggauggcaucugucgaaccccacuggaucgcugccagcauuauccuggaguuuuuccucauggugcugcuuauuccugagcccgaccgucagagaaccccacaggauaaccaacucgcauauguugugaucggacuguuguuuaugauacugacagucgccgcuaaugaaauggguuuacuagagacuaccaagaaggaccugggcauugggcacguagcgguggaaaaccaucaccaugccgcaaugcucgauguugaccuucacccugcuuccgccuggacacuguacgccguggcaaccacuaucauuacacccaugaugaggcauacgaucgagaacaccacugcuaauauaucauugacagccaucgcgaaccaggcugccauucugaugggacucgauaaaggcuggccaaucucuaagauggacauuggugucccucugcuugcauuagggugcuacagucaggugaauccgcugacccucaccgccgcugucuugaugcugguggcacacuaugccaucauaggccccggacuacaagcgaaagcuacacgcgaagcccagaagcggacugcagccggcauuaugaaaaacccaacgguugaugggaucguggcuaucgaccuggauccuguaguguacgacgccaaguucgagaagcagcucggacagauuaugcuucugaucuuguguaccucgcaaauacugcucaugcgaacaacuugggcacugugcgagagcauuaccuuagcuacaggcccccuuaccacucugugggaagguuccccagggaaauuuuggaauacgacaaucgccgucucuauggcgaacauuuucagaggaucauaucucgccggcgcaggucuagcuuucagccugaugaaguccuugggcgggggaaggcgcggcaccggggcccagggagagacucugggcgaaaaauggaagcggcagcucaaucagcuuaguaaaucugaguuuaacaccuacaagagaagcgguaucauggaaguugaccguucagaggcaaaggaggggcugaaaaggggagaaacaacuaagcacgcugugucccggggcaccgccaaauugcgcugguucgucgagcgaaaucuggugaagccugaagguaaaguaauagaucucggcugugggagaggaggcuggaguuauuacugcgccggguuaaagaaggugacagagguuaaaggauauacgaagggcggucccgggcaugaagagccgaucccaauggcgaccuacggauggaaccuggugaaacuucacagcggcaaggacgucuuuuucauuccucccgagaaaugugauacucugcuaugcgacaucggcgaaucuuccccaaaucccacaauugaggaagggaggacccuccgggugcugaagauggucgagccuugguugcgcggaaaccaauuuuguaucaaaauucugaauccguacaugcccucagugguugagacucucgaacagaugcagagaaagcaugguggcaugcuuguaaggaacccacugagccgaaauucgacacacgagauguauugggugucuugcgggaccggaaacaucgucagugcugugaauaugacgucccggauguuacugaaccguuucaccauggcacacagaaagccuacauacgaacgcgauguugacuugggcgccgguacuaggcauguggcugucgagcccgaaauagccaaccucgauauuaucgggcagcggaucgagaauauuaaacacgagcauaagagcaccuggcacuaugacgaagauaacccuuacaaaacaugggcauaucauggaucauacgaggugaagccauccggcucugccagcaguaugguaaauggcgugguuaaacugcuaacuaagcccugggacgucauaccuauggugacccaaaucgcuaugacagauaccacuccauuugggcagcagagaguguucaaggaaaaagucgacacgcgcacacccaaggcgaaaaggggaaccgcccaaauuauggagguuacugcaaaguggcuuugggguuuucugucccgaaacaaaaagccgcggaucuguaccagagaagaguucacaaggaaggugcgcagcaaugcugccauuggcgcaguauuuguggacgagaaccaguggaauucugccaaagaagcugucgaggaugaacguuucugggaccucgugcaccgggagagagaacugcacaagcaggggaaaugcgccacgugcguuuauaacaugaugggaaagagggagaaaaaguugggcgaguuugguaaggcgaaagggucacgcgcaaucugguacauguggcugggagcccgauuccucgaauucgaggcucuuggcuuuaugaaugaagaucauugguucagucgggagaacucccugagcggcguggagggggaaggauuacacaagcuggguuacauauugagagacaucucuaaaauuccuggcgggaauauguaugccgaugacaccgcaggaugggauacuaggaucacagaggacgaucuccagaacgaagcucgcauuaccgacaucauggagccagaacaugcccugcuagcuaagucgauauuuaaacuuacuuaccaaaauaaggucgugagaguacagcggcccgccaaaaacggcacaguuauggaugugauuucaaggcgugaccagcgagguagcgggcaggucggaaccuauggccugaauacauucacuaacauggaggcacaacucauccgccagauggaguccgaaggcaucuuuaguccuucugagcuggaaaccccaaacuuggcggagagaguguuagauuggcuggaaaaguacgggguggagcggcucaagaggauggccauuagcggagacgacugugucguuaaacccauagaugaccgcuucgcuacggcccuuaccgcacugaaugauauggguaaggugagaaaagacaucccgcagugggagccuuccaagggcuggaacgauuggcagcaaguacccuuuugcucacaccacuuccaucagcuaauuaugaaagacgggcgggaaaucguggucccauguaggaaucaggaugagcuggugggacgagcucguguuagucagggcgccgguuggucucucagagaaacagcaugcuuggggaagagcuaugcccaaauguggcagcugauguacuuucaccgccgggaccuuaggcuggcggcuaacgccauuuguuccgcagugccugucgauuggauccccacuucaagaaccacauggagcauacaugcccaccaucaguggaugacuaccgaggacaugcucucuguguggaaucgcguauggaucgaagagaacccauggauggaggauaagacgcacauuuccaguuggggagacguucccuauuuaggcaaacgggaagaccaauggugcggcagccugaucggguugacagcuagggccaccugggcaacuaauauucagguggcuaucaaccagguccgaagacugauuggaaaugagaacuaccucgauuacaugacaucgaugaagcgguucaaaaaugaaggugacccugagggcgcccuuugguga

SEQ ID NO: 13754 - RNA, 9879 nt, Artificial Sequence
  derived and/or modified CDS sequence (opt3) from DENV-1__GQ199776__SS-prME
agcgugaccaugcugcucaugcuuaugcccaccgcccuggcuuuccacuugacuacgcggggaggggaaccucauaugaucgucuccaagcaggaaaggggaaaaucuuuacuguuuaagaccucagccgguguuaauaugugcacgcuaauugccauggaccucggcgaacugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacacugucccuucacuaugcauggaagacuauggcuauggugcucucaauugucagccuguuucccuugugucugaguaccacgucucagaaaacaaccugguuaccgguacuccugggcucccuugggugcaagccucugacuauguucuugaucgccgagaauaagauauggggacgacgcagcuggccacucaacgaagguaucauggccgugggcauuguuucgauccugcuaucaucucugcuuaaaaacgaugugccccucgcugggccucugauugcaggaggcauguugaucgccuguuacgucauaagugguuccagcgcggacuuaucucuggagaaggcugccgaggugagcugggaagaggaagcagagcauuccggggccucacacaauauucucguagaagugcaggaugacggaacaaugaaaaucaaggaugaggagcgggacgauacccugacuauccuucugaaagcuacauugcuagcagucaguggcguuuauccccugagcauuccagccacccucuuugugugguacuucuggcaaaagaaaaagcagagaucuggcgugcugugggacacgccuucacccccagaagucgagagggcggugcuugaugacgggauauaucguaucaugcagcgcggauuacugggucggagccagguuggcguagggguguuccaagaaaacgucuuucauacuauguggcacgugaccagaggagcuguucucauguaccagggcaagagguuggagccgaguugggccagcgugaaaaaggaccugauuuccuacggugggggauggcgacuccagggcucuuggaauacaggcgaggaaguccaggugaucgcaguagagccugggaaaaaccccaagaauguccaaaccgccccaggaacauucaaaacucccgaaggugaggugggcgcuauugcccuggauuuuaagccugggaccucgggaagcccaaucguuaaccgggaaggcaagauagugggucuuuaugggaauggagucgugacgacaucaggcacuuacguuuccgcaaucgcucaggccaaagcgagucaggagggcccccugccugagauugaagacgagguguuccgcaagagaaacuugaccaucauggaucuacacccggggucuggaaaaacaaggcgguaucugccagccauuguccgagaagcaaucaagagaaaacuccgcaccuuaauacuggcucccacuagggugguagccagcgagauggcugaagcacuuaaggguaugccuauucguuaccaaaccacagccgugaaguccgagcauacgggcaaagagaucguugaccugaugugccacgccacuuuuaccaugcggcucuugucaccagucagagugcccaauuauaacaugaucauuauggaugaagcucauuucacagacccuucuagcaucgcggcaaggggguacauaaguacccgcgugggaaugggcgaggccgcugccauuuuuaugacugcaacaccgcccgguuccgucgaagccuucccacagagcaaugcuguaauccaggaugaggaacgagacauuccugagagaucuuggaacucaggguaugaguggaucaccgauuuucccggaaagacggugugguucguuccauccauaaaaaguggcaaugacauugcgaacugucugcggaagaauggcaaaagggugauccagcucagccgcaagacuuuugauacagaauaccaaaagaccaaaaacaacgacugggacuacgucgugaccacugauaucucggagaugggggccaauuuccgugcagacagaguuauugauccucggaggugccugaagcccgugauccuuaaagacggaccagaacgcgucauucuagcugguccgaugccugugacaguagccucugcagcccagcgaagaggccggauagggaggaaccacaauaaggagggagaucaguauaucuacaugggccagccccugaacaaugacgaggaucaugcucacuggaccgaagccaaaauguuguuagacaacauuaauacaccagaggguaucauccccgcgcuguucgaaccugagcgcgaaaaguccgcagccauugauggggaguauagacucaggggcgaggcucggaagacuuuuguggaacugaugcgucgcggagaccuuccaguuuggcugagcuacaaagucgccucagagggcuuccaauauagugaucgaagauggugcuuugacggggaaaggaacaaucaggugcucgaggaaaacauggauguggagauauggacgaaggagggagaacggaaaaaguugcgccccagauggcuggacgcuaggaccuacucugacccucuagcacugcgggaguucaaagaauuugccgcuggucgaagauccgucagcggcgaucucauccuugagauugggaagcugccgcagcacuuaacacagcgcgcccaaaaugcauuggacaaccugguuaugcuccauaauucagaacagggaggcagggcguaucggcacgccauggaggagcugccagauacuaucgaaacccuuaugcugcucgcuuugauugccgugcugacaggugggguaaccuuauucuuucuaaguggccguggacugggcaaaacuagcaucgggcuccuuugugugauggcauccucuguccuguuguggauggcuagcguggagccccauuggauagccgcauccaucauucuggaguucuuucucaugguucugcuuaucccugagcccgacagacagaggacgccacaggauaaccaacucgccuacguggucauuggacuguuguucaugauccugaccguagcugcgaaugagauggguuuacuagaaacaacuaagaaggaccugggcauagggcacguggccguugagaaccaccaucacgcagcuaugcucgauguggaccuucauccugccucagccuggacccuguacgcagucgcuacaaccauuaucacucccaugaugcgccacacaauugaaaacacgaccgccaauaucucuuugacugcgauagcuaaccaggccgcaauccugaugggacucgauaaaggcuggccaauuaguaagauggacaucggugugccucugcuugccuuagggugcuauucgcaggucaauccgcugacacucaccgcugcaguguugaugcugguugcccauuacgcgauuaucggccccggacuacaagcuaaagccacccgggaggcacagaagcgaacagccgcuggcauaaugaaaaacccaacuguggaugggauuguagccaucgaccuggauccuguggucuaugacgcaaaguuugaaaagcagcucggacagaucaugcuucugauuuuguguacgagccaaauccugcucaugagaaccacaugggcucugugcgaguccauaacuuuagccaccggcccccuuacaacccugugggaggguucuccagggaaauucuggaauacuacgauugcgguuucaauggccaacaucuuuaggggaagcuaccucgcaggcgcuggucuagccuucucccugaugaagaguuugggcgggggacgccggggcacaggggcacagggagaaacccugggcgagaaauggaagagacagcucaaucagcuuucuaaaagcgaguucaacacuuauaagcguucagguauuauggagguggacagguccgaagcuaaggaggggcugaaacggggagagaccacaaagcacgccgucagucgcggcacugccaaauugcgaugguuuguggaaagaaaucugguaaagccugaggguaaagugaucgaucucggcugugggaggggaggcuggagcuacuauugcgcgggguuaaagaagguuaccgaagugaaaggauacacaaagggcggucccgggcacgaggaaccgauaccaauggcuacguacggauggaaccuggucaaacuucauucuggcaaggacguguucuuuaucccucccgagaaaugugauacccugcuaugcgacauuggcgaguccucaccaaaucccacuaucgaagaggggcggacacuccgcguccugaagaugguggaaccuugguugagaggaaaccaauucuguauuaaaauccugaauccguauaugcccagcguuguagagacccucgagcagaugcagaggaagcacgguggcaugcuugugcgaaacccacugucgagaaauucuacucaugaaauguacugggucaguugcgggacaggaaacauuguguccgcaguuaauaugaccagccguauguuacugaacagauuuacgauggcccaccgcaagccuaccuaugagagggauguggacuugggcgcugguacacggcacgucgugguagaacccgagguggccaaccucgauaucauagggcagagaauugaaaauaucaaacaugagcacaagucaacuuggcauuacgacgaggauaacccuuauaaaaccugggcauaccacggauccuaugaaguuaagccaucuggcagcgccaguuccauggucaauggcguggugaaacugcuaacaaagcccugggacgucaucccuaugguuacucaaauugcuaugaccgauacaaccccauucgggcagcagcgcguguuuaaggagaaaguagacacuaggacgcccaaggcgaaacgaggaacagcccaaauaauggaagugaccgcaaaguggcuuugggguuuccugagccggaacaaaaagccgagaaucuguacuagggaggaauuuacccgcaagguccguucuaaugcugccauuggcgcaguguucguugacgagaaccaguggaacucagccaaagaggcuguggaagaugagcgguuuugggaccucguccauagagaaagggagcugcacaagcaggggaaaugcgccacaugcguguacaacaugaugggaaagcgcgagaaaaaguugggcgaguucgguaaggcgaaagggagucgagcaaucugguacauguggcugggagcccgguuucucgaguucgaagcucuuggcuucaugaaugaggaucacugguuuuccagagaaaacagccugucuggcguagagggggagggauuacauaagcuggguuauauuuugagggacaucucgaaaauaccuggcgggaauauguacgccgaugacacggcaggaugggauacccgcaucacugaagacgaucuccagaacgaggcuagaauuacagacaucauggaaccagagcacgcccugcuagcuaagucaauuuucaaacuuaccuaucaaaauaagguugugcggguccagaggcccgccaaaaacggcacugugauggaugugaucagccgucgagaccagcgcgguuccgggcaggucggaacauacggccugaauaccuuuacaaacauggaagcacaacucauaagacagauggagagugagggcauuuucucuccuagcgaacuggagacuccaaacuuggcggaacggguuuuagauuggcuggagaaguaugggguggaaaggcucaagcgcauggccaucuccggagacgacuguguagugaaacccaucgaugacagauuugcuaccgcccuuacggcacugaaugauauggguaagguccggaaagacauuccgcagugggagccuucaaagggcuggaacgauuggcagcaagugcccuucugcagucaucacuuucaccagcuaauaaugaaagacgggagggagaucguugugccaugucgaaaucaggaugaacuggucggacgugcuagagugucucagggcgccgguuggagccuccgcgagaccgcaugcuuggggaaguccuacgcccaaauguggcagcugauguauuuccaucggagggaccuuagacuggcggcuaacgccauuuguucagcaguaccuguugauuggauccccacaagccgcacuaccuggucuauucacgcccaucaccaguggaugacaacugaagacaugcucuccguguggaaucgggucuggaucgaggaaaacccauggauggaggauaagacccauauaaguagcuggggagacgugcccuacuuaggcaaaagggaggaccaauggugcggcucgcugaucggguugacggcucgagccacaugggcaaccaauauucagguugcuaucaaccaggugagacggcugauuggaaaugaaaacuaccucgauuauaugacuuccaugaagagguuuaaaaaugagucugacccugaaggugcccuuugguga

SEQ ID NO: 13755 - RNA, 9879 nt, Artificial Sequence
  derived and/or modified CDS sequence (opt3) from DENV-1__GQ199777__SS-prME
agcgugaccaugcugcucaugcuuaugcccacugcccuggcuuuccacuugacuacgcggggaggggaaccucauaugaucgucuccaagcaggaaagggggaaaucuuuacuguuuaagaccucagccgguguuaauaugugcacgcuaauugccauggaccucggcgaacugugugaagauacuaugaccuacaaaugcccacggauaacagagaccgaaccggacgauguggacuguuggugcaaugcgacugauacaugggugaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaggacgcuaacuucgugugccgccgaacuuuuguagauagaggcugggguaauggguguggauuguucggcaaaggcucccucauaaccugcgccaaguuuaagugcgugacaaaacuggaggggaagauuguccaguacgaaaacuuaaaauauucagugaucguuaccgugcacacuggagaccagcaucaagucgguaaugagaguacggaacacggcacaaccgcaacuauuacaccccaagcuccuaccaccgagauccagcugacugacuacggggcccucacacuugauuguagcccaaggacgggacuggacuucaacgaaaugguguugcuaaccaugaaggagaaaucuuggcugguacauaagcagugguuucucgaucugccgcuucccuggacuuccggcgcgucaacaagccaagagaccuggaaucggcaggaccuguugguuacauucaaaacugcccacgcaaagaagcaggaaguggucgugcucgguagucaagagggggcuaugcacaccgcccugacgggcgcuaccgaaauccagacaucuggaacuaccacaauuuuugccggccauuuaaaaugccgucugaagauggauaaacuaacucucaaggggauguccuaugucauguguaccggacuguucaaacuugagaaggaaguggcagagacgcagcacgguacaguuuuggugcagauaaaguacgagggcaccgacgccccuugcaaaaucccauucagcacucaagaugaaaaggggguaacacagaacggacgccugauuaccgcuaaucccaucgucacugacaaagagaagccugugaacauagaagcggagccacccuuuggcgagucguauauuaucaucggugcaggggaaaaagcccucaagcugucuugguucaagaaaggcuccucaauuggaaagauguuugaggcuaccgccagaggcgcaaggcggauggccauccuuggggauacagcuugggacuucggaaguauugguggcguuuuuacgagcguggggaaacugguccaucagauauucggaaccgccuacggcguguuguuuuccgguguaucuuggacuaugaagaucgggauuggcgugcuccugacaugguuaggacugaauagccgaucaaccagucuauccaugacauguaucgcaguuggccucgucacucuguaccuuggggugauggugcaggcggauagcggaugcgucaucaacuggaaaggccgcgaauugaagugugguucugggauuuucguuaccaaugaggugcacacguggacagaacaauauaaguuucaggcugacucaccgaaaagacugagugccgcaauaggaaaggccugggaggagggcgugugcgguaucaggagcgcuacccggcucgaaaacauuauguggaaacagaucuccaacgagcugaaucauauuuuacuggaaaacgacaugaaguucacuguagucgugggcgauguugccgggauccuugcacagggcaaaaagaugauacgcccucaacccauggaguacaaauauucuuggaagucguggggcaaggcuaaaaucauuggggccgacgugcagaauaccacauuuaucauugauggaccaaacacuccugaaugucccgacgaucagagagcguggaauaucugggaggucgaggacuacggcuucgguauauuuaccacaaacauuugguugaagcucagggauagcuauacacaggugugcgaccaccgucugauguccgccgcuaucaaagauucaaaggcaguucacgccgacaugggguacuggauugaaagugagaaaaaugaaaccuggaagcuagcucgggccucuuucaucgaggugaagacuuguauauggccaaaaagccauacacugugguccaacggaguacucgaaucagagaugaucauucccaagaucuauggcgguccuauuagccaacacaauuaccgaccaggcuacuucacccagacugcagggccguggcaucugggaaaacuugaguuggauuuugaccugugcgaaggcacaaccgucgugguggaugagcacugcgggaacagaggacccucuuuaaggacgacuaccgucacaggcaagaucauacacgaaugguguugccgcuccuguacccucccuccacugcgguucagaggugaggacgggugcugguauggaauggagauuaggcccguuaaagaaaaggaggaaaaucuugugaagaguaugguaagcgcgggcucuggugagguggacuccuuuucacugggcuugcucuguaucaguaucaugauugaagaggucaugcgcagccgauggucgcggaaaaugcugaugacugggacacuagccguguucuuucugcucaucaugggacagcugaccuggaacgaucuuauucguuugugcauaaugguuggcgcuaaugccuccgacagaauggggaugggaacaacuuaccuggcauuaauggcuaccuucaagaugaggccuauguuugccgugggccuccuguuccgccggcuuacgucuagagagguccugcuacucacaaucggucugagcuugguggcaucaguugaacugccaaacaguuuagaggaacucggggauggacuggccaugggcauuaugauccuuaaacuguuggcugacuuucaaucccaucagcucugggcgacccugcuaucucugacuuucauuaagaccacauuuagccuucacuaugccuggaaaacuauggcaauggugcucuccaucgucucacuguuccccuugugucugagcaccacgagucagaagacaaccugguuaccgguacuccugggcucucuugggugcaagccucugacuauguuuuugauagcugagaauaaaaucuggggaaggcgauccuggccacucaacgaagguauuauggccgugggcaucguuagcauucugcuaucgucacugcuuaagaacgaugugccccucgccgggccucugaucgcuggaggcauguugauagcauguuacgucauuucugguaguuccgccgacuuaagccuggagaaagcggcugaggugucuugggaagaggaagccgagcauagcggggcaucccacaauauccucguagaagugcaggaugacggaacaaugaagaucaaagaugaggagcgcgacgauacccugacuauucuucugaaggccacauugcuagcugucucaggcguuuauccccugaguauaccagcaacccucuucgugugguacuucuggcagaaaaagaagcagcggagcggcgugcugugggacacgccuucucccccagaagucgagagagccgugcuugaugacgggaucuauaggauuaugcagcguggauuacugggucgcucccagguuggcguagggguguuucaagaaaacgucuuccauacuauguggcacgugacccggggagcgguucucauguaccagggcaaaagauuggagccgucaugggcuagugugaagaaagaccugaucagcuacggugggggauggaggcuccagggcuccuggaauacaggcgaggaaguccaggugauugccguagagccugggaagaaccccaaaaauguccaaaccgcaccaggaacauuuaagacucccgaaggugaggugggcgccaucgcucuggauuucaagccugggaccucuggaucgccaauaguuaaccgagaaggcaaaaucgugggucuuuaugggaauggagucgugacgacaagcggcacuuacguuucagccauugcacaggcuaaggccucccaggagggcccccugccugagaucgaagacgagguguuucggaaacgcaacuugaccauuauggaucuacacccggggaguggaaagacaagaagguaucugccagcgaucguccgggaagccauaaaacgaagacuccgcaccuuaauucuggcacccacuagggugguagcuucugagauggccgaagcucuuaaggguaugccuauccguuaccaaaccacagcaguaaagagcgagcauacgggcaaagagaucguugaccugaugugccacgccacuuucaccaugcggcucuuguccccagucagagugcccaauuauaacaugauuaucauggaugaagcccauuuuacagacccuucaucuauagcugcgaggggguacauuagcacccgcgugggaaugggcgaggcagccgcuaucuucaugacugccacaccgcccgguagugucgaagcauuuccacaguccaaugccguaauucaggaugaggaacgagacaucccugagagaagcuggaacucuggguaugaguggauaaccgauuuccccggaaagacggugugguuuguuccaucaauuaaauccggcaaugacaucgcuaacugucugcggaagaauggcaaaagggugauccagcucagucgcaagacuuucgauacagaauaccaaaagaccaaaaacaacgacugggacuacgucgugaccacugauauuagcgagaugggggcgaauuuccgugccgacagaguuaucgauccucggaggugccugaagcccgugauucuuaaagacggaccagaacgcgucauacuagcagguccgaugccugugacaguagcuucggccgcacagcgaagaggccggaucgggaggaaccacaauaaggagggagaucaguauauuuacaugggccagccccugaacaaugacgaggaucaugcccacuggaccgaagcuaaaauguuguuagacaacaucaauacaccagaggguaucauucccgcccuguuugaaccugagcgcgaaaagucugcggcaauagauggggaguauagacucaggggcgaggcccggaagacuuucguggaacugaugcgucgcggagaccuuccaguuuggcuguccuacaaagucgcuagcgagggcuuucaauauucagaucgaagauggugcuucgacggggaaaggaacaaucaggugcucgaggaaaacauggauguggagaucuggacgaaggagggagaacggaaaaaguugcgccccagauggcuggacgccaggaccuacagugacccucuagcucugcgggaguuuaaagaguucgcagccggucgaagaucugucuccggcgaucucauucuugagaucgggaagcugccgcagcacuuaacacagcgcgcucaaaaugccuuggacaaccugguuaugcuccauaauagcgaacagggaggcagggcauaucggcacgcgauggaggagcugccagauacuauugaaacccuuaugcugcucgccuugaucgcugugcugacaggugggguaaccuuauuuuuccuaucaggccguggacugggcaaaacaaguauagggcuccuuugugugauggccagcuccguccuguuguggauggcaucuguggagccccauuggaucgcugccagcauuauccuggaauuuuuccucaugguucugcuuauuccugagcccgacagacagaggacgccacaggauaaccaacucgcauacguggucaucggacuguuguuuaugauacugaccguagccgcuaaugagauggguuuacuagaaacaacuaagaaggaccugggcauugggcacguggcgguugagaaccaccaucacgccgcaaugcucgauguggaccuucauccugcuuccgccuggacccuguacgccgucgcaacaaccaucauuacucccaugaugcgccacacaaucgaaaacacgaccgcuaauauaucauugacugccaucgcgaaccaggcugccauucugaugggacucgauaaaggcuggccaaucucuaagauggacauuggugugccucugcuugcauuagggugcuauagucaggucaauccgcugacacucaccgccgcuguguugaugcugguugcacauuacgccaucauaggccccggacuacaagcgaaagcuacccgggaggcccagaagcgaacagcagccggcauuaugaaaaacccaacuguggaugggaucguagcuaucgaccuggauccuguggucuaugacgccaaguucgaaaagcagcucggacagauuaugcuucugaucuuguguacgucgcaaauacugcucaugagaaccacaugggcacugugcgagagcauuacuuuagcuaccggcccccuuacaacccugugggaggguuccccagggaaauuuuggaauacuacgaucgccguuucuauggcgaacauuuucaggggaucauaccucgccggcgcaggucuagcuuucagccugaugaaguccuugggcgggggacgccggggcacaggggcccagggagaaacccugggcgagaaauggaagagacagcucaaucagcuuaguaaaucugaauuuaacacuuauaagcguagcgguaucauggagguggacaggucagaagcaaaggaggggcugaaacggggagagaccacaaagcacgcugucucccgcggcacugccaaauugcgaugguucguggaaagaaaucugguaaagccugaggguaaagugauagaucucggcugugggaggggaggcuggaguuacuauugcgccggguuaaagaagguuaccgaagugaaaggauacacaaagggcggucccgggcacgaggaaccgaucccaauggcgacguacggauggaaccuggucaaacuucauagcggcaaggacguguuuuucauuccucccgagaaaugugauacccugcuaugcgacaucggcgagucuuccccaaaucccacuauugaagaggggcggacacuccgcguccugaagaugguggaaccuugguugagaggaaaccaauuuuguaucaaaauucugaauccguauaugcccucaguuguagagacccucgagcagaugcagaggaagcacgguggcaugcuugugcgaaacccacugagcagaaauucgacucaugaaauguacugggucucuugcgggacaggaaacaucgugagugcuguuaauaugaccucccguauguuacugaacagauucacgauggcacaccgcaagccuaccuaugagagggauguggacuugggcgccgguacacggcacgucgcuguggaacccgagguagccaaccucgauauaauugggcagagaaucgaaaauaucaaacaugagcacaagagcacuuggcauuacgacgaggauaacccuuauaaaaccugggcauaccacggaucauaugaagugaagccauccggcucugccagcaguaugguuaauggcgucgugaaacugcuaacaaagcccugggacgugauuccuauggucacucaaauagcuaugaccgauacaaccccauuugggcagcagcgcguuuucaaggagaaaguggacacuaggacgcccaaggcgaaacgaggaacagcccaaaucauggaaguaaccgcaaaguggcuuugggguuuucugucccggaacaaaaagccgagaauuuguacuagggaggaguucacccgcaaggugcguagcaaugcugccaucggcgcagucuuuguggacgagaaccaguggaacucugccaaagaggcuguugaagaugagcgguucugggaccucgugcauagagaaagggagcugcacaagcaggggaaaugcgccacaugcgucuacaacaugaugggaaagcgcgagaaaaaguugggcgaguuugguaaggcgaaagggucacgagcaauuugguacauguggcugggagcccgguuccucgaguucgaagcucuuggcuuuaugaaugaggaucacugguucaguagagaaaacucccugagcggcguggagggggagggauuacauaagcuggguuauaucuugagggacauaucuaaaaucccuggcgggaauauguacgccgaugacacggcaggaugggauacccgcauuacugaagacgaucuccagaacgaggcuagaaucacagacauuauggaaccagagcacgcccugcuagcuaagucgaucuuuaaacuuaccuaucaaaauaagguaguucgggugcagaggcccgccaaaaacggcacugucauggaugugauaucacgucgagaccagcgcgguagcggacaggugggaacauacggccugaauaccuucacaaacauggaagcacaacucauuagacagauggaguccgagggcaucuuuaguccuucugaacuggagacuccaaacuuggcggaacgggucuuagauuggcuggagaaguaugggguugaaaggcucaagcgcauggccaucagcggagacgacugugugguaaaacccauugaugacagauucgcuaccgcccuuacggcacugaaugauauggguaaggugcggaaagacauaccgcagugggagccuuccaagggcuggaacgauuggcagcaaguccccuuuugcucacaucacuuccaccagcuaaucaugaaagacgggagggagauugugguuccaugucgaaaucaggaugaacuggugggacgugcuagagucagucagggcgccgguuggucucuccgcgagaccgcaugcuugggaaagagcuacgcccaaauguggcagcugauguauuuucaucggagggaccuuagacuggcggcuaacgccaucuguuccgcagugccuguagauuggauucccacaucacgcacuaccuggagcauccacgcccaucaccaguggaugacaacugaagacaugcucucuguuuggaaucggguguggauagaggaaaacccauggauggaggauaagacccauaucuccaguuggggagacguccccuacuuaggcaaaagggaggaccaauggugcggcagccugauuggguugacggcucgagccacaugggcaaccaauauccagguggcuauuaaccagguuagacggcugaucggaaaugaaaacuaccucgauuauaugacuucgaugaagagguucaaaaaugaguccgacccugaaggugcccuuugguga

SEQ ID NO: 13756 - RNA, 9879 nt, Artificial Sequence
  derived and/or modified CDS sequence (opt3) from DENV-1__GQ199778__SS-prME
uccgugaccaugcugcucaugcuuaugcccacagcccuggcuuuccacuugacuacgcggggaggggaaccucauaugaucgucuccaagcaggaaaggggaaaaucuuuacuguuuaagaccucagccgguguuaacaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagaacaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagaggcauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccguagucgugggcgauguugcugggauucuggcccagggcaagaagaugauccgcccucaacccauggaguacaaauauucguggaaaagcuggggcaaggcgaagauaaucggggccgacgugcagaauacuaccuuuauuaucgauggaccaaacacaccugaaugucccgacgaucagagagcuuggaauauuugggaggucgaggacuacggcuucgguaucuuuacuaccaacauauggcuuaaguugagggauuccuauacacaggugugcgaccaccgucucaugucagcagccauuaaagauaguaaggcuguucacgccgacaugggguacuggaucgaaucugagaaaaaugaaacguggaagcuggcacgggcgagcuucauugaggugaagaccuguaucuggccaaaaucccauacucuauggucaaacggaguacuggaaagcgagaugauaauccccaagauuuauggcgguccuaucucucaacacaauuaccgaccaggcuacuucacacaggccgcugggccguggcaucucggaaaacuggagcuugauuuugacuugugcgaaggcaccacugucgugguggaugagcacugcgggaacagaggacccucccugaggacaaccacggucacuggcaagauuauccacgaaugguguugccgcaguuguaccuuaccuccacuccgguucagaggugaggacgggugcugguauggaauggagauaaggcccauuaaagaaaaggaggaaaaucugguuaagagcauggugucugccggcuccggugagguagacucauuuagucuuggccuguuguguaucagcaucaugauugaagaggugaugcgcucgcgauggucccggcguaugcucaugacagggacccuggcagucuucuuucuacugaucaugggacagcucacuuggaacgaucugauuagacuuugcauaauggugggcgcuaaugccucugacaggauggggaugggaacaaccuacuuggcacugauggccacauucaaaaugcgcccuauguuugcuguuggcuuacucuuccggagacugacuagcagggaggugcuucugcuaaccaucggucucucacuggucgcgaguguggaauugccaaacucccuggaggaauuaggggauggacucgccaugggcauuaugauccugaaacuucugacggacuuucaaucucaucaguugugggcaacacuccugagccuaaccuucauuaaaacuaccuuuucccugcacuaugcuuggaagacaauggccaugguucuuucaaucgugagccucuucccccuguguuugaguacuaccucucagaaaacgacauggcugccggucuuacucggcucccuggggugcaagccucuuaccauguuucugauagccgagaauaagaucuggggacgacgcagcuggccauugaacgaagguauuauggcuguaggcaucgugucgauucuccugucaucucuacugaaaaacgauguuccccuugcagggccucucaucgccggaggcaugcugauagcguguuacgugauuagugguuccagcgcugacuugucuuuagagaaggccgcagaggucagcugggaagaggaagccgagcauuccggggcuucacacaauauccugguggaaguacaggaugacggaacuaugaaaaucaaggaugaggagcgggacgauacacucaccauucugcuuaaagcaacucuguuggccgugaguggcgucuauccccuaagcauaccagcgacacuguucguuugguacuucuggcaaaagaaaaagcagagaucuggcgugcucugggacaccccuucacccccagaaguggagagggcuguccuggaugacgggaucuaucguauuaugcagcgcggacuuuuaggucggagccaggugggcguugggguauuucaagaaaacguguuccauacgauguggcacgucacuagaggagccgugcugauguaccagggcaagaggcucgagccgaguugggcaagcguuaaaaaggacuugaucuccuacggugggggauggcgacugcagggcucuuggaauaccggcgaggaagugcaggucauugccguggagccugggaaaaaccccaagaauguacaaacagcuccaggaaccuuuaaaacacccgaaggugaggucggcgccaucgcacucgauuucaagccugggacuucgggaagcccaauagugaaccgggaaggcaagaucguuggucuguaugggaauggaguggucaccacgucaggcacauacguguccgcuauugcccaggcgaaagccagucaggagggcccccuuccugagaucgaagacgagguuuuucgcaagagaaaccugacuauuauggauuugcacccggggucuggaaaaaccaggcgguaucuaccagcaaucgugcgagaagcuauaaagagaaaacugcgcacacucauuuuagcccccaccagggucguggcuagcgagauggcagaagcccugaaggguaugccuauccguuaccaaacuaccgccguaaaguccgagcauacaggcaaagagaucguggaccuuaugugccacgcuacguucacuaugcggcugcucucaccaguuagaguccccaauuauaacaugauuaucauggaugaagcgcauuuuaccgacccuucuagcauagcagccaggggguacauuaguacacgcgugggaaugggcgaggcugccgcaaucuucaugaccgccacuccgcccgguuccguggaggcuuuuccacagagcaaugcggucauucaggaugaggaacgagacaucccugagagaucuuggaacucaggguaugaguggauaacagauuuccccggaaagaccguaugguuugugccauccauuaaaaguggcaaugacaucgccaacuguuugcggaagaauggcaaaaggguuauccagcugagccgcaagacguucgauacugaauaccaaaagaccaagaauaacgacugggacuacguggucaccaccgauauuucggagaugggggcaaauuuccgugcugacagagugaucgauccucggaggugccucaagcccguuauucugaaagacggaccagaacgcgugauacuugccgguccgaugccugucacuguggcaucugccgcucagcgaagaggccggaucgggaggaaccacaauaaggagggagaucaguauauuuacaugggccagccccuaaacaaugacgaggaucaugcccacuggacagaagcgaaaaugcuguuggacaacaucaauaccccagaggguaucauucccgcauuauuugaaccugagcgcgaaaaguccgccgcuauagauggggaguauagacugaggggcgaggcccggaagacauucguagaacucaugcgucgcggagaccugccaguguggcuuagcuacaaaguugcuucagagggcuuucaauauagugaucgaagauggugcuucgacggggaaaggaacaaucagguccuggaggaaaacauggauguggagaucuggacuaaggagggagaacggaaaaagcuccgccccagaugguuggacgcaaggacguacucugacccucuggcccuacgggaguuuaaagaguucgcugccggucgaagauccgugagcggcgaucugauucucgagaucgggaaacuuccgcagcaccugacccagcgcgcacaaaaugcguuagacaacuuggucaugcugcauaauucagaacagggaggcagggccuaucggcacgcuauggaggagcucccagauacaauugaaacucugaugcuucuggcccucaucgcaguuuugaccgguggggugacacuguuuuucuuaaguggccguggacuaggcaaaaccagcauagggcugcucuguguaauggcuuccucugugcuucuguggauggccagcgucgagccccauuggaucgcagccuccauuaucuuggaauuuuuccugauggugcuccugauuccugagcccgacagacagaggacuccacaggauaaccaacuugcuuacguugugaucggacuccuguuuaugauauugacggucgcggccaaugagaugggucuguuagaaaccacaaagaaggaccuaggcauugggcacguagcaguggagaaccaccaucacgcugccaugcuggauguugaccuccauccugccucagcauggacucuuuacgcuguggccaccacaaucauuacccccaugaugcgccacacuaucgaaaacacaacggcgaauauaucucugaccgcuaucgccaaccaggcagccauuuugaugggacuggauaaaggcuggccaaucaguaagauggacauuggugucccucuccuggcucuugggugcuauagccaggugaauccguuaacucugacagcagccguccucauguugguggcgcauuacgcuaucauaggccccggacugcaagccaaagcaacccgggaggcccagaagcgaaccgcugccggcauuaugaaaaacccaacaguugaugggaucguggcaaucgaccuagauccuguaguguaugacgcuaaguucgaaaagcagcugggacagauuaugcuccuuauccuguguacuagccaaauauugcugaugagaacgaccugggcccucugcgaguccauuacacuggcgacuggccccuuaaccacacuuugggaggguucuccagggaaauuuuggaauaccacuaucgccgucucaauggcaaacauuuucaggggaagcuaccuggcuggcgccggucucgcauucucccuaaugaagagucugggcgggggacgccggggcacgggggcucagggagaaacauugggcgagaaauggaagagacagcugaaucagcucucuaaaagcgaauuuaacaccuauaagcguucagguaucauggagguugacagguccgaagccaaggaggggcuuaaacggggagagacuaccaagcacgccgugagucgcggcacagcgaaacugcgaugguucgucgaaagaaauuuggugaagccugaggguaaaguaauagaucugggcugugggaggggaggcuggagcuacuauugcgcugggcucaagaaggugacugaaguuaaaggauacaccaagggcggucccgggcacgaggaaccgaucccaauggcaacauacggauggaacuuagugaaacugcauucuggcaaggacgucuuuuucauuccucccgagaaaugugauacgcuucugugcgacaucggcgaguccucaccaaaucccaccauugaagaggggcggacucuacgcgugcucaagauggucgaaccuuggcugagaggaaaccaauuuuguaucaaaauuuugaauccguauaugcccagcgugguugagacacuggagcagaugcagaggaagcacgguggcaugcucguacgaaacccacuuucgagaaauucuacccaugaaauguacugggugaguugcgggacuggaaacaucgucuccgccgugaauaugacaagccguaugcuguuaaacagauucaccauggcucaccgcaagccuacguaugagagggauguugaccugggcgccgguacccggcacguggcagucgaacccgagguggccaacuuggauauaauugggcagagaaucgaaaauaucaaacaugagcacaagucaacauggcauuacgacgaggauaacccuuauaaaacuugggcuuaccacggauccuaugaaguaaagccaucuggcagcgcgaguuccauggugaauggcguugucaaacuccugaccaagcccugggacgugauuccuauggugacacaaauagccaugacugauaccacaccauuugggcagcagcgcgucuucaaggagaaaguugacaccaggacucccaaggcaaaacgaggaacggcucaaaucauggaagugacagccaaguggcuaugggguuuucuuagccggaacaaaaagccgagaauuuguaccagggaggaguucacucgcaagguacguucuaaugcagccaucggcgcuguguuugucgacgagaaccaguggaacucagccaaagaggcgguggaagaugagcgguucugggaccugguucauagagaaagggagcuccacaagcaggggaaaugcgcaaccugcguguacaacaugaugggaaagcgcgagaaaaagcugggcgaguuugguaaggccaaagggagucgagcuauuugguacaugugguugggagcccgguuccuggaguucgaagcacucggcuuuaugaaugaggaucacugguucuccagagaaaacagccuuucuggcgucgagggggagggacugcauaaguuagguuauauccugagggacauaucgaaaaucccuggcgggaauauguacgcugaugacacagccggaugggauacgcgcauuaccgaagacgauuugcagaacgaggcuagaaucacugacauuauggaaccagagcacgcccuccuggcaaagucaaucuuuaaacuaacauaucaaaauaaggugguacggguucagaggcccgcgaaaaacggcaccgugauggaugucauaagccgucgagaccagcgcgguuccggacaggugggaacuuacggccuuaauacauucaccaacauggaagcccaacugauuagacagauggagagugagggcaucuuuucuccuagcgaacucgagacaccaaaccuggcugaacggguguuggauugguuagagaaguauggggucgaaaggcugaagcgcauggccaucuccggagacgacuguguugugaaacccauugaugacagauucgcaacugcucucaccgcccuuaaugauauggguaagguacggaaagacauaccgcagugggagccuucaaagggcuggaacgauuggcagcaagugcccuuuugcagucaucacuuccaccagcugaucaugaaagacgggagggagauugucgugccaugucgaaaucaggaugagcuaguuggacgugcaagagugucucagggcgccgguuggagccugcgcgagacggcgugccucgggaaguccuacgcucaaauguggcaguugauguauuuucaucggagggaccugagacuugccgcaaacgccaucuguucagcugucccuguggauuggauucccaccagccgcacaacuuggucuauccacgcccaucaccaguggaugaccacagaagacaugcuguccguauggaaucggguuuggauagaggaaaacccauggauggaggauaagacucauaucaguagcuggggagacgugcccuaccucggcaaaagggaggaccaauggugcggcucguuaauugggcugaccgcacgagcuacgugggccacaaauauccaggucgcgauuaaccaggugagacgguugaucggaaaugaaaacuaccuggauuauaugaccuccaugaagagguucaaaaaugagucugacccugaaggugcucucugguga

SEQ ID NO: 13757 - RNA, 9879 nt, Artificial Sequence
  derived and/or modified CDS sequence (opt3) from DENV-1__GQ199780__SS-prME
uccgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucugcucugcucaagaacgaugugccccuggcagggccucuuauugccggaggcaugcucaucgcguguuacgucauaagugguuccagcgcugaccugucuuuggagaaggccgcagaggugagcugggaagaggaagccgagcauuccggggcuucacacaauauuuuaguagaagugcaggaugacggaacuaugaaaaucaaggaugaggagagggacgauacacugaccauccuccugaaggcaacucuucuggccgucaguggcguuuaucccuugagcauuccagcgacacuauucgugugguacuuuuggcagaaaaagaaacaacgaucuggcgugcugugggacaccccuucacccccagaagucgagcgcgcugugcucgaugacgggauauaucggaucaugcagagaggacugcuugguaggagccagguuggcguagggguguuccaggaaaacgucuuucauacgauguggcacgugacucguggagccguuuuaauguaccaaggcaagcgccuggagccgaguugggcaagcgugaaaaaggaccucauuuccuacggugggggauggcgguugcagggcucuuggaauaccggcgaggaaguccaggugaucgccguagagccugggaagaaccccaaaaauguccagacagcuccaggaaccuucaagacaucggaaggugaggugggcgccauugcacuggauuuuaaacccgggacuagcggaucaccuaucguuaacagagaaggcaagauagugggucucuaugggaauggagucgugaccacguccggcacauacguuagugcuaucgcccaagcgaaagccucucaggagggcccacugcccgagauugaagacgagguguucaggaagcgaaaccuuacuaucauggaucugcacccugggagcggaaagacccggcgcuauuugccggcaauugucagagaagcuaucaaaaggaagcuacggacacugauacucgccccaacccgagugguagcuuccgagauggcagaagccuuaaaagguaugcccauuagauaccagacuaccgccgugaagucagagcauacaggcaaagagaucguugaccugaugugccacgcuacguuuacuaugcgccuucugucuccugucagggugccaaauuauaacaugaucauuauggaugaagcgcauuucaccgaccccagcaguaucgcagcccguggguacauauccacacgggugggaaugggcgaggcugccgcaauuuuuaugaccgccacuccuccggguagcgucgaggcuuucccccaaucuaaugcgguaauccaggaugaggaaagagacauuccagagaggucauggaacuccggguaugaguggaucacagauuuuccuggaaagaccgugugguucguucccaguauaaagagcggcaaugacauugccaacugucuccgcaaaaauggcaagcgagugauccaguugucgagaaaaacguucgauacugaauaccagaagaccaaaaacaacgacugggacuacgucgugaccaccgauaucucugagaugggggcaaauuuucgggcugacaggguuauugauccacgccguugccugaagccugugauccucaaggacggacccgaaagagucauucuggccgguccaaugccggugacuguagcauccgccgcucaacggaggggccgcauagggcgaaaccacaauaaagagggagaucaguauaucuacaugggccagccucuuaacaaugacgaggaucaugcccacuggacagaagcgaagaugcuacuggacaacauuaauacccccgaggguaucaucccagcauuguucgaacccgagagagagaaaagcgccgcuauugauggggaguaucgguuaaggggcgaggcccgcaagacauuuguggaacugaugagaaggggagaccucccuguuuggcugucauacaaagucgcuagugagggcuuccaguauucugaucggcguuggugcuuugacggggaacgcaacaaucaagugcuugaggaaaacauggauguggagauauggacuaaggagggagaaaggaaaaagcugagaccaagauggcucgacgcacggacguacuccgaccccuuggcccugcgcgaguucaaggaauuugcugccgguagaaggagcgucucaggcgaucuaauccuggagauugggaaacucccucagcaccuuacccagcgggcacagaaugcgcuggacaacuuaguuauguugcauaauagugaacaaggaggccgagccuauagacacgcuauggaggagcugccggauacaaucgaaacucucaugcugcuugcccugauugcagugcucaccggugggguaacauuguucuuucugagcggccgcggauuaggcaagaccuccaucgggcuacugugugugauggcuucuagcguccuccuuuggauggccuccguggagccacauuggauagcagccucaaucauucuggaguucuuuuugaugguucugcucauccccgagccugacaggcagcggacuccccaggauaaccagcuggcuuacguggucauuggacuucucuucaugauccugacgguagcggccaaugagauggguuugcuggaaaccaccaaaaaggacuuaggcauagggcacguggcaguugagaaccaccaucacgcugccaugcuagauguggaccugcauccagccucugcauggacucucuacgcugucgccaccacaauuaucaccccuaugaugcgucacacuauugaaaacacaacggcgaauaucagucuuaccgcuauagccaaccaagcagccauccugaugggauuggauaaaggcuggcccauuucgaagauggacaucggugugccacugcucgcucuggggugcuauagccaggucaauccucuuacuuuaacagcagccgugcugaugcucguugcgcauuacgcuauuaucggcccgggauugcaggccaaggcaaccagagaggcccagaaaaggaccgcugccggcauaaugaagaaccccacaguggaugggauuguagcaaucgaccuggauccaguggucuaugacgcuaaauuugaaaagcagcuaggacagaucaugcugcucauucuuuguacuucccagauccuguugaugcgcacgaccugggcccugugcgagucuauaacacucgcgacuggcccucugaccacauuaugggaggguucacccgggaaauucuggaauaccacuauugccguuagcauggcaaacaucuuccggggauccuaccuugcuggcgccggucuggcauuuagucucaugaagucucuaggcgggggacgaagaggcacgggggcucaaggagaaacacugggcgagaaguggaaaaggcaguugaaucagcugagcaagucagaguucaacaccuauaaacgcuccgguauuauggagguggaccggagugaagccaaggaggggcucaaaagaggagagacuaccaagcacgccgucagccguggcacagcgaaacuuaggugguuuguggaacggaaucugguaaaaccagaggguaaggugaucgauuugggcugugggcgcggaggcuggucuuacuauugcgcugggcugaaaaagguuacugaagugaaaggauacaccaagggcgguccugggcacgaggaacccauaccgauggcaacauacggauggaaccucgucaaauuacauuccggcaaggacguguucuuuaucccaccugagaagugugauacgcugcuuugcgacauuggcgagucaagccccaauccaaccaucgaagaggggcgaacucugagaguccuaaaaaugguggaacccuggcucaggggaaaccaguucuguauuaagauccugaauccuuauaugccgucgguuguagagacauuggagcaaaugcagcggaaacacgguggcaugcuggugcgcaacccccucucuagaaauaguacccaugaaauguacugggucuccugcgggacuggaaacauugugagcgccguuaauaugacaucaaggaugcuucugaaccgauuuaccauggcucaccggaagccaacguaugagcgugauguggacuuaggcgccgguaccagacacgucgcaguggaaccugagguagccaaccuggauaucauagggcagcgcauugaaaauaucaaacaugagcacaaguccacauggcauuacgacgaggauaaccccuauaagacuugggcuuaccacggaucuuaugaagugaaaccuagcggcagugcguccagcaugguuaauggcgucgugaaguugcucaccaaaccaugggacgugauccccauggucacacagauugccaugacugauaccacaccuuucgggcaacagaggguuuuuaaggagaaaguggacacccggacuccaaaggcaaagagaggaacggcucagauaauggaaguaacagccaaauggcugugggguuuccuaucucgcaacaagaaacccaggaucuguacccgagaggaauuuacucggaaggugagaucaaaugcagccauuggcgcugucuucguggacgagaaccaauggaauagugccaaagaggcgguugaagaugagagguuuugggaccuugugcaucgcgaacgugagcugcacaagcaggggaagugcgcaaccugcgucuacaacaugaugggaaaacgggaaaagaaacucggcgaguucgguaaggccaaaggguccagagcuaucugguacauguggcugggagccagguucuuggaguuugaagcacugggcuucaugaaugaggaucacugguuuagccgcgaaaacucucucucgggcguggagggggagggacuucauaagcuggguuauauuuuacgagacaucucaaaaauaccgggcgggaauauguacgcugaugacacagccggaugggauacgcggaucaccgaagacgaucugcagaacgaggcuaagauuacugacaucauggaaccugagcacgccuugcucgcaaagagcauuuucaaacugacauaucagaauaagguaguuagagugcaaaggccagcgaaaaacggcaccgucauggaugugaucucccgcagagaccagcgggguaguggacaggugggaacuuacggccuaaauacauuuaccaacauggaagcccagcuuauaaggcaaauggagucugagggcauuuucagccccuccgaacuggagacaccuaaccucgcugggcguguccuggauugguuggaaaagcauggaguugagcgauuaaaacgcauggccaucucaggugacgacugugugguaaagccaaucgaugacagauuugcaacugcucugaccgcccucaaugauaugggcaaggugcggaaagacgucccccagugggaaccgaguaagggguggaacgauuggcaacaggugccuuucugcucucaccacuuucaucaacuuauuaugaaagacggaagggagauaguugugcccugucgcaaucaggaugagcuggucggcagagcacgggugagccagggugccggguggucccuaagggaaacggcgugccugggaaagucauaugcucagauguggcaacucauguacuuccaccgacgugacuugagacuggccgcaaacgccaucuguagcgcuguaccaguugauugggugccuaccucucgcacaacuugguccauucaugcccaccaucaguggaugaccacagaggacaugcuuagugucuggaaucggguguggaucgaagagaaccccuggauggaagauaaaacucacauuagcucguggggcgacguuccauaucugggcaagagggaggaccaguggugcgggucccucaucggauuaaccgcaagagcuacgugggccacaaauauacaaguggcgaucaaccagguccgccggcugauugguaaugagaacuacuuggauuacaugaccucuaugaagagguuuaaaaaugaaucagaccccgagggcgcucugugguga

SEQ ID NO: 13758 - RNA, 9879 nt, Artificial Sequence
  derived and/or modified CDS sequence (opt3) from DENV-1__GQ199781__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccgccacgcggcuggaaaacauuauguggaaacagaucucuaacgagcucaaucauauucuguuagaaaacgacaugaaguucacaguagucgugggcgauguuguggggauccuggcacagggcaaaaagaugauacgcccucaacccauggagcacaaauacucguggaaaagcuggggcaaggcuaagaucauuggggccgacgcgcagaauaccacuuuuaucauugauggaccaaacaccccugaaugucccgacgaucagagagccuggaauaucugggaggucgaggacuauggcuucgguauauuuacaacuaacauuuggcuuaaguugagggauuccuacacccaggcuugcgaccaccgucucaugucagcagccaucaaagauaguaaggcugugcaugccgacaugggguauuggauugaaucugagaaaaaugaaacauggaagcuggcacgggcgagcuucaucgagguuaagacguguauauggccaaaaucccacacccuauggucaaacggagugcuggaaagcgagaugguaauccccaagauuuacggcgguccuaucucucaacauaauuaucgaccaggcuacuucacucagacagccgggccguggcaccucggaaaacuggagcuugauuuugacuugugcgaaggcaccacugucgugguggaugagcacugcgggaacagaggacccucccugaggacaaccacggucacuggcaagauuauccaugaaugguguugccgcaguuguaccuuaccuccacuccgguucaaaggugaggacgggugcugguacggaauggagauaagacccguuaaggaaaaggaggaaaaucuggugaaaagcaugguaucugcuggcuccggugagguggacucauuuagucuuggccuguuguguauuagcaucaugaucgaagaggucaugaggucgcgcuggucccgaaagaugcucaugacagggacccuggccguguuccuacugcucauuaugggacagcugacuuggaacgaucuuauccgguugugcauuaugguuggcgcaaaugcuucugaccguauggggaugggaacaaccuaucuggccuuaauggcaacauuuaaaaugagaccuauguucgccgugggccuccuguuuaggcgccuuacuagccgggagguccugcuacucaccauaggucugucauugguggcuaguguugaacugccaaacuccuuagaggaacucggggauggacuggcgaugggcaucaugauucuuaagcuguugacggacuuccaaucucaccagcucugggccacacugcuaagccugaccuuuaucaaaacuacccuuucccuccauuacgcauggaagacaauggcuauggugcugucaauugucagcuuguucccccuguguuuaaguacuaccucucagaagacgacauggcucccgguacugcuuggcucccuggggugcaaaccuuugaccauguuucucaucgccgagaauaagauauggggaagaaaaagcuggccacugaacgaagguaucauggccgugggcguugugucgauucuacugucaucucuucucaagaacgaugucccccuggcugggccuuugaucgcaggaggcauguuaauugccuguuaugugaucagugguuccagcgcggaccugucucucgagaaagcugccgagguaagcugggaagaggaagcagagcacuccggggccucacauaauauacugguggaaguccaggaugacggaacuaugaagauuaaagaugaggagagggacgauacacuuaccauccuguugaaggcuacucuacuggcaguuaguggcguguacccccucagcaucccagccacacuguucgugugguauuuuuggcaaaagaaaaagcagcgaucuggcguccuuugggacaccccuucacccccagaaguggagcgcgcgguuuuagaugacgggauuuaccggauaaugcagagaggacugcucgguaggagccagguaggcgugggggucuuccaagaaaacguguuccacacgauguggcacguuacucguggagcuguguugauguaucagggcaaacgccuggagccgaguugggccagcgucaagaaagaccucaucuccuacggugggggauggcggcugcagggcucuuggaauaccggcgaggaagugcagguaauugcagucgagccugggaagaaccccaagaaugugcaaacagccccaggaaccuuuaaaacacccgaaggugagguuggcgcuaucgcccuugauuucaagccugggacuucgggaagcccaauugugaacagagaaggcaaaaucgucggucuguacgggaauggagugguuaccacgucaggcacauauguguccgcaauagcucagacuaaggccagucaggagggccccuugccugagaucgaagacgaggucuuuaggaaacgaaaccuaaccauuauggaucugcauccggggucuggaaagacacggcgcuaccucccagcgaucauuagagaagccaucaagaggaaauuacggacccugauacuugcacccacucgagugguagcuagcgagauggccgaagcucugaaggguaugccuauuagauaucaaaccacagcagugaaauccgagcacacgggcaaggagaucguugaccucaugugccaugccacuuucaccaugcgcuugcugucaccagucagggugcccaauuacaacaugaucauuauggaugaagcccacuuuacagacccuucuagcaucgcugcgcguggguauauaaguacccgggugggaaugggcgaggcagccgcuauuuucaugacugccacaccgcccgguuccgucgaagcauuuccacagagcaaugccguaauccaggaugaggaaagagacauuccugagaggucuuggaacucaggguacgaguggaucaccgauuuccccggaaaaacggugugguuuguuccauccauaaagaguggcaaugacauugcuaacugucuccgcaagaauggcaaacgagugauccagcugagcagaaagacuuucgauacagaauaucagaaaaccaagaacaacgacugggacuacgucgugaccacugauaucucggagaugggggcgaauuuucgggccgacaggguuauugauccucgccguugccuuaaacccgugauccuaaaggacggaccagaaagagucauucuggcagguccgaugccugugacaguagcuucugccgcacagcggaggggccgcauagggcgaaaccauaauaaggagggagaucaguacaucuauaugggccagcccuugaacaaugacgaggaucacgcccacuggaccgaagcuaaaauguuacuggacaacauuaauacaccagaggguaucauccccgcccucuucgaaccugagagagaaaaguccgcggcaauugauggggaguaccggcugaggggcgaggcccgcaaaacuuucguggaacuuaugagaaggggagaccugccaguuuggcucagcuauaaggucgcuucagagggcuuucaauacagugaucggcguuggugcuucgacggggaacgcaacaaucagguguuggaggaaaacauggauguggagauauggacgaaagagggagaacgaaagaaacugagacccagguggcuagacgcccggaccuauucugacccucuggcucuccgcgaguuuaaggaguucgcagccgguagaagguccgucagcggcgaucuuauccuggagauugggaaguuaccgcagcauuugacacagcgggcucaaaaugcccuggacaaccucguuaugcugcacaauucagaacagggaggccgagcauacagacaugcgauggaggagcuuccagauacuaucgaaacccugaugcucuuggcccugauugcuguguuaacaggugggguaacccuauuuuuccugaguggccgcggacucggcaaaacuagcaucgggcuucugugugugauggccuccucugucuugcuguggauggcaagcguggagccccacuggauagcugccuccaucauucucgaauuuuuccugaugguucuucucaucccugagcccgacaggcagcggacgccacaggauaaccaacuggcauauguggucauuggauugcuguuuaugaucuuaaccguagccgcuaaugagaugggucuacuggaaacaacuaagaaagaccucggcauagggcacguggcgguugagaaccaucaccaugccaccaugcuugauguggaccugcacccugcaucagcuuggacauuguacgccgucgccaccacuauuaucacacccaugaugcgucauacgauugaaaacaccacugcaaauaucucucugacagcuauagccaaccaggcggcuauccucaugggacuggauaagggcuggccaauuaguaaaauggacaucggugugccucuuuuagcccuggggugcuacucgcaggucaauccgcucaccuugaccgcagccgugcugaugcuaguugcucacuaugcaauuaucggccccggacugcaagccaaggcgacaagagaggcucagaagaggacugccgcaggcauaaugaaaaacccaacgguggaugggauuguagccaucgaccucgauccuguggucuacgacgcuaaguucgaaaaacagcuuggacagaucaugcuguugauucuguguaccagccaaauccuccugaugcgcacaacuugggccuuaugcgaguccauaacccuugcaacaggcccccugaccacucucugggaggguucuccagggaaguuuuggaauacgacaauugcuguuucaauggccaacaucuuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacauuuacaagcgcucagguaucauggagguggaccgguccgaagccaaagagggguugaagagaggagagaccacacgucacgcagucaguaggggcacugcuaaacugcggugguucguggaacgcaaucucguaaagccugaggguaaggugauagauuuaggcugugggcgaggaggcuggagcuauuacugcgccgggcugaaaaagguuaccgaagugaaaggauauacaaagggcggucccgggcaugaggaaccgaucccaauggccacguacggauggaaccuugucaaacugcacucuggcaaggacguguuuuucgcgccucccgagaaaugugauacccuacucugcgacauuggcgaguccucaccaaaucccacuaucgaagaggggagaacacugagggucuugaagaugguggaaccuuggcugcggggaaaccaauuuuguauuaagauccucaauccguacaugcccagcguuguagagacccuugagcagaugcagcgcaaacaugguggcaugcuggugagaaacccauuaucgagaaauucuacucacgaaauguauugggucaguugcgggacaggaaacauuguguccgcuguuaauaugaccagccgaaugcuguugaaccgguucacgauggcacaccguaagccuaccuacgagagagauguggaccucggcgccgguacacgccaugucgcuguggaacccgagguagccaaccuggauaucauagggcagaggauugaaaauaucaaacacgagcauaagucaacuuggcacuaugacgaggauaacccuuacaaaaccugggcauaucauggauccuacgaagugaagccaucuggcagcgccaguuccaugguuaauggcgucgugaagcuacuuacaaaacccugggacgugaucccuauggucacucaaauugcuaugaccgauacaaccccauuugggcagcagcggguuuucaaggagaaaguggacacuagaacgcccaaggcgcgcaggggaacagcccaaauaauggaaguaaccgcacgauggcugugggguuuucucagccggaacaaaaagccgagaaucuguacuagggaggaguucacccgcaaggugcguucuaaugcugccauuggcgcagucuuuguggacgagaaccaguggaacucagccaaagaggcuguugaagaugagcgguucugggaccuggugcagaaggaaagagaguugcacaaacaggggaagugcgccacaugcgucuauaacaugaugggaaaaagggaaaagaagcugggcgaguuugguaaagcgaaggggagucgcgcaaucugguacauguggcucggagcccgauuccuugaguuugaagcucugggcuucaugaaugaggaucacugguucucccgggaaaacagcuuaucuggcguggagggggagggacugcauaaauuggguuacauucucagagacaucucgaagauaccuggcgggaauauguaugccgaugacacggcaggaugggauaccaggaucacugaagacgaucugcaaaacgaggcuaaaauuacagacaucauggaaccagagcacgcccuacuugcuaccucaauuuuuaagcugacuuaccagaauaaaguaguucgcgugcagagacccgccaagaacggcacagucauggaugugaucagccggagggaccagcgugguuccgggcaagugggaaccuauggccucaauacauucacuaacauggaagcacagcugauacgacagauggagagugagggcauauuuuugccuucugaauuagagaccccaaaccuggcggaacgcguccucgauuggcuugagaagcaugggguugaaagacugaaacggauggccaucagcggagacgacugugugguaaagcccaucgaugacagguucgcuacggcccuaaccgcacugaaugauauggguaaagugcgcaaggacauuccgcagugggagccuuccaaaggcuggaacgauuggcaacagguccccuuuugcucacaccacuuccaucagcucauaaugaaggacgggagagagaucgugguuccaugucggaaucaggaugaauuggugggaagggcucgagucagucaaggcgccgguuggucucugcgugagacagcaugccuugggaaguccuacgcccagauguggcagcugauguauuuucacagacgcgaccuccgguuagcggcuaacgccauuuguuccgcagugccuguagauuggguucccacuucaaggaccacauggagcauccaugcccaccaucaauggaugacuaccgaagacaugcugucuguguggaauagagucuggauugaggaaaacccauggauggaggauaaaacgcacguguccaguuggggagacguucccuacuugggcaagcgcgaggaccaguggugcggcagccugaucgggcucacagcucgggccaccugggcaucgaauauacagguggcuaucaaccaggucaggcgacuuauuggaaaugaaaacuaucuggauuacaugacuuccaugaaaagauucaagaaugagggugacccugaaggcgcccuaugguga

SEQ ID NO: 13759 - RNA, 9879 nt, Artificial Sequence
  derived and/or modified CDS sequence (opt3) from DENV-1__GQ199782__SS-prME
agcgugaccaugcugcucaugcuuaugcccaccgcccuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacaugggugaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaaaaucauaggggcggacauccagaauacuaccuuuauuaucgauggaccaaacacaccugaaugucccgacgaucagagagccuggaauauuugggaggucgaggacuauggcuucgguaucuuuacuaccaacauauggcuuagguugcgugauuccuacacacaggugugcgaccaccggcucaugucagcugcaauuaaggauaguaaagccguucaugcugacaugggguauuggaucgaaucugagaagaaugaaacguggaaacuggcccgagcauccuucauugaggugaagaccuguaucuggccaaagucccacacucuauggucaaacggaguacuggaaagcgagaugauaauccccaaaauuuacggcgguccuaucucucaacauaauuauagaccaggcuacuucacacagaccgcggggccguggcaccucggaaagcuggagcuugauuuugacuugugcgaaggcacuacagucgugguggaugagcacugcgggaacaggggacccucccugcgcaccacgacugucaccggcaaaauuauccaugaaugguguugccggaguuguacauuaccuccacucagauucaagggugaggacgggugcugguacggaauggagauaaggcccguuaaagaaaaggaggaaaaucugguaaagagcaugguaucugccggcuccggugagguggacucauuuagucuuggccuguuguguauuagcaucauggucgaagaggugaugcgcucgcgauggucccggaaaaugcucaugaccgggacucuggcuguuuuccuacugcucaucaugggacagcugacauggaacgaucuuauucguuugugcaucauggugggcgccaaugcaucugacagaauggggaugggaaccacauaucuggcuuuaauggccacuuuuaagauuaggccuauguucgcagucggccuccuggugcgccggcuuaccagcagagagguucugcuacucacgauaggucugucauugguggccagugucgaacugccaaacuccuuagaggaacucggggauggacuggcuaugggcaucaugauucuuaaacuguugacagacuuucaaucucaccagcucugggcgacccugcuaagccugacuuucaucaagaccacacuuucccuccauuacgccuggaaaacuauggcaaugguacugucaauugugagcuuguuuccccuguguuuaaguaccacgucucagaagacaaccuggcucccgguucugcuuggcucccuggggugcaagccuuugacuauguuccucaucacagagaauaaaauauggggaagaaagagcuggccacugaacgaagguaucauggcugugggcgucgugucgauucuacugucaucucuucucaaaaacgauguaccccuggccgggccuuugaucgccggaggcauguuaauugcuuguuaugugaucagugguuccagcgcagaccugucucucgagaaggccgcggaggucagcugggaagaggaagcugagcacuccggggccucacauaauauacugguugaagugcaggaugacggaaccaugaaaauuaaggaugaggagcgagacgauacucuuacaauccuguugaaagcaacccuacuggccgugaguggcgucuacccccucagcaucccagcuacgcuguuugugugguauuucuggcaaaagaagaaacagcgcucuggcguucuuugggacacuccuucacccccagaaguagagcgggcaguguuagaugacgggauuuacagaauaaugcagaggggacugcucggucguagccaggucggcguggggguuuuucaagaaaacguguuccacaccauguggcacgucacacgcggagccguguugauguaucagggcaagcggcuggagccgaguugggcgagcguaaagaaggaccucaucuccuacggugggggauggagacugcagggcucuuggaauaccggcgaggaaguccaggugauugcuguugagccugggaaaaaccccaagaaugugcaaacagccccaggaacuuucaagacccccgaaggugaggucggcgcaaucgcccuugauuuuaaaccugggacgucgggaagcccaauugugaacagggaaggcaagaucguuggucuguacgggaauggaguggucacaacuucaggcaccuauguguccgcuauagcccaggcaaaagcuagucaggagggccccuugccugagaucgaagacgagguauuccgaaagcggaaccuaacaauuauggaucugcauccggggucuggaaaaacccgcagauaccucccagccaucgugagggaagcgauuaagcggaaguuacgaacucugauccuugcccccaccagaguugucgcaagcgagauggcugaagcccugaaagguaugccuauacgcuaucaaacaacggcugugaaguccgagcacacuggcaaagagauuguggaccucaugugccaugcaaccuuuacaaugagguugcugucaccaguccguguacccaauuacaacaugaucaucauggaugaagcccacuucaccgacccuucuagcauugccgcucggggguauaucaguacuagagugggaaugggcgaggcggcagccauauuuaugacagcuaccccgcccgguuccguugaagccuucccacagagcaaugcagugauucaggaugaggaaagggacaucccugagcgcucuuggaacucaggguacgaguggauuacggauuuucccggaaagacugucugguucgugccauccaucaaaaguggcaaugacauagccaacugucuccgaaagaauggcaagagaguuauucagcugagccggaaaacauuugauaccgaauaucaaaagaccaaaaacaacgacugggacuacguggucacuacagauaucucggagaugggggcuaauuucagggcggaccgcgugaucgauccucguagaugccuuaagcccguaauucuaaaagacggaccagaacgggugauccuggccgguccgaugccuguuaccgucgcaucugcugcccagaggcgcggccgaauugggagaaaccauaauaaggagggagaucaguacauauauaugggccagcccuugaacaaugacgaggaucacgcacacuggacagaagccaagauguuacuggacaacaucaauacuccagaggguauuauccccgcucucuuugaaccugagcgggaaaaauccgccgcgaucgauggggaguacaggcugcgcggcgaggcaagaaagacguucguggaacuuaugaggcggggagaccugccaguguggcucagcuauaaagucgccucagagggcuuccaauacagugaucgucgcuggugcuuugacggggaacgaaacaaucagguuuuggaggaaaacauggauguggagauuuggaccaaggagggagaaaggaaaaagcugaggccccgguggcuagacgcucgcacauauucugacccucuggcccucagagaguucaaagaauuugcugcagguaggcgguccguaagcggcgaucuuauacuggagaucgggaaguuaccgcagcauuugacucagcgagcccaaaaugcucuggacaaccucgugaugcugcacaauucagaacagggaggcagagccuaccgccaugcaauggaggagcuuccagauaccauugaaacacugaugcucuuggcgcugaucgccgucuuaaccgguggggugacucuauucuuucugaguggcaggggacucggcaagacgagcauugggcuucuguguguuauggcuuccucuguguugcuguggauggccagcgucgagccccacuggaucgcagcuuccauaauccucgaguucuuucugaugguacuucucauuccugagcccgaccggcagcguaccccacaggauaaccaacuggccuaugugguuaucggauugcuguucaugauuuuaacaguggcagccaaugagaugggucuacuggaaacuaccaaaaaggaccucggcaucgggcacgucgcuguggagaaccaucaccaugcgacaaugcuugaugucgaccugcacccugccucagcauggaccuuguacgcuguggccacuacaauaauuacgcccaugaugagacauaccaucgaaaacacuacagccaauauuucucugaccgcaaucgcuaaccaggccgcgauacucaugggacuggauaaaggcuggccaaucaguaagauggacauugguguuccucuuuuagcucuggggugcuacagccaggugaauccgcucaccuugacagccgcaguacugaugcuaguggcccacuaugcuaucauuggccccggacugcaagcaaaagccacuagggaggcgcagaagcgcacggcugccggcaucaugaagaacccaaccgucgaugggauaguugcaauugaccucgauccuguggucuacgacgccaaauuugaaaagcagcuuggacagaucaugcuguugauccuguguacaagccaaauucuccugaugcggacuaccugggcuuuaugcgaguccaucacacuugccaccggcccccugacuacgcucugggaggguucuccagggaaauucuggaauacaaccauagcagugucaauggcuaacauuuuucgaggaagcuaucuagccggcgcgggucuggccuucuccuugaugaagagucugggcgggggaagaaggggcacuggggcacagggagaaacccucggcgagaaauggaagcgccagcuuaaucagcugucuaagagcgaauuuaacaucuacaaacggucagguauuauggagguagacagauccgaagcuaaggagggguugaaacguggagagacaacuaggcacgccgugagucggggcaccgcaaagcugcgcugguucguugaacgaaaucucgugaaaccugaggguaaggucaucgauuuaggcugugggagaggaggcuggagcuauuacugcgcugggcugaagaaagugacagaagucaagggauauacgaaaggcggucccgggcaugaggaaccgauaccaauggccaccuacggauggaaccuugugaagcugcacucuggcaaagacguuuucuuuacuccucccgagaagugugauacacuacucugcgacaucggcgaguccucaccaaaucccaccauugaagaggggaggacucugcggguauugaaaaugguggaaccuuggcugcgcggaaaccaauucuguaucaagauucucaauccguacaugcccagcgucguggagacacuugagcagaugcagagaaagcaugguggcaugcugguuaggaacccauuaucgcgaaauucuacccacgaaauguauugggugaguugcgggacgggaaacaucgucuccgccgugaauaugaccagccggaugcuguugaaccguuuuacaauggcgcacagaaaaccuacuuacgagcgcgauguagaccucggcgcugguaccaggcauguggcaguugaacccgaggucgccaaccuggauauuaucgggcagcggauagaaaauaugaagcacgagcauaaaucaacauggcacuaugacgaggauaacccuuacaagacuugggcuuaucauggauccuacgaagugaaaccaucuggcagcgccaguuccauggugaauggcgucguuaagcuacuuaccaagcccugggacgugauuccuaugguaacacaaaucgcaaugaccgauacuacgccauucgggcagcagagaguguuuaaagagaaggucgacacacgcacccccaaagccaagaggggaacugcucaaaucauggaagugaccgcgcgauggcugugggguuuccucagccggaacaaaaagccgagaauuuguacaagggaggaauuuacgcgcaagguucguucuaaugccgcaauaggcgcuguguucgucgacgagaaccaguggaacucagccaaagaggcaguggaagaugagcgguuuugggaccugguacagaaggaaagagaguugcacaaacaggggaagugcgcaaccugcguuuauaacaugaugggaaaaagggaaaagaagcugggcgaguucgguaaagcuaaggggagucgcgccaucugguacauguggcucggagcgcgauuucuugaguucgaagcacugggcuuuaugaaugaggaucacugguucucccgggaaaacagcuuaucuggcguggagggggagggacugcauaaauuggguuacauucucagagacaucucgaagauuccuggcgggaauauguaugccgaugacacugcuggaugggauacaaggaucaccgaagacgaucugcaaaacgaggccaaaauaacugacaucauggaaccagagcacgcacuacuugcuacaucaauuuucaagcugaccuaccagaauaaagucgugcgcgugcagagacccgccaagaacggcacagucauggauguuaucagccggagggaccagcgugguuccgggcaagugggaacuuauggccucaauaccuuuacgaacauggaagcucagcugauucgacagauggagagugagggcaucuucuugccuucugaauuagagaccccaaaccuggccgaacgcguacucgauuggcuugagaaguacgggguggaaagacugaaacggauggcaauaagcggagacgacugugucgugaagcccauugaugacagguuugcgacagcccuaacugcucugaaugauauggguaaaguucgcaaggacaucccgcagugggagccuuccaaaggcuggaacgauuggcaacaggugcccuucugcucacaucacuuucaccagcucaucaugaaggacgggagagagauugucgugccaugucggaaucaggaugaauugguaggaagggcccgaguuagucaaggcgcagguuggucucugcgugagaccgcuugccuuggaaagagcuaugcccagauguggcagcugauguacuuccauagacgcgaccuccgguuagcagccaacgcgauauguuccgcugugccugucgauugggugcccacaucaaggacuaccuggagcauccacgcccaucaccaauggaugacgacagaagacaugcugucuguuuggaauagaguguggauugaggaaaacccauggauggaggauaaaacccaugucuccaguuggggagacgugcccuauuugggcaagcgcgaggaccaguggugcggcagccugaucgggcucacugcacgggccacaugggcuucgaauauucagguagccaucaaccaggugaggcgacuuauaggaaaugaaaacuaccuggauuacaugaccuccaugaaaagauuuaagaaugagggugacccugaaggcgcacuaugguga

SEQ ID NO: 13760 - RNA, 9879 nt, Artificial Sequence
  derived and/or modified CDS sequence (opt3) from DENV-1__GQ199783__SS-prME
agcgugaccaugcugcucaugcuuaugcccacagcacuggcuuuccacuugacuacgagaggaggggaaccucauaugaucgucaccaagcaggaaaggggaaaauccuuacuguuuaagacaucugccgguguuaacaugugcacuuuaauugccauggaccucggagaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggaggguacaagcggcgcgaccuggguagacguugugcuugagcacgggaguugugucacuacaauggcaaaggauaaacccaccuuggacaucgaacugcuuaagacggaggugaccaacccugccgugcucaggaaacugugcauugaagcuaagaucuccaauacaacuaccgauucucgguguccaacacaaggagaggccacucuuauggaagaacaagacgcaaacuucgucugccgccgaaccuuuguugauagaggcugggguaauggguguggacuguucggcaaaggcagcuugauaacaugcgcuaaguuuaagugcgugaccaaacucgaggggaagauuguacaguacgaaaaccugaaauauuccgugaucgucacugugcacacgggagaccagcaucaaguugguaaugagucaacagaacacggcaccacugccaccauuacaccccaggcgccuaccagugagauccaguuaacugacuacggggcccugacacucgauuguagcccaaggacgggacuugacuucaacgaaauggugcuguugaccaugaaggagaaaucuuggcugguccauaagcagugguuucuggaucucccgcugcccuggacuuccggcgcaucaacaagccaagagaccuggaaucggcaggaccuucuggugacauucaaaacugcucacgccaagaagcaggaaguaguuguguuggguagucaagagggggcuaugcacaccgcccucacgggcgcaaccgaaauccagacaucuggaacuaccacaauuuuugccggccaucugaaaugccguuuaaagauggauaaacugacucuaaaggggauguccuaugucauguguaccggcagcuucaaacucgagaaggaaguggcugagacgcagcacgguacaguccuggugcagauaaaguacgagggcaccgacgcgccuugcaaaaucccauucucgacucaagaugaaaaggggguuacacagaacggacgccuuauuaccgcaaaucccaucgugacugacaaagagaagccuguaaacauagaagccgagccacccuuuggcgagucuuauauugucaucggugcuggggaaaaagccuugaagcuguccugguucaagaaaggcucaaguaucggaaagauguuugaggcaaccgccagaggcgcuaggcggauggccauucucggggauacagcaugggacuucggaagcguggguggcguuuuuacguccguggggaaacugguccaucagaucuucggaaccgcguacggcgugcuauuuucugguguaagcuggacuaugaagauugggauaggcgugcuguugacauggcucggacuaaauucacgaaguaccuccuuaagcaugacauguaucgcuguuggccuggucacucuauaccucggggugauggugcaggccgauucuggaugcgucauuaacuggaaaggccgcgaacugaagugugguucagggaucuucguuaccaaugaggugcacacguggacagaacaauauaaguuucaggcagacaguccgaaaagacuuagcgccgcuaucggaaaggccugggaggagggcgugugcgguauuagguccucuacccgguuggaaaacauaauguggaaacagaucucgaacgagcugaaucauauucuccuggaaaacgacaugaaguucacuguagucgugggcgauguuguggggaucuuagcacagggcaagaagaugauucgcccucaacccauggagcacaaauacagcuggaaguccuggggcaaggcuaaaaucauaggggccgacguccagaauaccacauuuaucauugauggaccaaacacuccugaaugucccgacgaucagagagcguggaauaucugggagguggaggacuauggcuucgguauuuuuaccacaaacaucuggcugaaacuuagggauucauacacgcagguuugcgaccaccguuugaugagugccgcuauaaaagauucuaaggcagugcaugccgacaugggguauuggauugaaagcgagaaaaaugaaaccuggaagcucgcucgggccuccuucaucgagguaaagacuuguauuuggccaaaaucacacacacuguggagcaacggaguccuagaaucugagaugaucauacccaagaucuacggcgguccuauuucccaacauaauuaucgaccaggcuacuucacccagacugcagggccguggcaccugggaaaacucgagcuggauuuugaccuuugcgaaggcacaaccgugguggucgaugagcacugcgggaacagaggacccaguuugaggacgacuaccguuacaggcaagaucauucaugaaugguguugccgcagcuguacccugccuccauuacgguucaaaggugaggacgggugcugguacggaauggagaucagacccgugaaggaaaaggaggaaaaucucguaaaaucuaugguguccgcgggcucaggugaggucgacaguuuuagccugggccuucuguguauaucgauuaugaucgaagaggugaugaggucccgcuggucucgaaagauguugaugacugggacacucgccguuuuccugcuacugaucaugggacagcucaccuggaacgaucugauucggcuuugcaucauggugggcgcuaaugccagcgaccguauggggaugggaacaacuuauuuggcacugauggcuaccuuuaaaauuagaccuauguucgccgucggcuuacucuuuaggcgccugacgucacgggaggugcuucugcuaacaauaggucucagucugguugcauccguggaauugccaaacucucuggaggaauuaggggauggacucgccaugggcaucaugauucugaaacuucugaccgacuuccaaagccaccaguugugggcuacucuccugucccuaaccuuuaucaaaacaacucugucacuucaucacgcguggaagaccauggccaugguccucagcauuguaagucuguuccccuugugucugucuacgacaucccagaagaccacuugguuaccggugcuccugggcagccuugggugcaaaccucugacaauguuuuugaucaccgagaauaagauauggggaagaaaaucguggccacucaacgaagguaucauggcaguuggcguggucucaauucugcuaucuagucugcuuaagaacgaugugccccucgcugggccucugaucgccggaggcauguugauugccuguuacguaaucuccgguagcucugcugacuuaagccuggagaaagcagccgagguguccugggaagaggaagcggagcauucaggggcuagucacaauauacucgucgaaguucaggaugacggaacuaugaagauuaaagaugaggagagggacgauacacugaccauccuucugaaggccacguugcuagcagugagcggcguguauccccugucuaucccagccacucucuucgucugguacuuuuggcaaaagaaaaagcagcgauccggcgugcugugggacaccccuucacccccagaaguugagcgcgcuguacuugaugacgggauuuaucggauaaugcagagaggauuacuggguaggagucaggugggcgucgggguguuccaagaaaacguuuuccacacaauguggcaugugacccguggagcaguccucauguaccagggcaaacgcuuggagccgagcugggccuccgugaagaaagaccugaucucuuauggugggggauggcggcuccagggcucguggaauacaggcgaggaaguacaggucauugcgguggagccugggaagaaccccaagaauguucaaacugcuccaggaaccuuuaaaacgcccgaaggugaggugggcgccaucgcacuggauuucaagccugggacaagcggaucaccaauugucaacagagaaggcaaaaucgugggucuuuacgggaauggaguugugacuaccuccggcacauacgucagugccauagcucagaccaaggccucucaggagggcccccugccugagaucgaagacgagguguuuaggaaacgaaacuugacuauuauggaucuacacccggggagcggaaagacccggcgcuaucugccagcaaucguaagagaagcuauuaagaggaaacuccggacauuaauccuggcccccacgcgagugguugcguccgagauggccgaagcacuuaaggguaugccuauaagauaccaaacuaccgcugucaaaucagagcauacaggcaaggagauuguggaccugaugugccacgccaccuucacuaugcgccucuugucuccagugaggguccccaauuauaacaugaucaucauggaugaagcucauuuuacagacccuagcaguauugcagcccguggguacaucuccacccggguaggaaugggcgaggccgcugcgauauucaugacggcaacuccgcccgguagcguggaagccuuuccacagucuaaugcuguuauucaggaugaggaaagagacaucccugagaggucauggaacuccggguaugaguggauuacagauuuccccggaaaaaccgugugguuugucccaaguaucaagagcggcaaugacauagccaacugucugcgcaagaauggcaaacgagugauucagcucucgagaaagaccuucgauacugaauaccagaagacaaagaacaacgacugggacuauguugugaccacagauaucucugagaugggggcaaauuuucgggccgacagggucaucgauccucgccguugccugaaacccgugauucuuaaggacggaccagaaagaguaauccuagcugguccgaugccugugacuguugcguccgccgcacagcggaggggccgcauugggcgaaaccacaauaaggagggagaucaguacauauacaugggccagccccugaacaaugacgaggaucacgcucauuggacggaagccaaaauguuguuagacaacaucaauaccccagaggguauuauccccgcacuguucgaaccugagagagaaaagagcgccgcuaucgauggggaguaucggcucaggggcgaggcccgcaaaacauucgucgaacugaugagaaggggagaccuuccaguguggcugucauacaagguggcgagugagggcuuucaauauucugaucggcguuggugcuucgacggggaacgcaacaaucagguccucgaggaaaacauggauguugagauuuggacuaaagagggagaacgaaagaaauugagacccagguggcuggacgcacggaccuacuccgacccucuagcccugcgcgaguuuaaggaguucgcugccgguagaaggagcgugucaggcgaucucauacuugagaucgggaagcugccgcagcacuuaacacagcgggcucaaaaugcauuggacaaccugguaaugcuccauaauagugaacagggaggccgagccuauagacacgcuauggaggagcugccagauaccauugaaacucuuaugcugcucgccuugaucgcagugcugacggguggggucaccuuauuuuuccuaagcggccgcggacugggcaaaacauccauugggcuccuuugugugauggcgucuagcguucuguuguggauggccuccguggagccccacuggaucgcugccucaauaauccuggaauuuuuccucaugguccugcuuauuccugagcccgacaggcagcggacuccacaggauaaccaacucgcauacguagugaucggacuguuguuuaugauucugaccguugcugccaaugagauggguuuacuagaaacaaccaagaaagaccugggcaucgggcauguggcagucgagaaccaccaucacgccacuaugcucgauguggaccuucauccugcuucugcguggacacuguaugccgucgcaacgaccauaauuacucccaugaugcgucacacaaucgaaaacaccaccgcuaauauuaguuugacagccaucgccaaccaggcagcuauacugaugggacucgauaagggcuggccaaucucgaaaauggacauuggugugccucugcuugccuuagggugcuacagccagguuaauccgcugacucucacggcggcuguguugaugcugguagcccacuacgcaaucauuggccccggacuacaagccaaggcuaccagagaggcacagaagaggacagccgcgggcaucaugaaaaacccaacuguggaugggauagucgcuauugaccuggauccuguuguguaugacgccaaguucgaaaaacagcucggacagaucaugcuucugaucuuguguaccucccaaauucugcucaugcgcacaaccugggcacugugcgagucuaucacuuuagccacgggcccccuuacaacccugugggaggguucaccagggaaguuuuggaauacuaccauagcugucagcauggccaacauuuuccggggauccuaccucgcaggcgcuggucuagccuuuagucugaugaaaucuuugggcgggggacgaagaggcacaggggcgcagggagaaacucugggcgagaaguggaagaggcagcucaaucagcuuagcaaaucagaguucaacaucuauaagcgcuccgguauuauggagguggaccggagugaagccaaagaggggcugaagagaggagagaccacacgucaugcaguaagcaggggcacggcuaaauugcggugguucguggaacgcaaucugguuaagccugaggguaaggugaucgaucucggcugugggcgaggaggcuggucuuacuauugcgccgggcugaaaaaggucaccgaagugaaaggauacacuaagggcggucccgggcacgaggaaccgauaccaauggcaacauauggauggaaccuagucaaacuucauuccggcaaggacguguuuuucaccccucccgagaaaugugauacucugcuaugcgacaucggcgagucaagcccaaaucccacaauugaagaggggagaacccucaggguucugaagaugguagaaccuugguugcggggaaaccaauuuuguaucaagauucugaauccguacaugcccucgguggucgagacgcucgagcagaugcagcgcaaacacgguggcaugcuugugagaaacccacugucuaggaauaguacccacgaaauguacuggguuuccugcgggacaggaaacaucgugagcgcugucaauaugacuucacgaauguuacugaaccgguucaccauggcccaucguaagccuacauaugagagagauguggacuugggcgccgguacucgccacguagcgguggaacccgagguugcuaaccucgauauuaucgggcagaggauagaaaauauuaaacaugagcacaaguccaccuggcauuacgacgaggauaacccuuauaaaacaugggcauaccacggaucuuaugaagucaagccaagcggcagugccuccagcauggugaauggcguggucaagcugcuaaccaaacccugggacguuaucccuauggugacucaaaucgcuaugacggauacaaccccauuugggcagcagcggguauucaaggagaaaguggacacuagaacccccaaggccaaacgcggaacagcacaaauuauggaagucacggccagguggcuuugggguuuucugucucgaaacaagaagccgcggauauguaccagagaggaguucacuaggaaagugcgcucaaaugcugcgaucggcgccguuuuuguggacgagaaccaguggaauagugcaaaggaggcugucgaagaugagcguuucugggaccucgugcagaaagaacgggagcugcacaagcaggggaaaugcgccacaugcguauacaacaugaugggaaagagagaaaagaaauugggcgaguuugguaaggcaaaaggguccagggccauuugguauauguggcugggagcucgcuuccucgaguuugaagcccuuggcuucaugaaugaggaucauugguucagccgagaaaacucucugucgggcguugagggggagggauuacacaagcuggguuacaucuugcgggacauuucaaaaaucccuggcgggaauauguacgcggaugacaccgcaggaugggauacuagaauaacagaagacgaucuccaaaacgaggccaagaucaccgacauuauggaaccagagcaugcucugcuagccacaagcaucuuuaaacuuacuuaucagaauaagguggucagggugcagcgccccgcaaagaacggcaccgugauggaugucauuuccagacgggaccagagggguagugggcaaguuggaacguacggccugaauaccuucacaaacauggaagcucagcucauccgucagauggagucugagggcauauuucugccuagcgaauuggagacuccaaacuuagccgaacgagugcuggauuggcucgagaaauaugggguagaacgccuuaagagaauggcuauuuccggagacgacuguguggucaaacccaucgaugaccgguucgccaccgcacugacagcgcuaaaugauauggguaaggugaggaaagacaucccgcagugggagccuucaaagggcuggaacgauuggcaacagguucccuuuugcagucaccacuuccaucagcugauuaugaaggacgggcgcgagauaguggucccauguagaaaucaggaugaacucgugggacgggccaggguaucucaaggcgcugguuggagcuugcgagagacugccugccuggggaaauccuacgcacagauguggcagcuuauguauuuucaccguagagaccugcgccucgcugccaacgcaaucuguucagccguuccuguggauuggguccccaccagccggacgacauggucuauucaugcgcaccaucaauggaugaccacugaagacauguuauccguguggaauaggguuuggaucgaggaaaacccauggauggaggauaagacacacgugaguagcuggggagacguccccuaccugggcaaaagagaggaccaguggugcggcucguugauugggcugaccgcucgcgccacuugggcauccaauauccagguggccauaaaccagguacggaggcucaucggaaaugaaaacuaucuugauuacaugaccucuaugaagcgauucaaaaaugagggugacccugaaggcgcucugugguga

SEQ ID NO: 13761 - RNA, 9879 nt, Artificial Sequence
  derived and/or modified CDS sequence (opt3) from DENV-1__GQ199784__SS-prME
agcgugaccaugcugcucaugcuuaugcccacagcccuggcuuuccacuugacuacgaggggaggggaaccucauaugaucgucaccaagcaggaaaggggaaaauccuuacuguuuaagacaucugcugguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcuccccaugucggccuggguuuggagaccagaacagaaacuuggaugagcuccgagggggccuggaaacagauccagaggguggaaaccugggcucuccggcacccuggauucacaguuauugcacuguuucuggcccaugugaucggcaccucuauuacgcagaagggcaucauauucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuacaccccaggccccuacaagugagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacugguagcuucaaacuggagaaggaagucgccgagacccagcacggaacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauaggguugggcgugcuccugacuugguuaggacuaaauucacgaaguacaucccuaagcaugaccuguaucgcgguuggccucgucacacuguaccuuggggugauggugcaggcugauucuggaugcgucauuaacuggaaaggccgcgaauugaagugugguucagggaucuucguuacuaaugaggugcacaccuggacggaacaauauaaguuucaggccgacaguccgaaaagacugagcgcagccaucggaaaggcuugggaggagggcgugugcgguauuagguccgccacacggcucgaaaacauaauguggaaacagaucucuaacgagcugaaucauauuuuacuggaaaacgacaugaaguucaccguagucgugggcgauguuguggggauccuugcacagggcaagaagaugauucgcccucaacccauggagcacaaauacucguggaaaagcuggggcaaggcuaagaucauaggggccgacguccagaauacuaccuuuaucauugauggaccaaacacaccugaaugucccgacgaucagagagcguggaauaucugggagguggaggacuauggcuucgguauuuuuacuaccaacaucugguugaagcucagggauucccacacacagguuugcgaccaucgucugaugucagccgcuauaaaagauaguaaggcagugcacgccgacaugggguacuggauugaaucugagaaaaaugaaacguggaagcuagcucgggccagcuucaucgagguaaagaccuguauuuggccaaaaucccauacucuguggucaaacggaguccucgaaagcgagaugaucauacccaagaucuauggcgguccuauuucucaacacaauuaccgaccaggcuauuucacacagaccgcagggccguggcaccugggaaaacuugaguuggauuuugaccugugcgaaggcacuacagugguggucgaugagcauugcgggaacagaggacccuccuuaaggaccacgacuguuaccggcaagaucauucacgaaugguguugccgcaguuguacacucccuccacugcgguucaaaggugaggacgggugcugguacggaauggagaucagacccgugaaggaaaaggaggaaaaucuuguaaaaagcauggugucugcgggcuccggugaggucgacucauuuagucugggcuugcucuguauaagcauuaugaucgaagaggugaugaggucgcgcuggucccgaaagaugcugaugaccgggacucuagccguuuuccugcuccugaucaugggacagcuuacauggaacgauuugauucggcugugcaucauggugggcgcuaaugccucugaccguauggggaugggaaccacauacuuagcacucauggcuacuuuuaaaaugagaccuauguucgccgucggccugcuuuuuaggcgccugaccagccgggaggugcuacuccugacgauugguuugucacugguugcaaguguggaauuaccaaacucccucgaggaacugggggauggacuugccaugggcauaaugauccugaaguugcucacagacuuccaaucucaucagcugugggcuacccuacugagccuuacuuuuauuaaaaccacacucucccugcacuaugcguggaagacuauggccauggucuugucaaucguaagccuguuccccuuaugucucaguaccacgucucagaagacaaccuggcugccggugcuucugggcuccuuggggugcaaaccucucgcaauguuucugauugcugagaauaagaucuggggaagaaaaagcuggccacuaaacgaagguauaauggccguuggcguggucucgauccugcuuucaucucuccugaagaacgaugugcccuuggccgggccuuuaauugcuggaggcaugcugaucgcauguuacguaauuagugguuccagcgccgaccucucucuggagaaagcggcugaggugagcugggaagaggaagccgagcauuccggggcaucacacaauauccuugucgaaguucaggaugacggaacuaugaagauaaaagaugaggagagggacgauacacugaccauuuugcuaaaggccacucugcucgcugugaguggcguguauccccugagcaucccagcaacacuuuucgucugguacuuuuggcaaaagaaaaagcagcgaucuggcguguuaugggacaccccuucacccccagaaguugagcgcgccguacuggaugacgggaucuaucggauuaugcagagaggacucuuggguaggagccaggugggcgucgggguguuccaagaaaacguuuuccacacgauguggcaugugacucguggagcgguccugauguaccagggcaaacgccucgagccgaguugggcuagcgugaagaaagaccugauauccuauggugggggauggcggcuucagggcucuuggaauaccggcgaggaaguacaggucaucgccguggagccugggaagaaccccaagaauguucaaacagcaccaggaaccuuuaaaacacccgaaggugaggugggcgccauugcucuggauuucaagccugggacuucgggaagcccaaucgucaacagagaaggcaaaauuguggguuuguacgggaauggaguugugaccacgucaggcacauacgucuccgccaucgcacaggcuaaggccagucaggagggcccccuaccugagauagaagacgagguguuuaggaaacgaaaccugacuaucauggaucuccacccggggucuggaaagacccggcgcuauuuaccagcgauuguaagagaagccaucaagaggaaacugcggacacuuauucuggcacccacccgagugguugcuagcgagauggccgaagcucucaaggguaugccuaucagauaccaaacuaccgcagucaaauccgagcauacaggcaaggagauaguggacuugaugugccacgccacguucacuaugcgccugcucucaccagugaggguccccaauuauaacaugauuaucauggaugaagcccauuuuaccgacccuucuagcaucgcugcgcguggguacauuaguacacggguaggaaugggcgaggcagccgcuaucuucaugaccgccacuccgcccgguuccguggaagcauuuccacagagcaaugccguuauacaggaugaggaaagagacauuccugagaggucuuggaacucaggguaugaguggaucacagauuuccccggaaaaaccgugugguuugucccauccauuaagaguggcaaugacaucgcuaacugucugcgcaagaauggcaaacgagugauacagcuuagcagaaagacguucgauacugaauaccagaaaaccaagaacaacgacugggacuauguugugaccaccgauauuucggagaugggggcgaauuuucgggccgacagggucaucgauccucgccguugccuaaaacccgugauccugaaggacggaccagaaagaguaauuuuggcagguccgaugccugugacuguugcuucugccgcacagcggaggggccgcaucgggcgaaaccacaauaaggagggagaucaguacauuuacaugggccagcccuuaaacaaugacgaggaucacgcccauuggacagaagcuaaaaugcugcucgacaacauaaauaccccagaggguaucauucccgcccuguucgaaccugagagagaaaaguccgcggcaaucgauggggaguaucggcuuaggggcgaggcccgcaaaacauucgucgaacugaugagaaggggagaccucccagugugguugagcuacaagguggcuucagagggcuuucaauauagugaucggcguuggugcuucgacggggaacgcaacaaucagguccuggaggaaaacauggauguugagaucuggacuaaagagggagaacgaaagaaacuaagacccagguggcuggacgcccggacguacucugacccucucgcacuucgcgaguuuaaggaguucgcagccgguagaagguccgugagcggcgaucugauuuuagagauagggaaguugccgcagcaccugacccagcgggcucaaaaugcccucgacaaccugguaaugcuucauaauucagaacagggaggccgagcauauagacacgcgauggaggagcugccagauacaaucgaaacucucauguugcuggccuuaauugcugugcuaaccgguggggucacacuguuuuuccucaguggccgcggacuuggcaaaaccagcaucgggcuguugugugugauggccuccucuguucugcucuggauggcaagcguggagccccacuggauugcugccuccaucauacuggaauuuuuccuuaugguccuccugaucccugagcccgacaggcagcggacuccacaggauaaccaauuggcauacguagugauuggacuguuauuuaugauccuaacgguugccgcuaaugagaugggucugcucgaaaccacaaagaaagaccuuggcauugggcauguggcggucgagaaccaccaucacgccacuaugcuggauguggacuugcauccugcaucagcuuggacccuguaugccgucgccacaaccaucauaacucccaugaugcgucacacaauugaaaacacgaccgcaaauaucucucucacugcuauugccaaccaggcggcuauccugaugggacuugauaagggcuggccaauaaguaaaauggacaucggugugccuuuacuggcccucgggugcuacucgcagguuaauccguugacacugaccgcagccgugcuaaugcugguagcucacuacgcaauuaucggccccggacuccaagccaaggcgaccagagaggcucagaagaggacagccgcaggcauuaugaaaaacccaacuguggaugggaucgucgccauagaccuugauccuguuguguaugacgcuaaguucgaaaaacagcugggacagauuauguugcugauccucuguacgagccaaauccuguuaaugcgcaccacaugggcccuuugcgaguccauuacucuggcaaccggcccccucacaacccuaugggaggguucuccagggaaguuuuggaauacuacgaucgcugucucaauggccaacauauuccggggaagcuaccuggcgggcgccgguuuggcauuuucccugaugaaaagucucggcgggggacgaagaggcacaggggcucagggagaaacccuuggcgagaaguggaagaggcagcugaaucaguugucuaaaagcgaguucaacauuuauaagcgcucagguaucauggagguggaccgguccgaagccaaagaggggcugaagagaggagagacuacccgucaugcaguaaguaggggcacagcuaaacuccggugguucguggaacgcaauuuaguuaagccugaggguaaggugauugaucugggcugugggcgaggaggcuggagcuacuauugcgccgggcuuaaaaaggucacugaagugaaaggauacaccaagggcggucccgggcacgaggaaccgaucccaauggccacauauggauggaaccuggucaaacuacauucuggcaaggacguguuuuucacgccucccgagaaaugugauacccuccugugcgacauaggcgaguccucaccaaaucccacuaucgaagaggggagaacauugaggguucugaagaugguagaaccuuggcuccggggaaaccaauuuuguauuaagauccuuaauccguacaugcccagcguggucgagacccuggagcagaugcagcgcaaacacgguggcauguuagugagaaacccacugucgagaaauucuacucacgaaauguacuggguuaguugcgggacaggaaacauuguguccgcggucaauaugaccagccgaauguugcucaaccgguucacgauggcucaucguaagccuaccuaugagagagauguggaccugggcgcagguacacgccacguagccguggaacccgagguugcuaaccuagauaucauugggcagaggaucgaaaauauaaaacaugagcacaagucaacuuggcauuacgacgaggauaacccuuauaaaaccugggccuaccacggauccuaugaagucaagccaucuggcagcgcaaguuccauggugaauggcguggucaaacuucugacaaaacccugggacguuauuccuauggugacucaaaucgccaugaccgauacaaccccauuugggcagcagcggguauucaaggagaaaguggacacuagaacgcccaaggcuaaacgcggaacagcgcaaaucauggaagucaccgccagguggcucugggguuuucugagccgaaacaagaagccgcggauuuguacuagagaggaguucaccaggaaagugcgcucuaaugcagcuauaggcgccguuuuuguggacgagaaccaguggaacucagcaaaggaggccgucgaagaugagcguuucugggacuuggugcagaaagaacgggagcugcacaagcaggggaaaugcgcuacaugcguauacaacaugaugggaaagagagaaaagaaacucggcgaguuugguaaggccaaagggaguagggcgaucugguauauguggcuuggagcacgcuuccuggaguuugaagccuuaggcuucaugaaugaggaucauugguucucccgagaaaacagccugucuggcguugagggggagggauugcacaagcucgguuacauucugcgggacaucucgaaaauuccuggcgggaauauguacgcugaugacacggccggaugggauaccagaaucacugaagacgaucuacaaaacgaggcaaggauaacagacaucauggaaccagagcaugcacuucuggccaccucaauuuuuaagcucacuuaucagaauaaagugguccgcgugcagagacccgcuaagaacggcacagugauggaugucaucagccggagggaccagcgugguuccgggcaaguuggaaccuacggccugaauacauucacuaacauggaagcccaguugauucgacagauggagagugagggcaucuuuuuaccuucugaacuggagacccagaaccucgcagaacgcgugcuugauuggcuggagaaguaugggguagaaagacuaaaacggauggcgauaagcggagacgacuguguggucaagccaauugaugacagguucgccacggcucugaccgcccucaaugauauggguaaagugcgcaaggacaucccccaaugggagccguccaaaggcuggaacgauuggcagcagguuccuuuuugcucacaccacuuccaucaguugaucaugaaggacgggagagagauugugguccccugucggaaucaagaugaacuggugggaagggcacgaguaagucagggcgcugguuggucucuucgugagacagccugccuggggaaguccuacgcacagauguggcaacucauguauuuucacagacgcgacuuacggcuggccgcgaacgcuauauguuccgccguuccaguggauugggucccuacuucaaggaccacauggagcauccaugcacaccaucaguggaugacuaccgaagacauguugucuguguggaauagaguuuggauugaggaaaaccccuggauggaggauaaaacgcacguguccaguuggggagacgucccauaccugggcaagcgcgaggaccaguggugcggcagccucaucgggcuuacagcccgggcuaccugggccucgaauauucagguggcaaucaaccaaguaaggcgacugauaggaaaugaaaacuaucuagauuacaugacuuccaugaaaagauucaagaaugagggugaccccgaaggcgcucugugguga

SEQ ID NO: 13762 - RNA, 9879 nt, Artificial Sequence
  derived and/or modified CDS sequence (opt3) from DENV-1__GQ199785__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccaggcaaaggcuagccaggagggcccccuuccugagauugaagacgagguguucaggaaacgaaaccugacuaucauggauuugcacccgggguccggaaagacccggcgcuaucuaccagccauuguaagagaagcgaucaagaggaaacugcggacacucauauuagcccccacccgagugguugcaucagagauggcugaagcccugaaggguaugccuauuagauaccaaacuaccgcugucaaaucugagcauacaggccgcgagaucguggaccuuaugugccacgcaacguuuacuaugaggcugcucagcccagugcguguccccaauuauaacaugaucauuauggaugaagcccauuucaccgacccuaguuccaucgccgcucggggguacauaagcacaagaguaggaaugggcgaggcggcagccauuuuuaugaccgcuacuccgcccgguucuguggaagccuucccacagucaaaugcaguuauccaggaugaggaaagggacauuccugagcgcuccuggaacaguggguaugaguggaucacagauuuucccggaaagaccgugugguucgucccaagcauaaaaucgggcaaugacauugccaacuguuugcgaaagaauggcaagagagugauccagcugucucggaaaacguuugauacugaauaccaaaagacaaaaaacaacgacugggacuacguugugaccaccgauaucuccgagaugggggcuaauuucagggcggaccgcgucauugauccucguagaugccucaagcccgugauccugaaagacggaccagaacggguaauucuugccgguccgaugccugugacuguugcaagcgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggaaaaaucagccgcgauugauggggaguauaggcugcgcggcgaggcaagaaagacauuugucgaacucaugaggcggggagaccugccaguguggcuuaguuacaaaguggccucugagggcuuccaauauuccgaucgucgcuggugcuuugacggggaacgaaacaaucagguccuggaggaaaacauggauguugagauauggacuaaggagggagaaagaaaaaagcucaggccccggugguuggacgcucgcacguacagcgacccucuggcccuaagagaguucaaagaauuugcugcagguaggcggucagugaguggcgaucugauccucgagauugggaagcuuccgcagcaccugacccagcgagcccaaaaugcuuuagacaacuugguaaugcugcauaauagcgaacagggaggcagagccuaucgccacgcaauggaggagcucccagauacaaucgaaacucugaugcuucuggcgcucauugccguguugaccgguggggucacacuguucuuuuuauccggcaagggacuaggcaaaaccucuaucgggcugcucugugugauggcuagcuccgcccuucuguggauggcaucaguugagccccauuggauagcugccucuaucauuuuggaauucuuucugauggugcuccugaucccugagcccgacaggcagcggacuccacaggauaaccaacuugcauacgucguaauuggacuccuguucaugaucuugacgguggccgcuaaugagaugggucuguuagaaaccacaaagaaagaccuaggcauagggcacguugcgguggagaaccaccaucacgccacuaugcuggaugucgaccuccauccugcaagugcuuggacccuuuacgccguggccacaaccauuaucacucccaugaugcgucacacaauugaaaacacgaccgcaaauaucucgcugacugcuauagccaaccaggcggcuaucuugaugggacuggauaagggcuggccaauuagcaaaauggacaucggugucccucuccuggcccuugggugcuauucccaggugaauccguuaacacugaccgcagccguucucauguugguggcucauuacgcaauuaucggccccggacugcaagccaaggcgaccagagaggcucagaagaggacagccgcaggcauaaugaaaaacccaacuguagaugggauuguggccaucgaccuagauccugucguuuaugacgcuaaguuugaaaaacagcugggacagaucaugcuccuuauucuguguacgucucaaaucuugcugaugcgcaccacaugggcccucugcgagucaauaacucuggcaaccggccccuuaacaacccuuugggaggguagcccagggaaguucuggaauacuacgauugcuguguccauggccaacaucuuucggggaaguuaccuggcgggcgccggucucgcauucucucuaaugaaaagccugggcgggggacgaagaggcacaggggcucagggagaaaccuugggcgagaaguggaagaggcagcugaaucagcucucaaaauccgaauucaacacuuauaagcgcagugguauuauggaggucgaccggagcgaagccaaagaggggcuuagacguggagagaccacaaagcacgcagugucuaggggcacugcuaaacugcggugguuuguagaacgcaauuuggugaagccugaggguaagguuaucgaucugggcugugggcgaggaggcugguccuacuauugcgccgggcucaaaaaggugaccgaagucaaaggauacacaaagggcggucccgggcacgaggaaccgauaccaauggccacguacggauggaacuuagugaaacugcauucaggcaaggacgucuucuuuaucccucccgagaaaugugauacccuucugugcgacauuggcgagagcucgccaaaucccacuaucgaagaggggagaacacuaagggugcucaagaugguugaaccuuggcugcggggaaaccaauucuguauuaagaucuugaauccguauaugcccucuguaguggagacccuggagcagaugcagcgcaaacacgguggcaugcucgucagaaacccacuuaguaggaauuccacucaugaaauguacugggugagcugcgggacaggaaacauuguuucagcggugaauaugaccucccgaaugcuguuaaaccgguuuacgauggcucaccguaagccuaccuaugagagagaugucgaccugggcgcagguacacgccacguggccguagaacccgagguggcuaacuuggauaucauagggcagaggauugaaaauaucaaacaugagcacaagucuacuuggcauuacgacgaggauaacccuuauaaaaccugggccuaccacggaagcuaugaaguuaagccaaguggcuccgcaagcucuauggucaauggcguggugaagcuccugacaaaacccugggacgucaucccuaugguuacucaaauugccaugaccgauacaaccccauucgggcagcagcggguguuuaaggagaaaguagacacuagaacgcccaaggcuaaacgcggaacagcgcaaauaauggaagugaccgccaaguggcuaugggguuuccuuucaaggaacaagaaaccgcgaaucuguacucgggaggaauuuaccagaaaggucaggaguaaugcagcuauuggcgccguguucguugacgagaaccaguggaauuccgcaaaagaggccguggaagaugagcgcuuuugggaccugguccaucgugaacgggagcuccacaagcaggggaaaugcgcuacaugcguguacaacaugaugggaaagagagaaaagaaacugggcgaguucgguaaggccaaagggagcagggcgaucugguacaugugguugggagcacgcuuucuggaguucgaagcccucggcuucaugaaugaggaucacugguuuucucgagaaaacucgcuuucaggcguagagggggagggacugcauaaguuagguuauauucugcgggacaucagcaaaauaccuggcgggaauauguacgcugaugacacggccggaugggauaccagaaucacugaagacgauuugcagaacgaggcaaagauuacagacaucaugaaaccagaacacgcucuccuggccaccuccauuuucaagcuaacuuaucaaaauaagguugugaggguccagcgccccgcuagaaacggcacagugauggaugugaucagucggagggaccagcgugguucugggcaggucggaaccuacggccuuaauacauuuacuaacauggaggcccaacugauacgacagauggaaagcgagggcauuuucuccccuucagagcucgaaaccccaaaccuggcagagcgcguuuuggauugguuagaaaaacaugggguggagagacugaagcggauggcgaucaguggagacgacuguguagugaaacccaucgaugacagguuugccacggcucucucugcccuuaaugauauggguaagguccgcaaagacauuccgcagugggaaccuagcaagggcuggaacgauuggcagcaagugcccuucugcucccaccacuuucaucagcugauaaugaaggacgggagagagaucguugugccaugucggaaucaggaugagcuagucggaagggcacgagugucacagggcgcugguuggagccugcgugaaaccgccugccucgggaaaucuuaugcacaaauguggcaguugauguacuuccacagacgcgaccugcggcuugccgcgaacgcuauuuguuccgccguaccuguugauugggugcccacaaguaggacuaccuggagcauccaugcacaccaucaguggaugacaacugaggacaugcugucggucuggaauagaguguggauugaagagaacccauggauggaagauaagacccacaucuccucuuggggagacguucccuaucucggcaaacgcgaggaccaauggugcggcucauuaauagggcugacggcccgggcuacaugggccaccaauauccagguggcaauuaaccaggucaggcgauugaucggaaaugagaacuaccuggauuacaugacuagcaugaagagauuuaaaaaugaaagugacccugagggugcucucugguga

SEQ ID NO: 13763 - RNA, 9879 nt, Artificial Sequence
  derived and/or modified CDS sequence (opt3) from DENV-1__GQ199786__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgagagagccgugcuggaugacgggauauauaggaucaugcagcguggacuuuuaggucgcagccagguuggcguagggguguuucaagaaaacgucuuccauaccauguggcacgugacacggggagcgguucugauguaccagggcaaaagacucgagccgaguugggcuagcgugaagaaagacuugauuuccuacggugggggauggaggcugcagggcucuuggaauaccggcgaggaaguccaggugaucgccguagagccugggaagaaccccaaaaauguccaaacagcaccaggaacuuuuaagacccccgaaggugaggugggcgccauugcucucgauuucaagccugggacgucgggaagcccaaucguuaaccgagaaggcaaaauagugggucuguaugggaauggagucgugacaacuucaggcaccuacguuuccgccaucgcacaggcuaaggccagucaggagggcccccuuccugagauugaagacgagguguuucggaaacgcaaccugacaaucauggauuugcacccggggucuggaaagaccagaagguaucuaccagcgauuguccgggaagccaucaaacgaaagcugagaacucucauauuagcacccacccgcgugguagcuagcgagauggccgaagcucugaaggguaugccuauuagguaccaaacaacggcagugaaauccgagcauacuggcaaggagaucguugaccuuaugugccacgccaccuucacaaugcgucugcucucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacuguuugaggaaaaauggcaagcgggugauccagcugagcaggaagacauucgauaccgaauaccagaaaaccaagaacaacgacugggacuacgucgugacuacagauaucucggagaugggggcgaauuuccgcgccgaccguguuauugauccuagacggugccucaaacccgugauccugaaggacggaccagaaagggucauucuugcagguccgaugccugugaccguagcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguggaacucaugcggcguggagaccugccaguuuggcuuagcuacaaggucgcuucagagggcuuucaauauagugaucgccgauggugcuucgacggggaaagaaacaaucaggugcuggaggaaaacauggauguggagauauggaccaaagagggagaaaggaagaaacuccggccccgcugguuggacgccagaacauacucugacccucuggcucuaagggaguuuaaggaguucgcagccggucggcgauccgucagcggcgaucugauccucgagauugggaaacuuccgcagcaccugacucagagagcucaaaaugccuuagacaacuugguuaugcugcauaauucagaacagggaggccgcgcauauaggcacgcgauggaggagcucccagauaccaucgaaacacugaugcuucuggcccucauugcuguguugaccggugggguaauccuguuuuucuuaaguggccggggacuaggcaagacuagcauagggcugcucugugugauggccuccucuguccuucuguggauggcaagcguggagccccauuggaucgcugccuccauuaucuuggaauuuuuccugaugguucuccugauuccugagcccgaccgucagagaacgccacaggauaaccaacuugcauacguggucaucggacuccuguuuaugauauugaccguagccgcuaaugagaugggucuguuagaaacaacuaagaaagaccuaggcauugggcacguggcgguugagaaccaccaucacgccgcaaugcuggauguggaccuccauccugcuucagccuggacccuuuacgccgucgcaacaaccaucauuacucccaugaugaggcacacaaucgaaaacacgaccgcuaauauaucucugacugccaucgcgaaccaggcugccauuuugaugggacuggauaagggcuggccaaucaguaaaauggacauuggugugccucuccuggcacuugggugcuauucgcaggucaauccguuaacacugaccgccgcugugcucauguugguugcacauuacgccaucauaggccccggacugcaagcgaaggcuacccgcgaggcccagaaacggacagcagccggcauuaugaagaacccaacuguggaugggaucguagcuaucgaccuagauccuguggucuaugacgccaaguucgaaaaacagcugggacagauuaugcuccuuauccuguguacgagccaaauauugcugaugcgaaccacaugggcacucugcgaguccauuacucuggcuaccggccccuuaacaacccuuugggaggguucuccagggaaguuuuggaauacuacgaucgccguuucaauggcgaacauuuucagaggaagcuaccuggccggcgcaggucucgcuuucucccuaaugaaaagucugggcgggggaaggcgcggcacaggggcccagggagaaaccuugggcgagaaguggaaacggcagcugaaucagcucucuaagagcgaauuuaacacuuauaagagaucagguaucauggagguggaccguuccgaagcaaaagaggggcuuaagaggggagagaccacaaaacacgcugucagucggggcacugccaagcugcgcugguucguggaacgaaauuugguaaaaccugaggguaaggugauagaucugggcugugggagaggaggcuggagcuacuauugcgccgggcucaagaaaguuaccgaagugaagggauacacaaaaggcggucccgggcacgaggaaccgaucccaauggcgacguacggauggaacuuagucaagcugcauucuggcaaagacguguuuuucauuccucccgagaagugugauacccuucugugcgacaucggcgaguccucaccaaaucccacuauugaagaggggaggacacuacggguccucaaaaugguggaaccuuggcugcgcggaaaccaauuuuguaucaagauuuugaauccguauaugcccagcguuguagagacccuggagcagaugcagagaaagcacgguggcaugcucgugaggaacccacuuucgcgaaauucuacucaugaaauguacugggucaguugcgggacaggaaacaucguguccgcuguuaauaugaccagccggaugcuguuaaaccguuucacgauggcacacagaaaaccuaccuaugagcgcgauguggaccugggcgccgguacaaggcacgucgcuguggaacccgagguagccaacuuggauauaauugggcagcggaucgaaaauaucaagcaugagcacaaaucaacuuggcauuacgacgaggauaacccuuauaagaccugggcauaccacggauccuaugaagugaaaccaucuggcagcgccaguuccaugguuaauggcgucgugaagcuccugacaaagcccugggacgugauuccuauggucacucaaauagcuaugaccgauacaaccccauuugggcagcagagaguuuucaaagagaagguggacacucgcacgcccaaagcgaagaggggaacagcccaaaucauggaaguaaccgcaaaauggcuaugggguuuucuuagccgaaacaagaagccgcggauuuguacuagagaggaguucaccaggaaagugcgcucuaaugcugccaucggcgcagucuuuguggacgagaaccaguggaacucagccaaggaggcuguugaagaugagcguuucugggaccuggugcaucgggaaagagagcuccacaaacaggggaagugcgccacaugcgucuacaacaugaugggaaaaagggaaaagaagcugggcgaguuugguaaagcgaaggggagucgcgcaauuugguacaugugguugggagcccgauuccuggaguucgaagcucucggcuuuaugaaugaggaucacugguucucccgggaaaacagccuuucuggcguggagggggagggacugcauaaauuagguuauauccugagagacauaucgaagaucccuggcgggaauauguacgccgaugacacggcaggaugggauaccaggauuacugaagacgauuugcagaacgaggcucgcaucacagacauuauggaaccagagcacgcccuccuggcuagaucaaucuuuaaacuaaccuaucaaaauaagguaguucgggugcagaggcccgccaaaaacggcacugucauggaugugauaagccgucgagaccagcgcgguuccggacaggugggaacauacggccuuaauaccuucacaaacauggaagcacaacugauuagacagauggagagugagggcaucuuuucuccuagcgaacucgagacuccaaaccuggcggaacgggucuuggauugguuagagaaguaugggguugaaaggcugaagcgcauggccaucuccggagacgacugugugguaaaacccauugaugacagauucgcuaccgcccucacggcacuuaaugauauggguaaggugcggaaagacauaccgcagugggagccuucaaagggcuggaacgauuggcagcaaguccccuuuugcagucaucacuuccaccagcugaucaugaaagacgggagggagauugugguuccaugucgaaaucaggaugagcuagugggacgugcuagagucucucagggcgccgguuggagccugcgcgagaccgcaugccucgggaaguccuacgcccaaauguggcaguugauguauuuucaucggagggaccugagacuugcggcuaacgccaucuguucagcagugccuguagauuggauucccacaagccgcacuaccuggucuauccacgcccaucaccaguggaugacaacugaagacaugcuguccguuuggaaucggguguggauagaggaaaacccauggauggaggauaagacccauaucaguagcuggggagacguccccuaccucggcaaaagggaggaccaauggugcggcucguuaauugggcugacggcucgagccacaugggcaaccaauauccagguggcuauuaaccagguuagacgguugaucggaaaugaaaacuaccuggauuauaugacuuccaugaagagguucaaaaaugagucugacccugaaggugcccucugguga

SEQ ID NO: 13764 - RNA, 9879 nt, Artificial Sequence
  derived and/or modified CDS sequence (opt3) from DENV-1__GQ199787__SS-prME
agcgugaccaugcugcucaugcuuguccccacagcccuggcuuuccacuugacuacgaggggaggggaaccucauaugaucguuaccaagcaggaaaggggaaaauccuuacuguuuaagacaucugcuggugugaauaugugcacucuaauugccauggaccucggcgaacugugugaagauaccaugacauacaaaugcccacggauaaccgaggcggaaccggacgauguagacuguuggugcaaugcuacugauacaugggugaccuaugggacguguucacaaacuggagagcaccgccgagacaagcguagugucgcccuugcaccccaugugggccuggguuuggagaccagaacagaaacuuggaugagcuccgagggggccuggaaacagauccagaggguugaaaccugggcucuccggcacccuggauucacagugauugcacuguuucuggcccaugcuaucggcaccucuauuacgcagaagggcaucauauucauccucuuaaugcuggucacuccaucgauggccaugcgcugcguggggauuggaucaagagauuuuguagagggucuuagcggcgcgacauggguugacguggucuuggagcacgggaguugugugaccacuauggcaaaggauaaacccacacuggacaucgaacuacucaagaccgaggugacgaacccugccguccugaggaaacuuugcauugaagcuaagaucuccaauaccacaacugauucucgguguccaacccaaggagaggccacacugauggaagaacaagacgcaaacuucguuugccgccgaacuuuuguggauagaggcugggguaauggguguggauuguucggcaaaggcagccucauaaccugcgcuaaguuuaagugcguaacaaaacuggaggggaagauugugcaguacgaaaacuuaaaauauuccgucaucgugaccguucacacuggagaccagcaucaaguggguaaugagucaacggaacacggcacaaccgccacuauuacaccccaggcgccuacaagugagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugauucagaacggacgcuugaucacugcaaaucccauaguaacagacaaagagaagccugucaacauugaagccgagccacccuuuggcgagucuuauaucgugaucgguguuggggaaaaagcucugaagcucuccugguucaagaaaggcucaaguauuggaaagauguuugaggccaccgcaagaggcgccaggcggauggcuauccugggggauacugccugggacuucggaagcauugguggcguguuuaccuccgucgggaaacuugugcaucagauauucggaacagcauacggcguacuguuuucuggugugagcuggacgaugaagaucgggauuggcguuuugcucaccuggcugggauuaaauucacgaaguacuucccugagcaugacauguaucgcggucggccuagugacccucuaccugggggugaugguccaggcugauucuggaugcguuaucaacuggaaaggccgcgaacuuaagugugguucagggauuuucgugacaaaugaggugcacacuuggaccgaacaauauaaguuucaggccgacaguccgaaaagauugagcgcagccauaggaaaggcuugggaggagggcguaugcgguaucagguccgccacgcggcuggaaaacauuauguggaaacagaucucuaacgagcucaaucauauucuguuagaaaacgacaugaaguucacagucgugguuggcgauguggucgggauccuggcacagggcaagaagaugauacgcccucaacccauggagcacaaauacucguggaaaagcuggggcaaggcuaagaucauuggggccgacgugcagaauaccacuuuuaucauugauggaccaaacaccccugaaugucccgacgaucagagagcguggaauaucugggagguugaggacuauggcuucgguauauuuacaacuaacauuuggcuuaaguugagggauuccuacacccaggccugcgaccaccgucucaugucagcugcaaucaaagauaguaaggccgugcaugcugacaugggguauuggauugaaucugagaaaaaugaaacauggaagcuggcccgggcuuccuucaucgagguaaagacguguauauggccaaaaucccacacccuauggucaaacggaguccuggaaagcgagauggugauccccaagauuuacggcgguccuaucucucaacauaauuaucgaccaggcuacuucacucagacagcggggccguggcaccucggaaaacuggagcuugauuuugacuugugcgaaggcaccacuguggucguugaugagcacugcgggaacagaggacccucccugaggacaaccacggugacuggcaagauuauccaugaaugguguugccgcaguuguaccuuaccuccacuccgguucaaaggugaggacgggugcugguacggaauggagauaagacccguaaaggaaaaggaggaaaaucuggugaaaagcauggucucugccggcuccggugagguggacucauuuagucuuggccuguuguguauuagcaucaugaucgaagagguuaugaggucgcgcuggucccgaaagaugcucaugacagggacccuggcuguguuccuacugcucauuaugggacagcugacuuggaacgaucuuauccgguugugcauuauggucggcgccaaugcaucugaccguauggggaugggaacaaccuaucuggcuuuaauggccacauuuaaaaugagaccuauguucgcagugggccuccuguuuaggcgccuuacuagccgggagguucugcuacucaccauaggucugucauugguggccagugucgaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguacugucaauugugagcuuguucccccuguguuuaaguacuaccucucagaagacgacauggcucccgguucugcuuggcucccuggggugcaaaccuuugaccauguuucucaucgcugagaauaagauauggggaagaaaaagcuggccacugaacgaagguaucauggccgugggcgucgugucgauucuacugucaucucuucucaagaacgauguaccccuggccgggccuuugaucgcuggaggcauguuaauugcauguuaugugaucagugguuccagcgccgaccugucucucgagaaagcggcugaggucagcugggaagaggaagccgagcacuccggggcaucacauaauauacugguugaagugcaggaugacggaacuaugaagauuaaagaugaggagagggacgauacacuuaccauccuguugaaggccacucuacuggcugugaguggcgucuacccccucagcaucccagcaacacuguuccuuugguauuuuuggcaaaagaaaaagcagcgaucuggcguguuaugggacaccccuucacccccagaaguugagcgcgccguacuggaugacgggauuuaccggauaaugcagagaggacucuuggguaggagccaggugggcgucgggguguuccaagaaaacguuuuccacacgauguggcacgugacucguggagcgguccugauguaucagggcaaacgccucgagccgaguugggcuagcgugaagaaagaccugaucuccuacggugggggauggcggcuucagggcucuuggaauaccggcgaggaaguacaggucauugccguggagccugggaagaaccccaagaauguucaaacagcaccaggaaccuuuaaaacacccgaaggugaggugggcgccaucgcucuggauuucaagccugggacuucgggaagcccaauugucaacagagaaggcaaaaucguggguuuguacgggaauggaguugugaccacgucaggcacauaugucuccgccauagcacaggcuaaggccagucaggagggcccccuaccugagaucgaagacgagguguuuaggaaacgaaaccugacuauuauggaucuccauccggggucuggaaagacccggcgcuacuuaccagcgaucguaagagaagccauuaagaggaaacugcggacacuuauccuggcacccacccgagugguugcuagcgagauggccgaagcucucaaggguaugccuauaagauaucaaacuaccgcagucaaauccgagcacacaggcaaggagauuguggacuugaugugccaugccacguucacuaugcgccugcucucaccagugaggguccccaauuacaacaugaucaucauggaugaagcccacuuuaccgacccuucuagcauugcugcgcguggguauaucaguacacggguaggaaugggcgaggcagccgcuauauucaugaccgccacuccgcccgguuccguggaagcauuuccacagagcaaugccguuauucaggaugaggaaagagacaucccugagaggucuuggaacucaggguacgaguggauuacagauuuccccggaaaaaccgugugguuugucccauccaucaagaguggcaaugacauagcuaacugucugcgcaagaauggcaaacgagugauucagcuuagcagaaagacguucgauacugaauaucagaaaaccaagaacaacgacugggacuacguugugaccaccgauaucucggagaugggggcgaauuuucgggccgacagggucaucgauccucgccguugccuaaaacccgugauucugaaggacggaccagaaagaguaaucuuggcagguccgaugccugugacuguugcuucugccgcacagcggaggggccgcauugggcgaaaccauaauaaggagggagaucaguacauauauaugggccagcccuuaaacaaugacgaggaucacgcccacuggacagaagcuaaaaugcugcucgacaacaucaauaccccagaggguauuauccccgcccuguucgaaccugagagagaaaaguccgcggcaaucgauggggaguaccggcuuaggggcgaggcccgcaaaacauucgucgaacugaugagaaggggagaccucccagugugguugagcuauaagguggcuucagagggcuuucaauacagugaucggcguuggugcuucgacggggaacgcaacaaucagguccuggaggaaaacauggauguugagauuuggacuaaagagggagaacgaaagaaacuaagacccagguggcuggacgcccggacguauucugacccucucgcacuucgcgaguuuaaggaguucgcagccgguagaagguccgugagcggcgaucugauauuagagaucgggaaguugccgcagcaucugacccagcgggcucaaaaugcccucgacaaccugguaaugcuucacaauucagaacagggaggccgagcauacagacaugcgauggaggagcugccagauacaauugaaacucucauguugcuggccuuaaucgcugugcuaaccgguggggucacacuguuuuuccucaguggccgcggacuuggcaaaaccagcauugggcuguugugugugauggccuccucuguucugcucuggauggcaagcguggagccccacuggaucgcugccuccauaauccuggaauuuuuccuuaugguccuccugauuccugagcccgacaggcagcggacuccacaggauaaccaauuggcauauguagugaucggacuguuauuuaugauucuaacgguugccgcuaaugagaugggucugcucgaaaccacaaagaaagaccuuggcaucgggcacguggcggucgagaaccaucaccaugccacuaugcuggauguggacuugcacccugcaucagcuuggacccuguacgccgucgccacaaccauaauuacucccaugaugcgucauacaaucgaaaacacgaccgcaaauauuucucucacugcuaucgccaaccaggcggcuauacugaugggacuugauaagggcuggccaaucaguaaaauggacauuggugugccuuuacuggcccucgggugcuacucgcagguuaauccguugacacugaccgcagccgugcuaaugcugguagcucacuaugcaaucauuggccccggacuccaagccaaggcgaccagagaggcucagaagaggacagccgcaggcaucaugaaaaacccaacuguggaugggauagucgccauugaccuugauccuguuguguacgacgcuaaguucgaaaaacagcugggacagaucauguugcugauccucuguacgagccaaauucuguuaaugcgcaccacaugggcccuuugcgaguccaucacucuggcaaccggcccccucacaacccuaugggaggguucuccagggaaguuuuggaauacuacgauagcugucucaauggccaacauuuuccggggaagcuaucuggcgggcgccgguuuggcauuuucccugaugaaaagucucggcgggggacgaagaggcacaggggcucagggagaaacccuuggcgagaaguggaagaggcagcugaaucaguugucuaaaagcgaguucaacaucuacaagcgcucagguauuauggagguggaccgguccgaagccaaagaggggcugaagagaggagagacuacccgucacgcaguaaguaggggcacagcuaaacuccggugguucguggaacgcaauuuaguuaagccugaggguaaggugaucgaucugggcugugggcgaggaggcuggagcuauuacugcgccgggcuuaaaaaggucacugaagugaaaggauauaccaagggcggucccgggcaugaggaaccgauaccaauggccacauacggauggaaccuggucaaacuacacucuggcaaggacguguuuuucacgccucccgagaaaugugauacccuccugugcgacaucggcgaguccucaccaaaucccacuauugaagaggggagaacauugaggguucugaagaugguagaaccuuggcuccggggaaaccaauuuuguaucaagauucuuaauccguacaugcccagcguggucgagacccuggagcagaugcagcgcaaacaugguggcauguuagugagaaacccacugucgagaaauucuacucacgaaauguauuggguuaguugcgggacaggaaacaucguguccgcggucaauaugaccagccgaauguugcucaaccgguucacgauggcucaccguaagccuaccuacgagagagauguggaccugggcgcagguacacgccauguagccguggaacccgagguugcuaaccuagauauuaucgggcagaggauagaaaauauuaaacacgagcauaagucaacuuggcacuaugacgaggauaacccuuacaaaaccugggccuaucauggauccuacgaagucaagccaucuggcagcgcaaguuccauggugaauggcguggucaaacuucugacaaaacccugggacguuaucccuauggugacucaaaucgccaugaccgauacaaccccauuugggcagcagcggguauucaaggagaaaguggacacuagaacgcccaaggcuaaacgcggaacagcgcaaauuauggaagucaccgccagguggcucugggguuuucugagccgaaacaagaagccgcggauauguacuagagaggaguucaccaggaaagugcgcucuaaugcagcuaucggcgccguuuuuguggacgagaaccaguggaacucagcaaaggaggccgucgaagaugagcguuucugggacuuggugcagaaagaacgggagcugcacaagcaggggaaaugcgcuacaugcguauauaacaugaugggaaagagagaaaagaaacucggcgaguuugguaaggccaaagggaguagggcgauuugguacauguggcuuggagcacgcuuccuggaguuugaagccuuaggcuucaugaaugaggaucacugguucucccgagaaaacagccugucuggcguugagggggagggauugcauaagcucgguuacauccugcgggacauuucgaaaaucccuggcgggaauauguaugcugaugacacggccggaugggauaccagaauaacugaagacgaucuacaaaacgaggcaaagaucacagacauuauggaaccagagcacgcacuucuggccaccucaaucuuuaaacucacuuaccagaauaagguggucagggugcagcgccccgcuaagaacggcacagugauggaugucauuagcagacgggaccagagggguuccgggcaaguuggaaccuauggccugaauacauucacuaacauggaagcccaguugauccgucagauggagagugagggcauauuuuuaccuucugaacuggagaccccaaaccucgcagaacgagugcuugauuggcuggagaaacaugggguagaacgccuaaagagaauggcgauuagcggagacgacuguguggucaaacccaucgaugaccgguucgccacggcucugaccgcccucaaugauauggguaaggugaggaaagacaucccgcagugggagccuuccaagggcuggaacgauuggcaacagguucccuuuugcucacaccacuuccaucaguugauuaugaaggacgggcgcgagauaguggucccauguagaaaugaagaugagcuggugggacgggcaaggguaagucagggcgcugguuggucucuucgagaaacagccugccuggggaaaagcuacgcacaaauguggcagcucauguauuuucaccguagagacuuacgccuggccgcgaacgcuaucuguuccgccguuccuguggauuggguccccacuucacggaccacauggagcauucaugcacaccaucaguggaugacuaccgaggacauguugucuguguggaauaggguuuggaucgaagagaacccauggauggaggauaagacgcacguguccaguuggggagacguccccuaccugggcaaaagagaagaccaauggugcggcagccucauugggcuuacagcccgcgcuaccugggccucgaauauccagguggcaauaaaccagguacggaggcugaucggaaaugagaacuaucuagauuacaugacuuccaugaagcgauucaaaaaugaaggugacccugagggcgcucugugguga

SEQ ID NO: 13765 - RNA, 9879 nt, Artificial Sequence
  derived and/or modified CDS sequence (opt3) from DENV-1__GQ199788__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggggagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuacuauugcgcggggcugaaaaagguuaccgaagugaaaggauacacaaagggcgguccugggcacgaggaacccaucccgauggcuacguacggauggaaccucgucaaauuacauucaggcaaggacguguucuuuauaccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuauaugccgucuguuguagagaccuuggagcaaaugcagcggaaacacgguggcaugcuggugcgcaacccccucaguagaaauuccacucaugaaauguacugggucagcugcgggacaggaaacaucgugucagcaguuaauaugaccuccaggaugcuucugaaccgauuuacgauggcccaccggaagccaaccuaugagcgugauguggacuuaggcgcugguacaagacacgucgccguggaaccugagguagcaaaccuggauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgacaugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacacggcuggaugggauacccggauaacugaagacgaucugcagaacgaggccaagaucacagacauuauggaaccugagcacgcuuugcucgccaaguccaucuucaaacugaccuaucagaauaagguaguuagagugcaaaggccagccaagaacggcacugucauggaugugauuagucgcagagaccagcgggguucuggacaggugggaacauacggccuaaauaccuuuacaaacauggaagcgcagcuuaucaggcaaauggagagcgagggcauauucucccccucagaacuggagacuccuaaccucgcccgucgaguccuggauugguuggaaaagcaugggguugagcgcuuaaaaagaauggcuauuaguggagacgacugugugguaaagccaaucgaugaccgguuugccaccgcacugacggcucucaaugauauggguaaggugaggaaagacaucccccagugggaaccgucuaagggcuggaacgauuggcagcaggucccuuucugcagccaccacuuucaucaacuuauuaugaaagacgggcgcgagauagugguucccuguagaaaucaggaugagcuggugggacgggccagggucucccagggcgcagguuggucacuacgagaaaccgccugccugggaaagagcuaugcgcagauguggcaacucauguacuuccaccguagagacuugcgccuggcugccaacgcaaucuguucugccgugccaguagauuggguuccuacaucccggacuaccuggaguauucaugcucaccaucaguggaugacaacugaggacaugcuuagcguguggaauagggucuggaucgaagagaaccccuggauggaagauaaaacccacauuucguccuggggagacgugccauaucugggcaagagagaggaccaguggugcggcucucucaucggguuaacggcccgcgcaacaugggcuaccaauauacaaguugccaucaaccaggugcggaggcugauuggaaaugagaacuacuuggauuacaugacuucaaugaagcgauuuaaaaaugaaagcgaccccgagggugcgcugugguga

SEQ ID NO: 13766 - RNA, 9879 nt, Artificial Sequence
  derived and/or modified CDS sequence (opt3) from DENV-1__GQ199789__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaacaugugcacccuaauugccauggaccucggcgaguucugugaagauacuaugaccuacaaaugcccgcggauaacggaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacaucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauaguagguguccaacucaaggagaggccacccuugucgaagaacaggacgcaaacuuuguuugccggcgcacauucguggaucgaggcugggguaauggguguggacuguuuggcaagggcuccuugauaacuugcgcuaaguucaaaugcguaaccaagcucgaggggaaaacagugcagcacgaaaaccugaaguacucagucauugugaccguucauacuggagaccagcaccaaguggguaaugagaguacggaacauggcacaaccgccacuaucacaccccaggcgccuagcacagagauucaguuaaccgacuauggggcccugacucucgauuguucuccaagaacaggacuugacuuuaacgaaaugguccuguugacgaugaaagagaaguccuggcuagugcacaaacagugguuccuggaucucccgcugcccuggaccucaggcgcaagcacaagccaagagacauggaauaggaaggaccuucugguaaccuuuaagacagcucacgccaaaaagcaggaaguuguggucuuggguucucaggagggggcuaugcauacugcccucaccggcgcaacggaaauccaaaccuccggaacaacuaccaucuucgccggccaccugaaaugccgguuaaagauggauaaacugacacuaaaggggacuagcuacgugauguguaccggaucguucaagcucgagaaagaagucgcugagacgcagcaugguacagugcugguucagauuaaguaugagggcaccgacgcgccuugcaaaauaccauuuucuacucaggaugaaaagggggugacacaaaacggacgucuuaucaccgcaaaucccauuguaacugacaaagagaagccugucaacaucgaagccgagccacccuucggcgaguccuacauagugauuggugcuggggaaaaggccuugaaacugucaugguuuaagaaaggcaguagcaucggaaagauguucgaggcaaccgcccgcggcgcuagaaggauggccauccucggggauacagcaugggacuuuggauccauugguggcguuuucacgucuguggggaaacugguccaccagaucuuuggaaccgcguauggcgugcuuuucagcgguguaucauggacuaugaagauugggauaggcgugcuguugacauggcucggacugaauagucgguccaccagcuuaucuaugacauguaucgcuguuggccuggucacucuauaccucggggugauggugcaggccgauucaggaugcgucauuaacuggaagggccgagaacugaaaugugguagugggaucuuuguuaccaaugaggugcauacguggacagaacaguacaaguuccaagcagacagcccgaaacgccuuuccgccgcuaucggaaaggccugggaggagggcgugugcgguauuagaucugcaaccagguuggaaaacauaauguggaaacagaucucgaacgagcugaaucacauucuccuggaaaacgacaugaaguuuacuguagucgugggcgauguugcugggaucuuagcccagggcaagaagaugauucggccucagcccauggaguauaaguacagcuggaaauccuggggcaaggcgaaaaucauaggggccgacgugcaaaauaccacauucaucauugauggaccaaacacuccugaaugucccgacgaucagcgcgcuuggaauaucugggaggucgaggacuauggcuuugguauuuucaccacaaacaucuggcugaaacuuagagauucauacacacaggugugcgaccacagguugaugagugcagccauaaaagauucuaaggcuguucaugccgacaugggguauuggauugaaagcgagaagaaugaaaccuggaaacucgcacgugcguccuucaucgaggugaagacuuguauuuggccaaaaucacacacacuguggagcaacggaguacuagaaucugagaugaucauacccaagaucuacggcgguccuaccucccagcauaauuaucggccaggcuacuuuacucaaacagccgggccguggcaccugggaaaacucgagcuggauuucgaccuuugcgaaggcaccacggucgugguggaugagcacugcgggaaccgaggacccaguuugagaacuaccacagucaccggcaagauuauccaugaaugguguugcaggagcuguacucugccuccauuacgcuuuaagggugaggacgggugcugguacggaauggagauucggcccguuaaagaaaaggaggaaaaucucgugaaaucuaugguauccgcuggcucaggugagguggacaguuucagccugggccuucuguguaucucgauaaugauugaagaggucaugagauccagguggucucgcaagauguugaugacagggacccucgccguguuuuuccugcuaaucaugggacagcugacauggaacgaucucauccgacugugcauuaugguuggcgcaaaugcuagcgaccggauggggaugggaacuaccuaucuugccuugauggcaacguuuaaaaugcguccuauguucgccgugggccuguuauuuagaaggcucacaucacgcgagguccugcuucugaccaucggucuaagucucguggcuuccguugaacugccaaacucuuuggaggaacugggggauggauuagcgaugggcauuaugauacucaagcugcuuacugacuuccagagccaccaacugugggccaccuugcucucccugacauuuaucaagacuaccuucucacuacauuacgcauggaaaacgauggcuauggugcugagcauugucagucuuuuuccccucugucugucuacaaccucccagaagacuacaugguugccgguacuguuaggcagccucgggugcaaaccucugaccauguuccuuaucgccgagaauaagauuuggggacggaaaucguggccacugaacgaagguaucauggccgugggcauaguuucaaucuugcucucuagucugcuaaagaacgaugugccccuggcugggccucuuauugcaggaggcaugcucaucgccuguuaugucauuuccgguagcucugcggaccugagcuuggagaaagcugccgagguguccugggaagaggaagcagagcacucaggggccagucauaauaucuuaguagaagugcaggaugacggaacuaugaagauaaaggaugaggagagagacgauacacugaccauucuccugaaagcuacgcuucuggcagucagcggcguuuaccccuugucuaucccagccacucuauucgugugguauuuuuggcagaagaaaaagcaaagguccggcgugcugugggacaccccuucacccccagaagucgagcgagcggugcucgaugacgggaucuaccgcauuaugcagcggggacugcuugguagaagucagguuggcguagggguguuccaggaaaacgucuuucacacaauguggcacgugaccaggggagcuguuuuaauguaucaaggcaaacgucuggagccgagcugggccuccgugaagaaggaccucauaucuuacggugggggauggcgcuugcagggcucguggaauacaggcgaggaaguccaggugaucgcaguagagccugggaaaaaccccaagaauguccagacugccccaggaaccuucaaaacgagcgaaggugaggugggcgcuauugcccuggauuuuaagcccgggacaucaggauccccuaucguuaaccgggaaggcaaaauugugggucucuacgggaauggagucgugacuaccaguggcacauauguuucugcaaucgcucaagccaaggcgagccaggagggcccacugcccgagauagaagacgagguguucagaaagaggaaccuuaccaucauggaucugcauccuggguccggaaaaacucgacgguacuugccggccauuguccgcgaagcaaucaagagaaaacuaaggacccugauucucgcuccaacacgggugguagccucagagauggcugaagcauuaaaggguaugcccauccgauaucagacgacugccgugaaaggcgagcacaccgggaaggagauaguugaccugaugugccaugccacauuuaccaugagacuucugucuccuguccgcgugccaaauuacaacaugauuaucauggaugaagcucacuucacugaccccagcaguaucgcggcaaggggauauauuuccacacgugugggcaugggugaggccgcugccaucuuuaugaccgcaacgccuccggggagcgucgaagccuucccccaaucuaaugcuguaauacaggaugaggaacgggacauuccagagagaucauggaacuccggauacgaguggaucacugauuuuccuggcaagacagugugguucguucccaguauuaaaagcggcaaugacaucgcgaacugucucaggaagaaugggaaacgcgugauacaguugucgcgaaagaccuucgauaccgaauaucagaaaacuaagaacaacgacugggacuacgucgugacaaccgauauuucugagaugggagccaauuuuagagcagaccggguuaucgauccaaggcgcugccugaagccugugauccucaaagacggucccgaacgugucauucuggcuggcccaaugccggugacaguagccuccgcagcccaaagacgggggaggaucggacgcaaccauaauaaggagggcgaucaguacauuuauaugggucagccucuuaacaaugacgaggaucacgcucacuggacugaagccaaaaugcuacuggacaacauaaauacgcccgaggggaucauuccagcguuguucgaacccgagcgagaaaagagcgcagccaucgauggcgaguacagauuacggggagaggcuaggaaaaccuuuguggaacugaugcgcagaggcgaccucccuguuuggcugucauauaaggucgccagugagggguuccaguacucugauaggcgguggugcuuugacggagaacguaacaaucaagugcuugaggaaaacauggauguggagaucuggacaaaagagggugaacgcaagaagcugcgaccaagauggcucgacgcuaggacuuauuccgaccccuuggcacugcgggaguucaaagaauuugccgcuggccgcagaagcgucucaggggaucuaauucuggagauaggaaagcucccucagcaucuuacccagagggcccagaaugcacuggacaacuuaguuauguugcacaauagugaacaaggcggucgggcguaccgacaugccauggaggagcugccggauacaaucgaaacccucaugcugcuugcucugauugccgugcucacugggggcguaacguuguucuuucugagcggaagaggcuuagggaaaaccuccaucggacuacugugugugauggcaucuagcgcucuccuuuggauggccuccgucgagccacacuggauugcagccucaaucauacuggaguucuuuuugauggugcugcucauccccgagccugaccgccagaggacaccccaggauaaccagcuggcuuauguugugauuggucuucucuucaugauccugacugucgcggccaaugagaugggcuugcuggaaaccacaaagaaagacuuagggauuggacacguagcaguggagaaccaucaccaugcugccaugcuagauguugaccugcacccagccucugcauggacccucuacgcuguggccacuacaaucauaacgccuaugaugcggcauaccauugaaaacacuacagcgaauaucagucuuaccgcuauugccaaccaagcagccauccugaugggcuuggauaaggguuggcccauaucgaagauggacaucggggucccacugcucgcucugggcugcuacagccaggugaauccucuuaccuuaacagcagccguccugaugcucguggcgcacuaugcuauuaucggaccgggcuugcaggccaaagcaacucgugaggcccaaaagagaacggcugccgggauuaugaaaaaccccaccguugauggaaucguggcaauagaccuggauccaguaguguacgacgcuaaguuugaaaaacagcuaggccagauuaugcugcucguccuuuguacaucccagauccuguugaugaggacuaccugggcccugugcgagucuaucacacucgcgaccgguccucugacuacguuaugggaggggucacccggaaaguucuggaauacaaccauugccguuagcauggcaaacaucuuccgcggcuccuaucuugcuggugccggccuggcauuuagucucaugaagucucuagggggaggccggcgagggacuggagcucaaggcgaaacccugggugagaaauggaagagacaguugaaucagcugagcaaaucagaguucaacacauacaagagguccgggauaauggagguggaccgcagugaagccaaagagggacucaagcggggcgagacuaccaagcacgccgucagcagagguacagcgaaacuucguugguuuguggaaaggaaucugguaaagccagagggcaaagugauugauuugggguguggacggggcggguggucuuauuacugcgcuggacugaagaaaguuacggaagugaagggcuauaccaaaggugggccuggacaugaggaacccaucccgauggcaacuuacggcuggaaccucgucaaguuacacuccggcaaggacguguucuuuauuccaccugagaaaugugauacacugcuuugcgacaucggggagucaagccccaauccaaccauagaagagggacgcacucugcgaguccuaaagaugguggaacccuggcucagagguaaccaguucuguaucaaaauucugaauccuuacaugccgucgguuguagagacauuggagcaaaugcagaggaagcauggcgggaugcuggugcggaacccccucucucgcaauaguacccacgaaauguauugggucuccugcggaacgggcaacaucgugagcgccguuaauaugaccucaagaaugcuucugaacagguuuacaauggcucaccgaaaaccaacuuacgagcgggauguggacuuaggugccgggacccgucaugucgcaguggaaccugagguagccaaccuggauauuaucggacagagaauugaaaauaucaagcacgagcauaaguccacauggcacuaugacgaggauaaccccuacaaaacuugggcuuaucauggcucuuacgaagugaagccuagcggcagugcguccagcaugguuaauggggucgugaaauugcucaccaagccaugggacgugauacccauggucacacagauugccaugaccgauacuacgccuuucggacaacagcgcguuuuuaaagagaagguggacacaaggaccccaaaggcaaaacgggguacugcucagaucauggaaguaaccgccaaguggcuguggggcuuccuaucuagaaacaaaaagccccgcaucuguacaagggaggaauuuacgcgaaaagugcggucaaaugcagccauuggggcugucuucguggacgagaaccaauggaauagugccaaggaggcgguugaagaugagagauuuugggaccuugugcacagggaacgcgagcugcacaagcagggaaaaugcgcaaccugcgucuauaacaugaugggcaagcgugagaaaaagcucggugaguucgggaaagccaagggaucccgggcuauaugguacauguggcugggcgccagauucuuggaguuugaagcacugggcuucaugaaugaggaucauugguuuagcagggaaaacucucucucggggguggagggagagggucuucacaaacugggcuacaucuuacgcgacauuucaaagaucccagggggaaauauguaugcugaugacacugccggcugggauacacgaauuaccgaagacgaucugcagaacgaggcuaagaucacugacauaauggaaccugagcaugccuugcucgcaaaaagcaucuucaagcugacauaccagaauaaaguaguucgggugcaaagaccagcgaagaacgguaccgucauggaugugauuuccaggcgcgaccagagagggaguggacaggugggcacauauggccuaaauacuuuuaccaacaucgaagcccagcuuauucggcaaauggagucugaggaaaucuucagccccuccgagcuggaaacgccuaaccucgcugggaggguccuggauugguuggagaaacacggaguugaacguuuaaagcgaauggccauaucaggugacgacugugugguaaagccaauugaugaccgcuuugcaaccgcucugacagcccucaaugauaugggcaaagugagaaaggacaucccccagugggagccgaguaaaggguggaacgauuggcagcaggucccuuucugcucucaccauuuucaccaacuuaucaugaaggacggacgggagauugugguucccuguaggaaucaggaugaacuggugggccgcgcaagagucagccagggugccggguggucccuacgggagacugcgugccugggaaaaucauacgcucagauguggcaacucauguauuuccauaggcgagacuugcgucuggccgcaaacgccauauguagcgcugugccaguagauuggguuccuaccucuagaacaacuugguccauccacgcccaucaccaguggaugaccacggaagacaugcuuaguguguggaaucgcgucuggauugaggaaaaccccuggauggaggauaagacacacaucagcucguggggcgacgugccauaccugggcaagcgggaggaccaguggugcgggucccucauuggauuaaccgcaagggcuacuugggccacaaauauccaaguugcgauaaaccaggugagacgccugaucgguaaugaaaacuauuuggauuacaugaccucuaugaaacgguuuaagaaugagucagaccccgaaggcgcucugugguga

SEQ ID NO: 13767 - RNA, 9879 nt, Artificial Sequence
  derived and/or modified CDS sequence (opt3) from DENV-1__GQ199790__SS-prME
agcgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugugaucggcaccucuauuacgcagaagggcaucauauucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuacaccccaggccccuacaagugagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacugggagcuucaaacuggagaaggaagucgccgagacccagcacgguacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauagggaucggcguguugcucacuuggcugggauuaaauucacgaaguacaucccugagcaugaccuguauugcgguuggccuagucacacucuaccugggggugauggugcaggcugauucuggaugcgucaucaacuggaaaggccgcgaacuuaagugugguucagggaucuucguuacuaaugaggugcacaccuggacggaacaauauaaguuucaggccgacaguccgaaaagauugagcgcagccauuggaaaggcuugggaggagggcgugugcgguauaagguccgccacacggcuggaaaacaucauguggaaacagauuucuaacgagcucaaucauauccuguuagaaaacgacaugaaguucaccguagucgugggcgauguuguggggauucuggcacagggcaaaaagaugauccgcccucaacccauggagcacaaauacucguggaaaagcuggggcaaggcuaagauaaucggggccgacguccagaauacuaccuuuauuaucgauggaccaaacacaccugaaugucccgacgaucagagagcguggaauauuugggagguggaggacuauggcuucgguaucuuuacuaccaacauauggcuuaaguugagggauucccacacacagguuugcgaccaucgucucaugucagccgcuauuaaagauaguaaggcagugcacgccgacaugggguacuggaucgaaucugagaaaaaugaaacguggaagcuggcucgggccagcuucauugagguaaagaccuguaucuggccaaaaucccauacucuauggucaaacggaguccuggaaagcgagaugauaauccccaagauuuauggcgguccuaucucucaacacaauuaccgaccaggcuauuucacacagaccgcagggccguggcaccucggaaaacuggagcuugauuuugacuugugcgaaggcacuacagugguggucgaugagcauugcgggaacagaggacccucccugaggaccacgacuguuaccggcaagauuauccacgaaugguguugccgcaguuguacauuaccuccacuccgguucaaaggugaggacgggugcugguacggaauggagauaagacccgugaaggaaaaggaggaaaaucugguaaaaagcauggugucugcgggcuccggugaggucgacucauuuagucuuggccuguuguguauuagcaucaugaucgaagaggugaugaggucgcgcuggucccgaaagaugcucaugaccgggacucuggccguuuuccuacugcucauuaugggacagcugacauggaacgaucuuauccgguugugcauuauggugggcgcuaaugccucugaccguauggggaugggaaccacauaccuggcauuaauggcuacuuuuaaaaugagaccuauguucgccgucggccuccuguuuaggcgccuuaccagccgggaggugcugcuacucacgauaggucugucauugguugcaaguguggaacugccaaacuccuuagaggaacucggggauggacuggccaugggcaucaugauucuuaagcuguugacagacuuccaaucucaucagcucugggcuacccugcuaagccugacuuuuaucaaaaccacacuuucccuccacuaugcguggaagacuauggccaugguccugucaauuguauccuuguucccccuguguuuaaguaccacgucucagaagacaaccuggcucccggugcugcuuggcucccuggggugcaaaccuuuggcaauguuucucaucgcugagaauaagauauggggaagaaaaagcuggccacugaacgaagguaucauggccguuggcguggucucgauucuacugucaucucuucucaagaacgaugugccccuggccgggccuuugaucgcuggaggcauguuaauugcauguuacguaaucagugguuccagcgccgaccugucucucgagaaagcggcugaggugagcugggaagaggaagccgagcauuccggggcaucacacaauauacuggucgaaguucaggaugacggaacuaugaagauuaaagaugaggagagggacgauacacuuaccauccuguugaaggccacucuacuggcugugaguggcguguauccccucagcaucccagcaacacuguucgucugguacuuuuggcaaaagaaaaagcagcgaucuggcgugcuuugggacaccccuucacccccagaaguugagcgcgccguauuagaugacgggauuuaucggauaaugcagagaggacugcucgguaggagccaggugggcgucgggguguuccaagaaaacguuuuccacacgauguggcaugugacucguggagcggucuugauguaccagggcaaacgccuggagccgaguugggcuagcgugaagaaagaccucaucuccuauggugggggauggcggcugcagggcucuuggaauaccggcgaggaaguacaggucauugccguggagccugggaagaaccccaagaauguucaaacagcaccaggaaccuuuaaaacacccgaaggugaggugggcgccaucgcucuugauuucaagccugggacuucgggaagcccaauugucaacagagaaggcaaaaucgugggucuguacgggaauggaguugugaccacgucaggcacauacgucuccgccauagcacaggcuaaggccagucaggagggccccuugccugagaucgaagacgagguguuuaggaaacgaaaccuaacuauuauggaucugcacccggggucuggaaagacccggcgcuaucucccagcgaucguaagagaagccauuaagaggaaauuacggacacugauccuugcacccacccgagugguugcuagcgagauggccgaagcucugaaggguaugccuauaagauaccaaacuaccgcagucaaauccgagcauacaggcaaggagauuguggaccucaugugccacgccacguucacuaugcgcuugcugucaccagugaggguccccaauuauaacaugaucaucauggaugaagcccauuuuaccgacccuucuagcauugcugcgcguggguacaucaguacacggguaggaaugggcgaggcagccgcuauauucaugaccgccacuccgcccgguuccguggaagcauuuccacagagcaaugccguuauucaggaugaggaaagagacaucccugagaggucuuggaacucaggguaugaguggauuacagauuuccccggaaaaaccgugugguuugucccauccaucaagaguggcaaugacauagcuaacugucuccgcaagaauggcaaacgagugauucagcugagcagaaagacguucgauacugaauaccagaaaaccaagaacaacgacugggacuauguugugaccaccgauaucucggagaugggggcgaauuuucgggccgacagggucaucgauccucgccguugccuuaaacccgugauucuaaaggacggaccagaaagaguaauccuggcagguccgaugccugugacuguugcuucugccgcacagcggaggggccgcauugggcgaaaccacaauaaggagggagaucaguacauauacaugggccagcccuugaacaaugacgaggaucacgcccauuggacagaagcuaaaauguuacuggacaacaucaauaccccagaggguauuauccccgcccucuucgaaccugagagagaaaaguccgcggcaaucgauggggaguaucggcugaggggcgaggcccgcaaaacauucgucgaacuuaugagaaggggagaccugccaguguggcucagcuacaagguggcuucagagggcuuucaauauagugaucggcguuggugcuucgacggggaacgcaacaaucaggucuuggaggaaaacauggauguugagauuuggacuaaagagggagaacgaaagaaacugagacccagguggcuagacgcccggacguacucugacccucuggcucuccgcgaguuuaaggaguucgcagccgguagaagguccgugagcggcgaucuuauacuggagaucgggaaguuaccgcagcacuugacccagcgggcucaaaaugcccuggacaaccucguaaugcugcauaauucagaacagggaggccgagcauauagacacgcgauggaggagcuuccagauacaauugaaacucugaugcucuuggcccugaucgcuguguuaaccgguggggucacacuauuuuuccugaguggccgcggacucggcaaaaccagcauugggcuucugugugugauggccuccucuguuuugcuguggauggcaagcguggagccccacuggaucgcugccuccauaauccucgaauuuuuccugaugguccuucucauuccugagcccgacaggcagcggacuccacaggauaaccaacuggcauacguagugaucggauugcuguuuaugauuuuaacgguugccgcuaaugagaugggucuacuggaaaccacaaagaaagaccucggcaucgggcauguggcggucgagaaccaccaucacgccacuaugcuugauguggaccugcauccugcaucagcuuggaccuuguaugccgucgccacaaccauaauuacucccaugaugcgucacacaaucgaaaacacgaccgcaaauauuucucugacugcuaucgccaaccaggcggcuauacucaugggacuggauaagggcuggccaaucaguaaaauggacauuggugugccucuuuuagcccuggggugcuacucgcagguuaauccgcucacauugaccgcagccgugcugaugcuaguagcucacuacgcaaucauuggccccggacugcaagccaaggcgaccagagaggcucagaagaggacagccgcaggcaucaugaaaaacccaacuguggaugggauagucgccauugaccucgauccuguuguguaugacgcuaaguucgaaaaacagcuuggacagaucaugcuguugauccuguguacgagccaaauucuccugaugcgcaccacaugggccuuaugcgaguccaucacucuugcaaccggcccccugacaacccucugggaggguucuccagggaaguuuuggaauacuacgauagcugucucaauggccaacauuuuccggggaagcuaccuagcgggcgccggucuggcauuuuccuugaugaaaagucugggcgggggacgaagaggcacaggggcucagggagaaacccucggcgagaaguggaagaggcagcuuaaucagcugucuaaaagcgaguucaacaucuauaagcgcucagguauuauggagguggaccgguccgaagccaaagagggguugaagagaggagagacuacccgucaugcaguaaguaggggcacagcuaaacugcggugguucguggaacgcaaucucguuaagccugaggguaaggugaucgauuuaggcugugggcgaggaggcuggagcuacuauugcgccgggcugaaaaaggucacugaagugaaaggauacaccaagggcggucccgggcacgaggaaccgauaccaauggccacauauggauggaaccuugucaaacugcauucuggcaaggacguguuuuucacgccucccgagaaaugugauacccuacucugcgacaucggcgaguccucaccaaaucccacuauugaagaggggagaacacugaggguuuugaagaugguagaaccuuggcugcggggaaaccaauuuuguaucaagauucucaauccguacaugcccagcguggucgagacccuugagcagaugcagcgcaaacacgguggcaugcuggugagaaacccauuaucgagaaauucuacucacgaaauguacuggguuaguugcgggacaggaaacaucguguccgcggucaauaugaccagccgaaugcuguugaaccgguucacgauggcucaucguaagccuaccuaugagagagauguggaccucggcgcagguacacgccacguagccguggaacccgagguugcuaaccuggauauuaucgggcagaggauagaaaauauuaaacaugagcacaagucaacuuggcauuacgacgaggauaacccuuauaaaaccugggccuaccacggauccuaugaagucaagccaucuggcagcgcaaguuccauggugaauggcguggucaagcuacuuacaaaacccugggacguuaucccuauggugacucaaaucgccaugaccgauacaaccccauuugggcagcagcggguauucaaggagaaaguggacacuagaacgcccaaggcuaaacgcggaacagcgcaaauuauggaagucaccgccagguggcugugggguuuucucagccgaaacaagaagccgcggauauguacuagagaggaguucaccaggaaagugcgcucuaaugcagcuaucggcgccguuuuuguggacgagaaccaguggaacucagcaaaggaggccgucgaagaugagcguuucugggaccuggugcagaaagaacgggaguugcacaagcaggggaaaugcgcuacaugcguauacaacaugaugggaaagagagaaaagaaacugggcgaguuugguaaggccaaagggaguagggcgauuugguauauguggcucggagcacgcuuccuugaguuugaagcccugggcuucaugaaugaggaucauugguucucccgagaaaacagcuuaucuggcguugagggggagggacugcacaaguuggguuacauccuccgggacauuucgaaaaucccuggcgggaauauguacgcugaugacacggccggaugggauaccagaauaacugaagacgaucugcaaaacgaggcaaggaucacagacauuauggaaccagagcaugcucuacuugccaccucaaucuuuaagcugacuuaucagaauaaagugguccgcgugcagagacccgcuaagaacggcacagugauggaugucauuagccggagggaccagcgugguuccgggcaaguuggaaccuacggccucaauacauucacuaacauggaagcccagcugauccgacagauggagagugagggcauauuuuugccuucugaauuagagacccagaaccuggcagaacgcgugcucgauuggcuugagaaguaugggguagaaagacugaaacggauggcgauuagcggagacgacuguguggucaagccaaucgaugacagguucgccacggcucuaaccgcccugaaugauauggguaaagugcgcaaggacaucccccaaugggagccguccaaaggcuggaacgauuggcagcagguuccuuuuugcucacaccacuuccaucagcucauuaugaaggacgggagagagauagugguccccugucggaaucaagaugaauuggugggaagggcacgaguaagucagggcgcugguuggucucugcgugagacagccugccuuggaaagagcuacgcacagauguggcaacugauguauuuucacagacgcgaccuccgguuagccgcgaacgcuaucuguuccgccguuccaguggauugggucccuacuucaaggaccacauggagcauucaugcacaccaucaguggaugacuaccgaagacaugcugucuguguggaauagaguuuggaucgaggaaaaccccuggauggaggauaaaacgcacguguccaguuggggagacgucccauacuugggcaagcgcgaggaccaguggugcggcagccugauugggcucacagcccgggcuaccugggccucgaauauccagguggcaauaaaccaaguaaggcgacuuaucggaaaugaaaacuaucuggauuacaugacuuccaugaaaagauucaagaaugagggugaccccgaaggcgcucuaugguga

SEQ ID NO: 13768 - RNA, 9879 nt, Artificial Sequence
  derived and/or modified CDS sequence (opt3) from DENV-1__GQ199791__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaagcuucaaacuggagaaggaaguggcugagacccagcacgguacgguccuugugcagauaaaguacgagggcacagacgcgccuugcaaaaucccauucuugacccaagaugaaaaggggguuacucagaacggacgccugauuacagcaaaucccaucgugaccgacaaagagaagccuguaaacauagaagccgagccacccuuuggcgagucguauauugucaucggugcuggggaaaaagcccucaagcugucuugguucaagaaaggcuccucaaucggaaagauguuugaggcaacugccagaggcgcuaggcggauggccauucuuggggauaccgcaugggacuucggaaguaucgguggcguguuuacaagcguugggaaacuggugcaucagauuuucggaacggcguacggcgucuuguuuuccggugugucuuggaccaugaagauagggaucggcguacuccugacuugguuaggacugaauagccgaucaacaagucuauccaugaccuguauugcugugggccucguuacacuguaccuuggggucauggugcaggccgauagcggaugcgugaucaacuggaaaggccgcgaauugaagugugguucugggaucuucgucacuaaugagguucacaccuggacggaacaauauaaguuucaggcagacucaccgaaaagacugagugccgcuauuggaaaggccugggaggagggcgugugcgguauaaggagcgcaacacggcucgaaaacaucauguggaaacagauuuccaacgagcugaaucauaucuuacuggaaaacgacaugaaguucaccgugguagucggcgaugugguugggauucuugcucagggaaaaaagaugauccgcccucaacccauggagcacaaauacucuuggaagucguggggcaaggccaaaauaaucggggcggacgugcagaauacuaccuuuauuaucgauggaccaaacacaccugaaugucccgacgaucagagagccuggaauauuugggaggucgaggacuauggcuucgguaucuuuacuaccaacauaugguugaagcucagggauagcuacacacaggugugcgaccaccgucugauguccgcugcaauuaaagauucaaaggccguucaugcugacaugggguauuggaucgaaagugagaaaaaugaaacguggaagcuagcccgggcaucuuucauugaggugaagaccuguaucuggccaaaaagccacacucugugguccaacggaguacucgaaucagagaugauaauccccaagauuuacggcgguccuaucagccaacauaauuaucgaccaggcuacuucacacagaccgcggggccguggcaccugggaaaacuugaguuggauuuugaccugugcgaaggcacuacagucgugguggaugagcacugcgggaacagaggacccucuuuaaggaccacgacugucaccggcaagauuauccaugaaugguguugccgcuccuguacacucccuccacugcgguucaaaggugaggacgggugcugguacggaauggagauaagacccguuaaggaaaaggaggaaaaucuugugaaaaguaugguaagcgccggcucuggugagguggacuccuuuucacugggcuugcucuguauuaguaucaugaucgaagaggucaugaggagccgcuggucgcgaaagaugcugaugaccgggacucuagcuguguuccugcuccugauuaugggacagcuuacauggaacgauuugauccggcugugcauuaugguuggcgccaaugcauccgaccguauggggaugggaaccacauauuuagcucucauggccacuuuuaaaaugagaccuauguucgcagugggccugcuuuuuaggcgccugaccucucgggagguccuacuccugacgauagguuugagccugguggccucaguugaauuaccaaacagucucgaggaacugggggauggacuugcuaugggcaucaugauucugaaguugcucacagacuuccaaucccaccagcugugggcgacccuacugucucuuacuuuuaucaaaaccacacucagccugcauuacgccuggaagacuauggcaaugguguuguccauugucucacuguuccccuuaugucucagcaccacgagucagaagacaaccuggcugccgguacuucugggcucuuuggggugcaaaccucucacuauguuucugaucgcugagaauaagauauggggaagaaaauccuggccacuaaacgaagguaucauggccgugggcguugugagcauucugcuuucgucacuccugaagaacgauguccccuuggccgggccuuuaaucgcuggaggcaugcugauugcauguuaugugaucucugguaguuccgccgaccucagccuggagaaagcggcugagguaucuugggaagaggaagccgagcacagcggggcaucccauaauauacuuguggaaguccaggaugacggaacaaugaagauuaaagaugaggagagggacgauacccugacuaucuugcuaaaggccacacugcucgcuguuucaggcguguacccccugaguaucccagcaacccuuuucgugugguauuuuuggcaaaagaaaaagcagcgaagcggcgucuuaugggacacgccuucucccccagaaguggagcgcgccguucuggaugacgggauuuaccggauaaugcagagaggacucuuggguaggucccagguaggcgugggggucuuccaagaaaacguguuccacacuauguggcacguuacccguggagcggugcugauguaucagggcaaacgccucgagccgucaugggcuagugucaagaaagaccugaucagcuacggugggggauggcggcuucagggcuccuggaauacaggcgaggaagugcagguaauugccgucgagccugggaagaaccccaagaaugugcaaaccgcaccaggaacauuuaaaacucccgaaggugagguuggcgccaucgcucuggauuucaagccugggaccucuggaucgccaauugugaacagagaaggcaaaaucgucgguuuguacgggaauggagugguuacgacaagcggcacuuaugugucagccauagcacaggcuaaggccucccaggagggcccccuaccugagaucgaagacgaggucuuuaggaaacgaaaccugaccauuauggaucuccauccggggaguggaaagacacggcgcuacuuaccagcgaucgugagagaagccauuaagaggaaacugcggacccuuauccuggcacccacucgaguaguggcuucugagauggccgaagcucucaaggguaugccuauaagauaucaaaccacagcaguuaaaagcgagcacacgggcaaggagauugucgacuugaugugccaugccacuuucaccaugcgccugcucuccccagugagggugcccaauuacaacaugaucaucauggaugaagcccacuuuacagacccuucaucuauugcugcgcguggguauaucagcacccgggucggaaugggcgaggcagccgcuauauucaugacugccacaccgcccgguaguguagaagcauuuccacaguccaaugccgugauucaggaugaggaaagagacaucccugagaggagcuggaacucuggguacgaguggauuaccgauuuccccggaaaaacgguuugguuugugccaucaaucaaguccggcaaugacauagcuaacugucugcgcaagaauggcaaacgagucauucagcuuaguagaaagacuuucgauacagaauaucaaaaaaccaagaacaacgacugggacuacgugguuaccacugauaucagcgagaugggggcgaauuuucgggccgacagggugaucgauccucgccguugccuaaaacccgucauucugaaggacggaccagaaagagugaucuuggcagguccgaugccuguaacaguggcuucggccgcacagcggaggggccgcauugggcgaaaccauaauaaggagggagaucaguacauauauaugggccagcccuuaaacaaugacgaggaucacgcccacuggaccgaagcuaaaaugcugcucgacaacaucaauacaccagaggguauuauccccgcccuguucgaaccugagagagaaaagucugcggcaaucgauggggaguaccggcuuaggggcgaggcccgcaaaacuuucguugaacugaugagaaggggagaccucccagucugguuguccuauaagguggcuagcgagggcuuucaauacucagaucggcguuggugcuucgacggggaacgcaacaaucaggugcuggaggaaaacauggaugucgagauuuggacgaaagagggagaacgaaagaaacuaagacccagguggcuggacgcccggaccuauagugacccucucgcucuucgcgaguuuaaggaauucgcagccgguagaaggucuguuuccggcgaucugauauuagagaucgggaaguugccgcagcaucugacacagcgggcucaaaaugcccucgacaaccuggugaugcuucacaauagcgaacagggaggccgagcauacagacaugcgauggaggagcugccagauacuauugaaacccucauguugcuggccuuaaucgcuguacuaacagguggggugacccuguuuuuccucucaggccgcggacuuggcaaaacuaguauugggguccugugugugauggccagcuccguuuugcuguggauggcaucuguggagccccacuggaucgcugccagcauaauccucgaauuuuuccugaugguccuucucauuccugagcccgacaggcagcggacgccacaggauaaccaacuggcauauguagugaucggauugcuguuuaugauuuuaaccguugccgcuaaugagaugggucuacuggaaacaacuaagaaagaccucggcaucgggcacguggcggucgagaaccaucaccaugccaccaugcuugauguggaccugcacccugcauccgcuuggacauuguacgccgucgccaccacuauaauuacacccaugaugcgucauacgaucgaaaacaccacugcaaauauuucacugacagcuaucgccaaccaggcggcuauacucaugggacuggauaagggcuggccaaucucuaaaauggacauuggugugccucuuuuagcccuggggugcuacagucagguuaauccgcucaccuugaccgcagccgugcugaugcuaguagcucacuaugcaaucauuggccccggacugcaagccaaggcgacaagagaggcucagaagaggacugccgcaggcaucaugaaaaacccaacgguggaugggauagucgccauugaccucgauccuguuguguacgacgcuaaguucgaaaaacagcuuggacagaucaugcuguugauccuguguaccucgcaaauucuccugaugcgcacaacuugggccuuaugcgagagcaucacccuugcaacaggcccccugaccacucucugggaggguuccccagggaaguuuuggaauacgacaauagcugucucuauggccaacauuuuccggggaucauaucuagcgggcgccggucuggcauuuagcuugaugaaaucccugggcgggggacgaagaggcaccggggcucagggagaaacucucggcgagaaguggaagaggcagcuuaaucagcugaguaaaucugaauucaacaucuacaagcgcagcgguauuauggagguggaccggucagaagccaaagagggguugaagagaggagagaccacacgucacgcaguauccaggggcacugcuaaacugcggugguucguggaacgcaaucucguuaagccugaggguaaggugaucgauuuaggcugugggcgaggaggcuggaguuauuacugcgccgggcugaaaaaggucaccgaagugaaaggauauacaaagggcggucccgggcaugaggaaccgauaccaauggccacguacggauggaaccuugucaaacugcacagcggcaaggacguguuuuucaccccucccgagaaaugugauacucuacucugcgacaucggcgagucuuccccaaaucccacaauugaagaggggagaacccugaggguuuugaagaugguagaaccuuggcugcggggaaaccaauuuuguaucaagauucucaauccguacaugcccucaguggucgagacucuugagcagaugcagcgcaaacaugguggcaugcuggugagaaacccauuaagcaggaauucgacacacgaaauguauuggguuucuugcgggaccggaaacaucgugagugcggucaauaugacgucccgaaugcuguugaaccgguucaccauggcucaccguaagccuacauacgagagagauguggaccucggcgcagguacucgccauguagccguggaacccgagguugcuaaccuggauauuaucgggcagaggauagaaaauauuaaacacgagcauaagagcaccuggcacuaugacgaggauaacccuuacaaaacaugggccuaucauggaucauacgaagucaagccauccggcucugcaagcaguauggugaauggcguggucaagcuacuuacuaaacccugggacguuaucccuauggugacccaaaucgccaugacagauaccacuccauuugggcagcagcggguauucaaggagaaaguggacacgagaacacccaaggcuaaacgcggaaccgcgcaaauuauggaagucacugccagguggcugugggguuuucucucccgaaacaagaagccgcggauauguaccagagaggaauucacaaggaaagugcgcagcaaugcagcuaucggcgccguuuuuguggacgagaaccaguggaauucugcaaaggaggccgucgaagaugagcguuucugggaccuggugcagaaagaacgggaguugcacaagcaggggaaaugcgcuacgugcguauauaacaugaugggaaagagagaaaagaaacugggcgaguuugguaaggccaaagggucaagggcgauuugguacauguggcucggagcacgcuuccuugaguuugaagcccugggcuucaugaaugaggaucacugguucagucgagaaaacuccuuaagcggcguugagggggagggacugcauaaguuggguuacauccuccgggacauuucuaaaaucccuggcgggaauauguaugcugaugacaccgccggaugggauacuagaauaacagaagacgaucugcaaaacgaggcaaagaucaccgacauuauggaaccagagcacgcucuacuugccacuucgaucuuuaaacugacauaccagaauaagguggucagggugcagcgccccgcuaagaacggcaccgugauggaugucauuucaagacgggaccagagggguagcgggcaaguuggaacauauggccucaauacuuucaccaacauggaagcccagcugauccgucagauggaguccgagggcauauuuuugccuagugaauuagagacgccaaaccuggcagaacgagugcucgauuggcuugagaaauacgggguagaacgccugaagagaauggcgauuucuggagacgacuguguggucaaacccaucgaugaccgguucgccaccgcucuaacagcccugaaugauauggguaaggugaggaaagacaucccgcagugggagccuagcaagggcuggaacgauuggcaacagguucccuuuugcucccaucacuuccaccagcucauuaugaaggacgggcgcgagauaguggucccauguagaaaucaggaugaauuggugggacgggcaaggguaucacaaggcgcugguuggagucugcgagagacugccugccuugggaaaucuuaugcacagauguggcagcugauguacuuucaucguagagaccuccgcuuagccgcgaacgcuaucuguagcgccguuccuguggauuggguccccaccucccggacaacuuggucaauucacgcacaucaccaauggaugaccacggaagacaugcugagcguguggaauaggguuuggaucgaggaaaacccauggauggaggauaagacacaugugucuuccuggggagacguccccuauuugggcaaaagagaggaccaguggugcggcagucugauugggcucaccgcccgcgcuacuugggccagcaauauccagguggcaauaaaccagguacggaggcuuaucggaaaugaaaacuaccuggauuacaugacaucgaugaagcgauucaaaaaugagggugacccugaaggcgcuuuuugguga

SEQ ID NO: 13769 - RNA, 9879 nt, Artificial Sequence
  derived and/or modified CDS sequence (opt3) from DENV-1__GQ199792__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgaugccuggguaacuuaugggacauguagucagaccggagagcaccgccgagacaagcguagcguggcacuugcaccccaugucggccuggguuuggagacgagaacugaaaccuggauguccucugagggggcuuggaaacagauccagaggguggaaacaugggcacuccggcacccuggauucacuguuauugcccuguuucuggcucaugccaucggcaccucgauuacacagaagggcaucauauucauccucuuaaugcuggugaccccaucaauggcgaugcgcugcgucgggauuggaagcagagauuuuguggagggucuuaguggcgcaacguggguagacguuguguuggagcacggguccugugucacuacaauggccaaggauaaacccacccuggacaucgaauugcucaagacugaggugacaaacccugcugugcugaggaaacuuugcauugaagccaagaucucuaauaccacgaccgauagccgguguccaacacaaggagaggcaacucuggucgaagaacaggacgcuaacuucguuugccgccgaaccuuuguggauagaggcugggguaauggguguggauuguucggcaaaggcucccucauaacaugcgccaaguuuaagugcguaacuaaacuggaggggaagauugugcaguacgaaaacuuaaaauauucagucaucgugaccguucacacaggagaccagcaucaaguggguaaugagaguaccgaacacggcacuacggcgacaauuacaccccaggccccuacuaccgagauccagcugacagacuacggggcacucacccuugauuguagcccaaggacuggacuggacuucaacgaaauggucuugcuaacaaugaaggagaaaucuuggcuggugcauaagcagugguuucucgaucugccgcuucccuggacguccggcgcuucaaccagccaagagacuuggaaucggcaggaccuguugguaacauucaaaaccgcccacgcuaagaagcaggaaguugugguccucgguagucaagagggggccaugcacacagcacugacuggcgccaccgaaauccagacgucuggaaccacaacuauuuuugcuggccauuuaaaaugccgucugaagauggauaaacuaacccucaaggggauguccuaugugauguguacagguagcuucaaacuggagaaggaagucgcggagacucagcacggaaccgugcuuguucagauaaaguacgagggcacggacgcaccuugcaaaaucccauucucgacacaagaugaaaagggggugacccagaacggacgcuugauuacugccaaucccaucguaacagacaaagagaagccugucaacauagaagcugagccacccuuuggcgagucuuauauugugaucggugccggggaaaaagcacugaagcucuccugguucaagaaaggcucaaguaucggaaagauguuugaggccaccgcuagaggcgccaggcggauggcaauucugggggauacugcgugggacuucggaagcaucgguggcguuuuuaccuccguggggaaacuuguccaucagauuuucggaacagcuuacggcgugcuguuuucugguguaagcuggacgaugaagauagggaucggcguguugcucaccuggcugggauuaaauucacgaaguacuucccugagcaugacauguauugccguuggccuagucacccucuaccugggggugauggugcaggcagauucuggaugcgucaucaacuggaaaggccgcgaacuuaagugugguucagggaucuucguuacaaaugaggugcacacuuggaccgaacaauauaaguuucaggccgacaguccgaaaagauugagcgcugccauuggaaaggcaugggaggagggcgugugcgguauaagguccgcuacgcggcuggaaaacaucauguggaaacagauuucuaacgagcucaaucauauccuguuagaaaacgacaugaagcugacaguagucgugggcgauguugccgggauucuuggacagggcaaaaagaugauccgcccucaacccauggaguacaaauauucguggaaaagcugggggaaggcgaaaauaaucggagccgacgcucagaauaccacuuucauuaucgauggcccaaacaccccugaaugucccgacgaucagagagcauggaauauuugggagguggaggacuacgguuuugggaucuucacaacuaacauaugguugaagcucagggauuccuauacccaggucugcgaccaccgucugaugucagccgcuauuaaagauaguaaggccgugcacgcagacaugggauacuggaucgaaucugagaaaaaugaaacauggaagcuagcgcgggccagcuuuauugagguuaagacguguaucuggccaaaaucccauacccuguggucaaacggcgugcucgaaagcgagaugauaauccccaagauuuaugguggcccuaucucucaacacaauuaccgaccaggguacuucacucagacagcuggaccguggcaucugggcaaacuugaguuggauuucgaccugugcgaagggaccacuguagucguggaugagcacugcggaaacagaggccccuccuuaaggacaaccacggugacugguaagauuauccacgaaugguguugccgcaguuguacccucccuccacugcgguuuagaggggaggacggaugcugguauggcauggagauaaggcccgucaaagaaaaggaggaaaaucuuguuaagagcauggugucugccgguuccggcgagguagacucauucagucugggguugcucuguauuagcaucaugaucgaagaggugaugcgcucgcgauggucccggaaaaugcugaugacaggaacccuagcagucuuuuuccugcucauuaugggccagcugacuuggaacgaucuuauccguuugugcauuauggugggggcuaaugccucugacagaaugggaaugggcacaaccuaccuggcauuaauggccacauuuaagaugaggccuauguucgcuguuggucuccuguuucgccggcuuacuagcagagaggugcugcuacucaccauagggcugucauuggucgcgaguguggaacugccaaacuccuuagaggaacucggagauggccuggccaugggcaucaugauucuuaaacuguugacggacuuccaaucucaucagcucugggcaacacugcuaagccugaccuuuaucaagacuaccuucucccuucacuaugcuuggaaaacaauggccaugguucucucaauugugagccuguuucccuugugucugaguacuaccucucagaagacgacaugguuaccgguccuccuggggucccuuggaugcaagccucugaccauguucuugaucgccgagaauaaaauaugggguaggaaguccuggccacucaacgaaggcaucauggcuguagggauugugucgauccugcuaucaucucugcuuaaaaacgauguuccccucgcaggaccucugauugccggcgguauguugaucgcguguuacgugauaaguggguccagcgcugacuuaucucuggagaaggccgcagaggucagcugggaagaggaagccgagcauuccggagcuucacacaauauucucguggaaguacaggaugacggcacuaugaaaaucaaggaugaggagcgagacgauacacugaccauccuucugaaagcaacuuugcuagccgugaguggcgucuauccccugagcauuccagcgacacucuuuguuugguacuucuggcaaaagaagaaacagcgcucuggggugcugugggacaccccuucacccccagaaguggagcgggcuguccuugaugacggaauauauagaaucaugcagagggguuuacugggccguagccagguggggguuggaguauuccaagaaaacguguuucauacgauguggcacgucacucgcggcgccgugcucauguaccaggguaagcgguuggagccgaguugggcaagcguuaaaaaggaccugauuuccuacgggggaggcuggagacucaggggcucuuggaauaugggggaggaagugcaggucaucgccguggagccuggcaaaaaucccaagaauguacagaccgcuccagguacauucaagacccccgaaggcgaggucggggccauugcacuggauuuuaaaccuggaacaucgggcagcccaaucgugaaccgagaagguaagauaguugggcuuuauggaaauggcguggucacuaccucaggcacguacguguccgcuaucgcccaagcgaaagccagucaggaggggccccugccugagauugaagacgagguuuuccggaagcgcaacuugacaaucauggaucuacacccgggaucugguaaaacuagaagguaucugccagcaauugugcgggaagcuaucaagcgaaagcucagaaccuuaauacuggcccccacacgcgucguggcuagcgagauggcagaagcccuuaaaggcaugccuauuagguaccagaccacugccguaaaguccgagcauaccgggaaagagaucguggaccugaugugccacgcuacauuuacgaugcgucucuugucaccaguucggguccccaauuauaacaugaucauuauggaugaagcgcauuucacugacccuucuagcaucgcagccagaggauacauaaguaccagggugggcaugggugaggcugccgcaauuuuuaugacagccaccccgcccggguccguggaggcuuucccacaaagcaaugcggucauccaggaugaggaacgcgacauuccugagcgaucuuggaacucaggauaugaguggaucacugauuuucccggcaagacaguaugguucgugccauccauaaaaaguggcaaugacauugccaacugucugagaaagaaugggaagcggguuauccagcucagcaggaaaaccuuugauacggaauaccagaagacuaaaaacaacgacugggacuacguggucacaaccgauaucucggagaugggagcaaauuuccgcgcugaccgugugauugauccuagacggugccugaagcccguuauccuuaaagacgguccagaaagggugauucuagccggcccgaugccugucaccguggcaucugccgcucaacgccgagggagaauaggacggaaccacaauaaggagggcgaucaguauaucuacaugggucagccccugaacaaugacgaggaucaugcccacuggacugaagcgaagauguuguuagacaacauuaauacaccagaggggaucauccccgcacuguucgaaccugagagggaaaaauccgccgcuguagauggcgaguaucgccucagaggagaggccaggaagaccuuuguggaacugaugcggcguggcgaccuuccaguuuggcugagcuacaaagucgcuucagagggguuccaguauagugaucgccgauggugcuuugacggagaaagaaacaaucaagugcucgaggaaaacauggauguggagauuuggacaaaggagggugaaaggaaaaaguugcggccccgcuggcuggacgcaagaacuuacucugacccucuagcccugagggaguucaaagaauuugcugccggccggcgauccgucagcggggaucucauacuugagaucggaaagcugccgcagcacuuaacgcagagagcacagaaugcguuggacaaccugguuaugcuccauaauucagaacaaggcggucgcgccuauaggcacgcuauggaggagcugccagauaccauugaaacacuuaugcugcucgccuugaucgcagugcugacugggggcguaaccuuauucuuucuaaguggacggggccuggggaagacaagcauuggacuccuuugugugauggcuuccucuguccuguuguggauggccagcguggagccccauuggaucgcagccuccauaauccuggaguucuuucucaugguucugcuuauuccugagcccgaccgucagagaaccccacaggauaaccagcucgcuuacguggucaucggucuguuguucaugauucugacuguagcggccaaugagaugggcuuacuagaaacgaccaaaaaggaccuggggaucggacacguggcaguugagaaccaccaucacgcugccaugcucgauguggaccuucauccugccucagcauggacacuguacgcugucgccacuaccauaauuacacccaugaugaggcacaccaucgaaaacacuacagcgaauauuucuuugacggcuaucgccaaccaagcagccauacugaugggccucgauaaagguuggccaaucaguaagauggacauuggggugccucugcuugcuuuaggcugcuauucgcaggucaauccgcugacccucacugcagccguguugaugcugguugcgcauuacgcuaucauuggacccggccuacaggccaaagcaacacgcgaggcccaaaagcggaccgcugccgggaucaugaagaacccaaccguggauggaauaguagcaauugaccuggauccuguggucuaugacgcuaaauuugaaaagcagcucggccagaucaugcuucugaucuuguguacaagccagauucugcucaugcgaacuacgugggcccugugcgaguccaucaccuuagcgacagguccccuuacuacccugugggaggggucuccaggaaaauucuggaauacaaccauagccguuucaauggcaaacauuuuuagaggcagcuaccucgcuggugccggccuagcauucucccugaugaagagucuagggggaggcaggcgcgggacuggagcucaaggcgaaacgcugggugagaaauggaagcggcagcucaaucagcuuucuaagagcgaguucaacacauauaaaagaucagggaucauggagguggaccguuccgaagccaaggagggacugaaaaggggcgagaccacuaagcacgccgucagucgggguaccgcgaaauugcgcugguuuguggaacgaaaucugguaaagccugagggcaaggugauugaucucggguguggaagaggcggguggagcuacuauugcgcuggacuaaagaagguuacagaagugaaaggcuacacuaagggugggcccggacacgaggaaccgaucccaauggcaaccuacggcuggaaccuggucaaacuucauucuggcaaggacguguucuuuauaccucccgagaaaugugauacacugcuaugcgacaucggggaguccucaccaaaucccacgauugaagagggaaggacccuccggguccugaagaugguggaaccuugguugcgcgguaaccaguucuguaucaagauucugaauccguauaugcccagcguuguagagacucucgagcaaaugcagagaaaacacggcgggaugcuugugaggaacccacugucgcgaaauucuacacaugaaauguacugggucaguugcggaaccggcaacaucguguccgccguuaauaugacuagccggauguuacugaaccguuuuacaauggcucacagaaagccuaccuaugagcgcgauguggacuuggguacggggaccaggcacgucgccguggaacccgagguagcaaaccucgauauuaucggacagcggauagaaaauauuaaacaugagcacaagucaacauggcauuacgacgaggauaacccuuauaaaacuugggccuaccacggcuccuaugaagugaagccaucuggcagcgcuaguuccaugguuaauggggucgugaagcugcuaaccaaacccugggacgugaucccuauggucacacagaucgcgaugacugauaccacaccauucggacaacagagaguuuuuaaggagaaaguggacacccgcacucccaaggccaaaagggguacggcacagauuauggaaguaacagcucgauggcuuuggggcuuccugagccggaacaagaagccgagaauauguaccagggaggaauuuacucgcaaagugcguucuaaugccgcaaucggggccgucuucguggacgagaaccaauggaacucagcuaaggaggccguugaagaugagcgguuuugggaccucgugcauagagaaagggagcugcacaaacagggaaagugcgcgaccugcgucuacaacaugaugggcaaacgcgaaaagaaguugggugaguucgggaaagcaaagggaagucgagccauuugguacauguggcugggcgcucgguuucucgaguucgaagcccuuggcuucaugaaugaggaucacugguuuuccagagaaaacagccugucugggguggagggagaggguuuacauaaacugggcuauaucuugagggacauuucgaagaucccugggggaaauauguacgcagaugacacagcuggcugggauacgcgcauaaccgaagacgaucuccagaacgaggccaaaaucacugacauuauggaaccagagcacgcucugcuagccaaggcaaucuucaaacuuacauaucagaauaagguaguuagagugcaacggcccgcgaagaacgguaccgucauggaugugauuucaaggcgugaccagcgagggagcggacaggugggcacuuacggccugaauacauuuaccaacauggaagcccagcucauccgccaaauggaguccgaggggauauucaguccuucugaacuggagacaccaaacuuggcugaaagagccuuagauuggcuggagaaauauggagucgaacggcucaagaggauggcaauuagcggugacgacuguguugugaaacccaucgaugaccgcuuugcuacugcccuuaccgcacugaaugauaugggcaagguaagaaaagacaucccgcagugggagccuuccaagggguggaacgauuggcaacaggugcccuucugcucacaucacuuucaccaacuaauuaugaaggacggacgggagauagucgugccauguaggaaucaggaugaacugguuggccgagcccgugugagucagggugcgggguggucucucagagagacggcuugcuugggaaaaagcuacgcccagauguggcaacugauguauuuccaucgccgggaccuuaggcuggcagccaacgcuaucuguuccgccgucccuggcgauugggugcccaccucaagaacaacuuggagcauucacgcacaucaccaguggaugaccacagaagacaugcucucuguauggaaucgcguuuggaucgaggaaaacccauggauggaggauaagacucauauuuccaguugggaggacgugcccuacuuaggcaaacgggaagaccaguggugcgggagccugaucggauugaccgcuagggccacgugggcgacaaauauacaagucgcuaucaaccaggugcgaagacugauugguaaugagaacuaccucgauuauaugaccucgaugaagcgguuuaaaaaugaauccgacccugagggcgcccuuugguga

SEQ ID NO: 13770 - RNA, 9879 nt, Artificial Sequence
  derived and/or modified CDS sequence (opt3) from DENV-1__GQ199793__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaacuacaucacaagagaccuggaaucggcaggaccuguuggugacauucaaaacugcucacgccaagaagcaggaaguaguugugcucgguagccaagagggggcuaugcacaccgcccugacgggcgcaaccgaaauccagacaaguggaacuaccacaauuuuugccggccauuuaaaaugccgucugaagauggauaaacuaacucucaaggggaugucuuaugucauguguaccggauccuucaaacuggagaaggaaguggcugagacgcagcacgguacaguccuugugcagauaaaguacgagggcaccgacgcgccuugcaaaaucccauucagcacucaagaugaaaaggggguuacacagaacggacgcuugauuaccgcaaaucccaucgugacugacaaagagaagccuguaaacauagaagccgagccacccuuuggcgagucguauauugucaucggugcuggggaaaaagcccugaagcucucuugguucaagaaaggcuccucaaucggaaagauguuugaggcaaccgccagaggcgcuaggcggauggccauucugggggauacagcaugggacuucggaaguaucgguggcguguuuacgagcguugggaaacuugugcaucagauuuucggaaccgcguacggcguccuguuuuccggugugucuuggacuaugaagauagggaucggcguauugcucacauggcugggauuaaauagccgaucaaccagucuguccaugacauguauugcugugggccuaguuacucucuaccugggggucauggugcaggccgauagcggaugcgugaucaacuggaaaggccgcgaacuuaagugugguucugggaucuucgucaccaaugagguucacacguggacagaacaauauaaguuucaggcagacucaccgaaaagauugagugccgcuauuggaaaggccugggaggagggcgugugcgguauaaggagcgcaacccggcuggaaaacaucauguggaaacagauuuccaacgagcucaaucauauccuguuagaaaacgacaugaaguucacugugguagucggcgaugugguugggauucuggcucagggaaaaaagaugauccgcccucaacccauggagcacaaauacucuuggaagucguggggcaaggccaaaauaaucggggcggacgugcagaauaccacauuuauuaucgauggaccaaacacuccugaaugucccgacgaucagagagccuggaauauuugggaggucgaggacuauggcuucgguaucuuuaccacaaacauauggcuuaaguugagggauagcuacacgcagaugugcgaccaccgucucauguccgcugcaauuaaagauucaaaggccgugcaugcugacaugggguauuggaucgaaagugagaaaaaugaaaccuggaagcuggcccgggcaucuuucauugagguuaagacuuguaucuggccaaaaagccacacacuaugguccaacggagugcuggaaucagagaugauaauccccaagauuuacggcgguccuaucagccaacauaauuaucgaccaggcuacuucacccagacugcggggccguggcaccucggaaaacuggagcuugauuuugacuugugcgaaggcacaaccguagucguggaugagcacugcgggaacagaggacccucucugaggacgacuaccgugacaggcaagauuauccaugaaugguguugccgcuccuguaccuuaccuccacuccgguucaaaggugaggacgggugcugguacggaauggagauaagacccgucaaggaaaaggaggaaaaucugguuaaaaguauggugagcgccggcucuggugagguagacuccuuuucacuuggccuguuguguauuaguaucaugaucgaagaggugaugaggagccgcuggucgcgaaagaugcucaugacugggacacuggcugucuuccuacugcucauuaugggacagcugaccuggaacgaucuuauccgguugugcauuauggugggcgccaaugcauccgaccguauggggaugggaacaacuuaucuggcuuuaauggccaccuuuaaaaugagaccuauguucgcaguuggccuccuguuuaggcgccuuacgucucgggaggugcugcuacucacaauaggucugagcuuggucgccucaguggaacugccaaacaguuuagaggaacucggggauggacuggcuaugggcaucaugauucuuaagcuguugaccgacuuccaaucccaccagcucugggcgacucugcuaucucugaccuuuaucaaaacaacucuuagccuccauuacgccuggaagaccauggcaaugguucuguccauugugucauuguucccccuguguuuaagcacgacaagucagaagaccacuuggcucccgguccugcuuggcucucuggggugcaaaccuuugacaauguuucucaucaccgagaauaagauauggggaagaaaauccuggccacugaacgaagguaucauggcuguaggcgugguuagcauucuacugucgucacuucucaagaacgaugugccccuggccgggccuuugaucgccggaggcauguuaauugcuuguuaugucaucucugguaguuccgcagaccugagccucgagaaagccgcggaggugucuugggaagaggaagcugagcacagcggggccucccauaauauacugguagaagugcaggaugacggaacuaugaagauuaaagaugaggagagggacgauacacuuaccauccuguugaaggcaacgcuacuggccgucucaggcguuuacccccucaguaucccagcuacucuguucgugugguauuuuuggcaaaagaaaaagcagcgaagcggcgugcuuugggacaccccuucucccccagaagucgagcgcgcaguguuagaugacgggauuuaccggauaaugcagagaggacugcucgguaggucccagguuggcguagggguguuccaagaaaacgucuuccacacaauguggcacgugacccguggagccguuuugauguaucagggcaaacgccuggagccgucaugggcgagugugaagaaagaccucaucagcuacggugggggauggcggcugcagggcuccuggaaugcuggcgaggaaguccaggugauugccguagagccugggaagaaccccaagaauguccaaacagcaccaggaacuuuuaaaacccccgaaggugaggugggcgccaucgcucuugauuucaagccugggacgucuggaucgccaauuguuaacagagaaggcaaaaucgugggucuguacgggaauggagucgugacaacuagcggcaccuauguuucagccauagcacaggcuaaggccucccaggagggccccuugccugagaucgaagacgagguguuuaggaaacgaaaccuaacaauuauggaucugcauccggggaguggaaagacccggcgcuaccucccagcgaucgucagagaagccauuaagaggaaauuacggacucugauccuugcacccacccgagugguagcuucugagauggccgaagcucugaaggguaugccuauaagauaucaaacaacggcagugaaaagcgagcacacuggcaaggagauuguugaccucaugugccaugccaccuucacaaugcgcuugcuguccccagucagggugcccaauuacaacaugaucaucauggaugaagcccacuuuaccgacccuucaucuauugcugcgcguggguauaucagcacucgggugggaaugggcgaggcagccgcuauauucaugacagccaccccgcccgguagugucgaagcauuuccacaguccaaugccguaauucaggaugaggaaagagacaucccugagaggagcuggaacucugggcaugaguggauuacggauuuccccggaaaaacugugugguuuguuccaucaaucaaguccggcaaugacauagcuaacugucuccgcaagaauggcaaacgagugauucagcugaguagaaagacauucgauaccgaauaccaaaaaaccaagaacaacgacugggacuaugucgugacuacagauaucagcgagaugggggcgaauuuucgggccgacaggguuaucgauccucgccguugccuuaaacccgugauucuaaaggacggaccagaaagagucauccuggcagguccgaugccugugaccguagcuucggccgcacagcggaggggccgcauugggcgaaaccacaauaaggagggagaucaguacauauacaugggccagcccuugaacaaugacgaggaucacgcccauuggacagaagcuaaaauguuacuggacaacaucaauacuccagaggguauuauccccgcccucuucgaaccugagagagaaaagucugcggcaaucgauggggaguaucggcugaggggcgaggcccgcaaaacguucguggaacuuaugagaaggggagaccugccaguuuggcucuccuacaaggucgcuagcgagggcuuucaauauucagaucggcguuggugcuucgacggggaacgcaacaaucagguguuggaggaaaacauggauguggagauuuggaccaaagagggagaacgaaagaaacugagacccagguggcuagacgcccggacauacagugacccucuggcucuccgcgaguuuaaggaauucgcagccgguagaaggucugucuccggcgaucuuauacuggagaucgggaaguuaccgcagcacuugacucagcgggcucaaaaugcccuggacaaccucguuaugcugcauaauagcgaacagggaggccgagcauauagacacgcgauggaggagcuuccagauaccauugaaacacugaugcucuuggcccugaucgcuguguuaaccggugggguaacucuauuuuuccugucaggccgcggacucggcaaaacgaguauugggcuucugugugugauggccagcuccgucuugcuguggauggcaucuguggagccccacuggaucgcugccagcauaauccucgaauuuuuccugaugguucuucucauuccugagcccgacaggcagcggaccccacaggauaaccaacuggcauacguggucaucggauugcuguuuaugauuuuaacaguagccgcuaaugagaugggucuacuggaaacuaccaagaaagaccucggcaucgggcauguggcgguugagaaccaccaucacgccacaaugcuugauguggaccugcauccugcauccgcuuggaccuuguaugccgucgccacuacaauaauuacgcccaugaugcgucacaccaucgaaaacacuacagcaaauauuucacugaccgcuaucgccaaccaggcggcuauacucaugggacuggauaagggcuggccaaucucuaaaauggacauuggugugccucuuuuagcccuggggugcuacagucaggucaauccgcucaccuugacagcagccgugcugaugcuaguugcucacuacgcaaucauuggccccggacugcaagccaaggcgacuagagaggcucagaagaggacggccgcaggcaucaugaaaaacccaaccguggaugggauaguagccauugaccucgauccuguggucuaugacgcuaaguucgaaaaacagcuuggacagaucaugcuguugauccuguguacaucgcaaauucuccugaugcgcacuaccugggccuuaugcgagagcaucacacuugcaaccggcccccugacuacgcucugggaggguuccccagggaaguuuuggaauacaaccauagcuguuucuauggccaacauuuuccggggaucauaccuagcgggcgccggucuggcauuuagcuugaugaaaucccugggcgggggacgaagaggcacuggggcucagggagaaacccucggcgagaaguggaagaggcagcuuaaucagcugaguaaaucugaauucaacaucuauaagcgcagcgguauuauggagguggaccggucagaagccaaagagggguugaagagaggagagacaacucgucaugcagucuccaggggcaccgcuaaacugcggugguucguggaacgcaaucucguaaagccugaggguaaggugaucgauuuaggcugugggcgaggaggcuggaguuacuauugcgccgggcugaaaaagguuacagaagugaaaggauacacgaagggcggucccgggcacgaggaaccgauaccaauggccaccuauggauggaaccuugucaaacugcauagcggcaaggacguguuuuucacuccucccgagaaaugugauacacuacucugcgacaucggcgagucuuccccaaaucccaccauugaagaggggagaacucugagggucuugaagaugguggaaccuuggcugcggggaaaccaauuuuguaucaagauucucaauccguacaugcccucaguuguagagacacuugagcagaugcagcgcaaauacgguggcaugcuggugagaaacccauuaagcaggaauucgacccacgaaauguauugggucucuugcgggacgggaaacaucgugagugcgguuaauaugaccucccgaaugcuguugaaccgguucacaauggcucaccguaagccuacuuacgagagagauguggaccucggcgcagguacccgccaugucgccguggaacccgagguagcuaaccuggauauuaucgggcagaggauagaaaauauuaaacacgagcauaagagcacauggcacuaugacgaggauaacccuuacaaaacuugggccuaucauggaucauacgaagugaagccauccggcucugcaagcaguaugguuaauggcgucgugaagcuacuuaccaaacccugggacgugaucccuauggucacacaaaucgccaugaccgauacuacgccauuugggcagcagcggguuuucaaggagaaaguggacacaagaacccccaaggcuaaacgcggaacugcgcaaauuauggaaguaaccgccagguggcugugggguuuucucucccgaaacaagaagccgcggauauguacaagagaggaauucacgaggaaagugcgcagcaaugcagcuaucggcgccgucuuuguggacgagaaccaguggaauucugcaaaggaggccguugaagaugagcguuucugggaccuggugcagaaagaacgggaguugcacaagcaggggaaaugcgcuaccugcgucuauaacaugaugggaaagagagaaaagaaacugggcgaguuugguaaggccaaagggucaagggcgauuugguacauguggcucggagcacgcuuccuugaguuugaagcccugggcuucaugaaugaggaucacugguucagucgagaaaacuccuuaagcggcguggagggggagggacugcauaaguuggguuacauccuccgggacauuucuaaaaucccuggcgggaauauguaugcugaugacacugccggaugggauacaagaauaaccgaagacgaucugcaaaacgaggcaaagaucacugacauuauggaaccagagcacgcucuacuugccacaucgaucuuuaaacugaccuaccagaauaagguaguuagggugcagcgccccgcuaagaacggcacagucauggaugugauuucaagacgggaccagagggguagcgggcaagugggaacuuauggccucaauaccuucacgaacauggaagcccagcugauccgucagauggaguccgagggcauauuuuugccuagugaauuagagaccccaaaccuggcagaacgaguccucgauuggcuugagaaauacgggguugaacgccugaagagaauggcgauuucuggagacgacugugugguaaaacccaucgaugaccgguucgccacagcucuaacugcccugaaugauauggguaaggugaggaaagacaucccgcagugggagccuagcaagggcuggaacgauuggcaacagguccccuuuugcucccaucacuuccaccagcucauuaugaaggacgggcgcgagauagugguuccauguagaaaucaggaugaauuggugggacgggcaagggucucacaaggcgcugguuggagucugcgagagaccgccugccuugggaaaucuuaugcacagauguggcagcugauguacuuucaucguagagaccuccgcuuagccgcgaacgcuaucuguagcgccgugccuguagauuggguucccacaucccggacuaccuggucaauucacgcacaucaccaauggaugacgacagaagacaugcugagcguguggaauagggucuggaucgaggaaaacccauggauggaggauaagacccaugugucuuccuggggagacguucccuauuugggcaaaagagaggaccaguggugcggcagucugauugggcucacugcccgcgcuacaugggccagcaauauccagguggcaauaaaccagguccggaggcuuaucggaaaugaaaacuaccuggauuacaugaccucgaugaagcgauucaaaaaugagggugacccugaaggcgcucuaugguga

SEQ ID NO: 13771 - RNA, 9879 nt, Artificial Sequence
  derived and/or modified CDS sequence (opt3) from DENV-1__GQ199795__SS-prME
agcgugaccaugcugcucaugcuuaugcccaccgcacuggcuuuccacuugacuacgcggggaggggagccucauaugaucgucuccaagcaggaaaggggaaaaucuuuacuguuuaagaccucagccgguguuaacaugugcacgcuaauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccguguugacaggugggguaacccuguuuuucuuaaguggccguggacuaggcaaaacuagcaucgggcugcucugugugauggcauccucuguccuucuguggauggcuagcguggagccccauuggauagccgcauccaucauuuuggaauuuuuccugaugguucuccugaucccugagcccgacagacagaggacgccacaggauaaccaacuugccuacguggucauuggacuccuguuuaugaucuugaccguagcugcgaaugagaugggucuguuagaaacaacuaagaaggaccuaggcauagggcacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugaugggacuggauaaaggcuggccaauuaguaagauggacaucggugugccucuccuggcccuugggugcuauucgcaggucaauccguuaacacugaccgcugcagugcucauguugguugcccauuacgcgauuaucggccccggacugcaagcuaaagccacccgggaggcacagaagcgaacagccgcuggcauaaugaaaaacccaacuguggaugggauuguagccaucgaccuagauccuguggucuaugacgcaaaguucgaaaagcagcugggacagaucaugcuccuuauucuguguacgagccaaaucuugcugaugagaaccacaugggcucucugcgaguccauaacucuggccaccggccccuuaacaacccuuugggaggguucuccagggaaauuuuggaauacuacgauugcgguuucaauggccaacaucuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguauuauggagguggacagguccgaagcuaaggaggggcuuaaacggggagagaccacaaagcacgccgucagucgcggcacugccaaacugcgaugguucguggaaagaaauuugguaaagccugaggguaaagugaucgaucugggcugugggaggggaggcuggagcuacuauugcgcggggcucaagaagguuaccgaagugaaaggauacacaaagggcggucccgggcacgaggacccgauaccaauggcuacguacggauggaacuuagucaaacugcauucuggcaaggauguguuuuucaucccucccgaaaaaugugacacccuucugugcgauauuggcgaguccucaccaaaucccacuaucgaggaagggcggacacuacgcguccucaagaugguggagccuuggcugagaggaaaccaauuuuguauuaaaaucuugaauccguauaugcccagcguuguagaaacccuggagcagaugcagaggaagcacgguggcaugcucgugcgaaacccacuuucgagaaauucuacucaugagauguacugggucaguugcgggacaggaaacauuguguccgcaguuaauaugaccagccguaugcuguuaaacagauucacgauggcccaccgcaagccuaccuaugaaagggacguggaucugggcgcugguacacggcacgucgccguggagcccgaaguagcaaacuuggacaucauagggcagagaauugagaauaucaaacaugaacacaagucaacuuggcauuacgaugaggacaacccuuauaaaaccugggccuaccacggauccuaugaggugaagccaucuggcagcgcuaguuccaugguuaauggcgucgugaaacuccugacaaagcccugggaugugaucccuauggucacucaaauugcgaugaccgacacaaccccauuugggcagcagcgcguuuucaaggaaaaaguggacacuaggacgcccaaggccaaacgaggaacagcacaaauaauggagguaaccgcuaaguggcuaugggguuuucuuagccggaacaaaaagccgagaaucuguacuagggaagaguucacccgcaaggugcguucuaaugccgcaauuggcgccgucuuuguggaugaaaaccaguggaacucagcuaaagaggccguugaggacgaacgguucugggaucuggugcauagagagagggaacuccacaagcaggggaaaugcgcgacaugcgucuacaacaugaugggaaagcgcgagaaaaagcugggcgaauuugguaaggcaaaagggagucgagccaucugguacaugugguugggagcucgguuccuggaguucgaggcccucggcuuuaugaaugaagaccacugguucuccagagagaacagccuuucuggcguggaaggggagggacugcauaaguuagguuauauucugagggauaucucgaaaauaccuggcgggaauauguacgcagacgauacggcuggaugggacacccgcaucacugaggaugacuugcagaacgaagccagaauuacagauaucauggagccagaacacgcucuccuggccaagucaauuuuuaaacuaaccuaucaaaauaagguaguucgggugcagaggcccgccaagaauggcacugucauggacgugaucagccgucgagaucagcgcgguuccggacaggugggaacauacggccuuaauaccuucacaaacauggaggcgcaacugauaagacagauggaaagugagggcauauuuucuccuagcgagcucgaaacuccaaaccuggccgagcgggucuuggacugguuagaaaaguaugggguugagaggcugaagcgcauggcuaucuccggagacgauugugugguaaaacccaucgacgauagauucgccaccgcacucacggcucuuaaugacauggguaaggugcggaaagauauuccgcagugggaaccuucaaagggcuggaacgacuggcagcaaguccccuuuugcagucaucacuuccaccagcugauaaugaaagaugggagggagaucgugguuccaugucgaaaucaggacgagcuagugggacgugccagagucucucagggcgcagguuggagccugcgcgaaaccgccugccucgggaaguccuacgcgcaaauguggcaguugauguauuuucaucggagggaucugagacuugcugccaacgcaauuuguucagccgugccuguagacuggauccccacaagccgcacuaccuggucuauucacgcucaucaccaguggaugacaacugaggauaugcuguccguuuggaaucggguguggaucgaagagaacccauggauggaagacaagacccauauaaguagcuggggagacguccccuaccucggcaaaagggaggaucaauggugcggcucguuaaucgggcugacggcccgagcaacaugggcuaccaauauucagguggccaucaaccagguuagacgguugauuggaaaugagaacuaccuggacuauaugacuuccaugaagagguucaaaaaugaaucugauccugagggugcgcucugguga

SEQ ID NO: 13772 - RNA, 9873 nt, Artificial Sequence
  derived and/or modified CDS sequence (opt3) from DENV-1__FJ882547__SS-prME
agcgugaccaugcugcucaugcuuaugcccaccgcacuggcuuuccacuugacuacgaggggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaauaggcaccacauaccuggccuuaauggcaacuuuuaagaugaggccuauguucgccguuggucuccuguuucgccggcuuaccagcagagaggugcugcuacucacgaucgggcugucauuggucgcuaguguggaacugccaaacuccuuagaggaacucggagauggccuggcgaugggcauuaugaugcuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaagaaccccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaggcaaaaaguugaggccccgguggcuggacgcucgcaccuacucugacccucuagcacugagagaguucaaagaauuugccgcugggaggcgguccgucagcggagaucucauacuugagaucggcaagcugccgcagcacuuaacacagcgagcccagaaugcauuggacaaccugguuaugcuccauaauucagaacaaggugggagagcguaucgccacgccauggaggagcugccagauacuauugaaacccuuaugcugcucgcuuugaucgccgugcugacaggcggaguaaccuuauucuuucuaaguggcagggggcugggaaagacuagcauuggucuccuuugugugauggcauccucuguccuguuguggauggcuagcguggagccccauuggaucgccgcauccauaauccuggaguucuuucucaugguucugcuuauuccugagcccgaccggcagcguacgccacaggauaaccagcucgccuacguggucaucggccuguuguucaugauucugaccguagcugcgaaugagaugggguuacuagaaacaacuaaaaaggaccugggaaucggccacguggccguugagaaccaccaucacgcagcuaugcucgauguggaccuucauccugccucagccuggacccuguacgcagucgcuacaaccauaauuacucccaugaugagacacacaaucgaaaacacgaccgccaauauuucuuugacugcgaucgcuaaccaagccgcaauacugaugggucucgauaaaggguggccaaucaguaagauggacauuggcgugccucugcuugccuuaggaugcuauucgcaggucaauccgcugacacucaccgcugcaguguugaugcugguugcccauuacgcgaucauuggccccgggcuacaggcuaaagccaccagggaggcacaaaagcgcacagccgcuggaaucaugaagaacccaacuguggauggcauaguagccauugaccuggauccuguggucuaugacgcaaaauuugaaaagcagcucggucagaucaugcuucugaucuuguguacgagccagauucugcucaugcggaccacaugggcucugugcgaguccaucacuuuagccaccgggccccuuacaacccugugggagggaucuccaggcaaauucuggaauacuacgauagcgguuucaauggccaacauuuuucgagguagcuaccucgcaggcgcugggcuagccuucucccugaugaagaguuugggaggcgggagaaggggaacaggcgcacaaggugaaacccugggggagaaauggaagcgccagcucaaucagcuuucuaagagcgaguucaacacuuauaaacggucaggaaucauggagguggacagauccgaagcuaaggagggccugaaacguggugagaccacaaagcacgccgucaguaggggcacugccaaauugcggugguuuguggaacgcaaucugguaaagccugaggggaaggugauugaucucggauguggccgagggggauggagcuacuauugcgcgggccuaaagaagguuaccgaagugaaagguuacacaaaagggggacccggccacgaggaaccgaucccaauggcuacguacggcuggaaccuggucaaacuucauucugggaaggacguguucuuuauaccucccgagaaaugugauacccugcuaugcgacaucggagaguccucaccaaaucccacuauugaagaggguagaacacucaggguccugaagaugguggaaccuugguugcggggcaaccaguucuguaucaagauucugaauccguauaugcccagcguuguagagacccucgagcaaaugcagcgcaaacacgggggaaugcuugugagaaacccacugucgagaaauucuacucaugaaauguacugggucaguugcggcacagguaacaucguguccgcaguuaauaugaccagccgaauguuacugaaccgguuuacgauggcccaccguaagccuaccuaugagagagauguggacuuggggacaggaacucgccacgucgcuguggaacccgagguagccaaccucgauauuaucggccagaggauagaaaauauuaaacaugagcacaagucaaccuggcauuacgacgaggauaacccuuauaaaacaugggcauaccacggcuccuaugaagugaagccaucugggagcgccaguuccaugguuaauggagucgugaagcugcuaacuaaacccugggacgugaucccuaugagcccaaucgcuaugaccgauacaacaccccuugcgcagcgggucuucaaggagaaaguugacacuagaacgccgaaggccaaacgcgguacagcacaaauuauggaagugaccgcuagguggcuguggggcuuucucucucgaaacaagaagccucggauauguacuagagaggaguucaccaggaaaguacgcucaaaugccgcaaucggggccguguuugucgacgagaaccaguggaauagugcuaaggaggccguggaagaugagcguuucugggaccugguucaucgggaaagagaguugcacaaacagggaaagugcgcgacaugcguguacaacaugaugggcaaaagggaaaagaagcugggugaguuugggaaagcaaagggaucccgcgccauuugguacauguggcucggcgcucgauuccuugaguuugaagcccugggcuucaugaaugaggaucacugguucagccgggaaaacucuuuaucgggggucgagggagagggucugcauaaauugggcuauauccucagagacauuucaaagaucccagggggaaauauguacgcagaugacacggcuggcugggauaccaggauaacugaagacgaucugcaaaacgaggccaaaaucacagacauuauggaacccgagcacgcucuacuugccaaggcaaucuuuaaacugaccuaucagaauaaggugguacgcguucagagaccugcgaagaacgguacugugauggaugucauuagccggagggaccagcguggguccggacaagugggcacauacggccucaauaccuucacaaacauggaagcccagcugauccgacagauggagagugaggaaauauuuucuccaagcgaguuggaaacucccaacuuagcugagcgcgcccuggauuggcucgaaaaauaugggguggagagacuuaagcggauggcaauuuccggagacgacugugucguuaaaccgaucgaugacagguucgcuaccgcccugacggcacuaaaugauauggguaaggugcgcaaagacaucccucagugggagcccucaaagggcuggaacgauuggcaacagguaccauuuugcagucaucacuuccaccagcugauuaugaaggacgggagagaaauaguggucccuugucggaaucaggaugagcucgugggaagggcccgaguuucucaaggcgcggguuggagcuugcgugaaaccgcuugccuggggaaauccuacgcccagauguggcagcuuauguauuuucauagacgcgaccugcggcucgcagccaacgcuaucuguucagccgugcccgucgauugggugccaacaagcaggacuaccuggucuauucacgcacaucaccaguggaugacaacugaggacauguuauccguauggaauagaguuuggaucgaagagaaccccuggauggaggauaagacccauauuaguagcugggaagacgugccuuaccugggaaaacgcgaggaccaauggugcggcucguugaucggccugacggcucgggccacaugggcgaccaauauacaggucgcuaucaaccaggugaggcgacucauugggaaugaaaacuaccuugauuauaugacuuccaugaagagauucaaaaaugagucugacccagagggagcccugugguga

SEQ ID NO: 13773 - RNA, 9879 nt, Artificial Sequence
  derived and/or modified CDS sequence (opt3) from DENV-1__GQ199797__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggggagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaaccaugaugcuccuggcucuuaucgccgugcugacaggugggguaacccucuucuuuuuguccggccgcggacugggcaagacuucuauuggguuacuaugugugauggcaagcuccguccugcucuggauggcuucaguggagccacauuggaucgccgcaucuauaauccuugaguucuuucugaugguuuugcugauucccgagccugacaggcagcggacgccccaggauaaccagcucgccuacguggucaucggacugcuuuucaugauucucaccguagcugcgaaugagaugggucuguuggaaacaacuaaaaaggaccugggcaucgggcacguggccguugagaaccaccaucacgcagcuauguuagauguggaccuacauccagccagugccuggacccuguacgcagucgcuacaaccauaauuacuccuaugaugcgucacacaaucgaaaacacgaccgccaauauuucgcucacugcgaucgcuaaccaagccgcaauacuuaugggacuggauaaaggcuggcccaucagcaagauggacauuggugugccauugcuggcccucgggugcuauucccaggucaauccucugacacuuaccgcugcaguguuaaugcugguugcccauuacgcgaucauuggcccgggacuccaggcuaaggccaccagagaggcacagaagaggacagccgcuggcaucaugaagaaccccacuguggaugggauaguagccauugacuuggauccaguggucuaugacgcaaaauuugaaaagcagcugggacagaucaugcuacugauccucuguacgucucagauucuucugaugcgcaccacaugggcuuugugcgagucaaucacucuggccaccggcccucucacaacccugugggaggguagccccgggaaauucuggaauacuacgauagcgguuuccauggccaacauuuuccggggaaguuacuuagcaggcgcuggucuugccuuuucucugaugaaaagccucggcgggggacgaagaggcacaggggcacaaggagaaacccuaggcgagaaguggaaaaggcagcugaaucaguugucaaaguccgaguucaacacuuauaaacgcagugguaucauggagguggaccggagcgaagcuaaggaggggcugaaaagaggagagaccacaaagcacgccgucucucguggcacugccaagcucaggugguuuguggaacggaaucuuguaaaaccagaggguaaggugauugaucugggcugugggcgcggaggcugguccuacuauugcgcgggguugaaaaagguuaccgaagugaaaggauacacaaagggcgguccugggcacgaggaacccaucccgauggcuacguacggauggaaccuggucaaacuccauucaggcaaggacguguucuuuauaccaccugagaagugugauaccuuacugugcgacaucggcgagagcucgcccaauccaacuauugaagaggggcgaacacuuagaguccugaaaaugguggaacccuggcuaaggggaaaccaguucuguaucaagauucucaauccuuauaugccgucuguuguagagacccuggagcaaaugcagcggaaacacgguggcauguuggugcgcaacccccugaguagaaauuccacucaugaaauguacugggucagcugcgggacaggaaacaucgugucagcaguuaauaugaccuccaggaugcuccuuaaccgauuuacgauggcccaccggaagccaaccuaugagcgugauguggaccugggcgcugguacaagacacgucgccguggaaccugagguagcaaacuuagauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaagcuguugacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcucugggguuuccugucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuagugcaucgcgaacgugagcuucacaagcaggggaagugcgcgacaugcgucuacaacaugaugggaaaacgggaaaagaaacugggcgaguucgguaaggcaaaagggagcagagccauuugguacauguggcucggagcuagguuccuggaguuugaagccuugggcuucaugaaugaggaucacugguuuucucgcgaaaacucgcugucaggcguggagggggagggacuccauaaacuugguuauauccugcgagacauuagcaaaaucccgggcgggaauauguacgcagaugacacggcuggaugggauacccggauaacugaagacgauuuacagaacgaggccaagaucacagacauuauggaaccugagcacgcucuguuggccaaguccaucuucaaacucaccuaucagaauaagguaguuagagugcaaaggccagccaagaacggcacugucauggaugugauuagucgcagagaccagcgggguucuggacaggugggaacauacggccugaauaccuuuacaaacauggaagcgcagcuaaucaggcaaauggagagcgagggcauauucucccccucagaacuugagacuccuaaccuggcccgucgaguccucgauuggcuggaaaagcaugggguugagcgcuugaaaagaauggcuauuaguggagacgacugugugguaaagccaaucgaugaccgguuugccaccgcauuaacggcucugaaugauauggguaaggugaggaaagacaucccccagugggaaccgucuaagggcuggaacgauuggcagcaggucccuuucugcagccaccacuuucaucaacucauuaugaaagacgggcgcgagauagugguucccuguagaaaucaggaugagcuugugggacgggccagggucucccagggcgcagguuggucacugcgagaaaccgccugccuaggaaagagcuaugcgcagauguggcaacugauguacuuccaccguagagaccuccgcuuggcugccaacgcaaucuguucugccgugccaguagauuggguuccuacaucccggacuaccuggaguauucaugcucaccaucaguggaugacaacugaggacaugcugagcguguggaauagggucuggaucgaagagaaccccuggauggaagauaaaacccacauuucguccuggggagacgugccauaucuuggcaagagagaggaccaguggugcggcucucugaucgggcucacggcccgcgcaacaugggcuaccaauauacaaguugccaucaaccaggugcggagguuaauuggaaaugagaacuaccuggauuacaugacuucaaugaagcgauuuaaaaaugaaagcgaccccgagggugcguugugguga

SEQ ID NO: 13774 - RNA, 9879 nt, Artificial Sequence
  derived and/or modified CDS sequence (opt3) from DENV-1__GQ199799__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaccccaucaguugugggccacacuccugagccuaaccuucaucagaacuaccuuuucccugcacuaugcauggaaaacaauggcuauggugcuuucaauugucagccucuucccgcuguguuugaguacuaccucucagaagacgacauggcugccuguauuacucggcucccuggggugcaagccacuuaccauguuucugaucgccgagaauaaaauauggggaaggaagagcuggcccuugaacgaagguaucauggccgugggcauuguuucgauccuccugucaucucuacugaaaaacgaugugccucuugcugggccccucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacuaugaaaaucaaggaugaggagcgagacgauacacucaccauccugcuuaaagcuacucuguuggcagucaguggcguuuauccacuaagcauuccugccacacuguucgugugguacuucuggcaaaagaagaaacagcgcucuggcgugcucugggacacccccuccccaccggaagucgagcgggcggugcuggaugacgggauauauagaaucaugcagaggggacuuuuaggucguucacagguuggcguagggguguuucaagaaaacgucuuccauacgauguggcacgugacucgcggagcuguucugauguaccagggcaagcggcucgagccuaguugggccagcgugaaaaaggacuugauuuccuacggugggggauggagacugcagggcucuuggaauaccggcgaggaaguccaggugaucgcaguagagcccgggaaaaacccaaagaauguccaaacagcccccggaaccuuuaagacaucggaaggugaggugggcgcuauugcccucgauuucaaaccugggacuagcggaucaccaaucguuaacagggaaggcaagauagugggucuguaugggaauggagucgugaccacguccggcacauacguuagugcaaucgcucaggccaaagcgucucaggagggcccccuuccugagauugaagacgagguguuucgaaagcggaaccugacuaucauggauuugcacccggggagcggaaaaacccgcagauaucuaccagccauugucagggaagcaaucaagcggcgacugagaacacucauauuagcucccacccgcgugguagccuccgagauggcugaagcacugaaggguaugccuauuagguaccaaacuaccgccgugaaaucagagcauacaggcaaggagaucguugaccuuaugugccacgccacguucacuaugcgucugcucucuccaguccgggugcccaauuauaacaugaucauuauggaugaagcucauuuuaccgacccuagcaguaucgcggcaagaggguacauauccacaagggugggaaugggcgaggccgcugccauuuucaugaccgcaacuccgcccgguagcgucgaagccuuuccacagucuaaugcuguaauccaggaugaggaacgcgacauuccugagcgaucauggaacuccggguaugaguggaucacagauuuccccggaaaaaccgugugguuuguuccaaguauaaagagcggcaaugacauugcgaacuguuugagaaaaaauggcaagcgggugauccagcugucgaggaagacguucgauacugaauaccaaaaaacaaagaacaacgacugggacuacgucgugaccaccgauaucucugagaugggggccaauuuccgcgcagaccguguuauugauccuagacggugccucaaacccgugauccugaaggacggaccagaaagggucauucuugcugguccgaugccugugacuguagccuccgcagcccagcgccgaggcagaauagggcggaaccacaauaaagagggagaucaguauaucuacaugggccagccccuaaacaaugacgaggaucaugcucacuggacagaagccaagaugcuguuggacaacauuaauaccccagaggguaucauccccgcguuauuugaaccugagagggaaaagagcgcagccauugauggggaguaucgccugagaggcgaggcuaggaaaacauucguggaacucaugcggcguggagaccugccaguuuggcuuucauacaaggucgccagugagggcuuucaauauucugaucgccgauggugcuucgacggggaaagaaacaaucaggugcuggaggaaaacauggauguggagauauggacuaaagagggagaaaggaagaaacuccggccccgcugguuggacgcuagaacguacuccgacccucuggcacuaagggaguuuaaggaauucgccgcuggucggcgaagcgucucaggcgaucugauccucgagauugggaaacuuccgcagcaccugacccagagagcccaaaaugcauuagacaacuugguuaugcugcauaauagugaacagggaggccgcgcguauaggcacgccauggaggagcucccagauacaaucgaaacucugaugcuucuggcucucauugccguguugaccggugggguaacacuguuuuucuuaagcggccggggacuaggcaagaccuccaucgggcugcucugugugauggcaucuagcguccuucuguggauggcuuccguggagccccauuggauagccgcaucaaucauuuuggaauuuuuccugaugguucuccugaucccugagcccgaccgucagagaacuccacaggauaaccaacuugccuacguggucauuggacuccuguuuaugaucuugacgguagcugcgaaugagaugggucuguuagaaaccacaaagaaagaccuaggcauagggcacguggccguugagaaccaccaucacgcagcuaugcuggauguggaccuccauccugccucugccuggacucuuuacgcagucgcuaccacaauuaucacccccaugaugaggcacacuauugaaaacacaacggccaauaucagucugaccgcgauagcuaaccaggccgcaaucuugaugggacuggauaagggcuggccaauuucgaaaauggacaucggugugccucuccuggcccuugggugcuauagccaggucaauccguuaacucugacagcugcagugcucauguugguugcccauuacgcgauuaucggccccggacugcaagcuaaggccacccgcgaggcacagaaacggaccgccgcuggcauaaugaagaacccaacaguggaugggauuguagccaucgaccuagauccuguggucuaugacgcaaaguucgaaaaacagcugggacagaucaugcuccuuauucuguguacuucccaaaucuugcugaugcgaacgaccugggcucucugcgagucuauaacacuggccacuggccccuuaaccacacuuugggaggguucaccagggaaguuuuggaauaccacuauugcgguuagcauggccaacaucuucagaggauccuaccuggcaggcgcuggucucgccuucagucuaaugaaaucucugggcgggggaaggcgcggcacgggggcacagggagaaacauugggcgagaaguggaaacggcagcugaaucagcucagcaagucagaauuuaacaccuauaagagauccgguauuauggagguggaccguagugaagcuaaagaggggcuuaagaggggagagacuaccaaacacgccgucagccggggcacagccaagcugcgcugguucguggaacgaaauuugguaaaaccugaggguaaggugaucgaucugggcugugggagaggaggcuggucuuacuauugcgcggggcucaagaaaguuacugaagugaagggauacaccaaaggcggucccgggcacgaggaaccgauaccaauggcuacauacggauggaacuuagucaagcugcauuccggcaaagacguguuuuucaucccucccgagaagugugauacgcuucugugcgacauuggcgagucaagcccaaaucccaccaucgaagaggggaggacucuacggguccucaaaaugguggaaccuuggcugcgcggaaaccaauuuuguauuaagaucuugaauccguauaugcccucgguuguagagacacuggagcagaugcagagaaagcacgguggcaugcucgugaggaacccacuuucucgaaauaguacccaugaaauguacugggucuccugcgggacuggaaacauugugagcgcaguuaauaugacaucacggaugcuguuaaaccguuucaccauggcccacagaaaaccuacguaugagcgcgauguggaccugggcgcugguaccaggcacgucgccguggaacccgagguagcaaacuuggauaucauagggcagcggauugaaaauaucaagcaugagcacaaauccacauggcauuacgacgaggauaacccuuauaagacuugggccuaccacggaucuuaugaagugaaaccaagcggcagugcuuccagcaugguuaauggcgucgugaagcuccugaccaagcccugggacgugaucccuauggucacacaaauugcgaugacugauaccacaccauuugggcagcagagaguuuucaaagagaagguggacacccgcacucccaaagccaagaggggaacggcacaaauaauggaaguaacagcuaaauggcuaugggguuuucuuucucgaaacaagaagccgcggaucuguaccagagaggaauucacuaggaaagugcgcucaaaugccgcaauuggcgccgucuuuguggacgagaaccaguggaauagugcuaaggaggccguugaagaugagcguuucugggaccuggugcaucgggaaagagagcuccacaaacaggggaagugcgcgaccugcgucuacaacaugaugggaaaaagggaaaagaagcugggcgaguuugguaaagcaaaggggucccgcgccaucugguacaugugguugggagcucgauuccuggaguucgaagcccucggcuuuaugaaugaggaucacugguucagccgggaaaacucucuuucgggcguggagggggagggacugcauaaauuagguuauauucugagagacaucucaaagauaccuggcgggaauauguacgcagaugacacagcuggaugggauacgaggaucaccgaagacgauuugcagaacgaggccaaaauuacugacaucauggaaccagagcacgcucuccuggccaagagcauuuuuaaacuaacauaucaaaauaagguaguucgcgugcagagacccgcaaagaacggcaccgucauggaugugaucucccggagggaccagcgugguagugggcaggugggaacuuacggccuuaauacauucaccaacauggaagcgcaacugauacgacagauggagucugagggcauuuuuagcccuuccgaacucgagacaccaaaccuggccgggcgcgucuuggauugguuagaaaaacauggaguugagagacugaagcggauggcuaucucaggugacgacugugugguaaaacccaucgaugacagguucgccacugcacucaccgcucuuaaugauaugggcaaggugcgcaaagacauuccgcagugggaaccuaguaagggguggaacgauuggcagcaaguccccuuuugcucucaccacuuccaucagcugauaaugaaggacggaagagagaucgugguuccaugucggaaucaggaugagcuagugggcagggcccgagucagccagggugcaggguggucccugcgugaaacggccugccucggaaaaucauaugcgcaaauguggcaguugauguacuuucacagacgcgaccugcggcuugcugccaacgcaauuuguagcgccgugccuguagauuggguucccaccucuaggacaacuugguccauccaugcucaccaucaguggaugaccacagaggacaugcugaguguguggaauagagucuggauugaagagaacccauggauggaagauaagacucacgugagcucguggggcgacguucccuaucucggcaaacgcgaggaccaauggugcggguccuuaaucggacugaccgcccgggcaacgugggcuacaaauauacagguggccaucaaccaggucaggcgauugcuggguaaugagaacuaccucgauuacaugaccucuaugaagagauucaaaaaugaaucagacccugagggcgcgcuuugguga

SEQ ID NO: 13775 - RNA, 9879 nt, Artificial Sequence
  derived and/or modified CDS sequence (opt3) from DENV-1__GQ199800__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguuccguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuucuuacacaagaugaaaagggggugacccagaacggacgcuugauuacugcaaaucccaucguaacagacaaagagaagccugucaacauagaagccgagccacccuucggcgagucuuauauugugaucggugcuggggaaaaagcccugaagcucuccugguuuaagaaaggcucaaguaucggaaagauguucgaggcaaccgccagaggcgcuaggcggauggccauucugggggauacugcaugggacuuuggaagcaucgguggcguuuucaccuccguggggaaacuuguccaucagauuuuuggaacagcguacggcgugcuguucucugguguaagcuggacgaugaagauagggaucggcguguugcucaccuggcugggauuaaauucacgaaguacuucccugagcaugacauguauugcuguuggccuagucacccucuaccugggggugauggugcaggccgauucuggaugcgucaucaacuggaaaggccgcgaacuuaagugugguucagggaucuuuguuacaaaugaggugcacacuuggaccgaacaauauaaguuccaggcagacaguccgaaaagauugagcgccgcuauuggaaaggccugggaggagggcgugugcgguauaagguccgcaacgcggcuggaaaacaucauguggaaacagauuucuaacgagcucaaucauauccuguuagaaaacgacaugaaguuuacaguagucgugggcgauguugcugggauucuggcccagggcaagaagaugauccgcccucaacccauggaguacaaauauucguggaaaagcuggggcaaggcgaagauaaucggggccgacgugcagaauaccacuuucauuaucgauggaccaaacaccccugaaugucccgacgaucagagagcuuggaauauuugggaggucgaggacuacggcuuugguaucuucacaacuaacauauggcuuaaguugagggauuccuauacccaggugugcgaccaccgucucaugucagcagccauuaaagauaguaaggcuguucacgccgacaugggguacuggaucgaaucugagaaaaaugaaacauggaagcuggcacgggcgagcuucauugaggugaagacguguaucuggccaaaaucccauacccuauggucaaacggaguacuggaaagcgagaugauaauccccaagauuuauggcgguccuaucucucaacacaauuaccgaccaggcuacuuuacucagacagccgggccguggcaucucggaaaacuggagcuugauuucgacuugugcgaaggcaccacugucgugguggaugagcacugcgggaacagaggacccucccugaggacaaccacggucacuggcaagauuauccacgaaugguguugccgcaguuguaccuuaccuccacuccgguuuaaaggugaggacgggugcugguauggaauggagauaagacccguuaaggaaaaggaggaaaaucuggugaaaagcaugguaucugcuggcuccggugagguggacucauucagucuuggccuguuguguauuagcaucaugaucgaagaggucaugaggucgcgcuggucccgaaagaugcucaugacagggacccuggccguguuuuuccuacugauuaugggacagcucacuuggaacgaucugauccggcuuugcauuaugguuggcgcaaaugcuucugaccguauggggaugggaacaaccuacuuggcccugauggcaacauuuaaaaugagaccuauguucgccgugggcuuacucuuuaggcgccugacuagccgggagguccuucugcuaaccauaggucucucacugguggcuaguguugaauugccaaacucccuggaggaauuaggggauggacucgcgaugggcaucaugauucugaaacuucugacggacuuccaaucucaucaguugugggccacacuccugagccuaaccuuuaucaaaacuaccuucucccugcacuaugcauggaagacaauggcuauggugcuuucaauugucagccucuuuccccuguguuugaguacuaccucucagaagacgacauggcugccgguauuacucggcucccuggggugcaaaccucuuaccauguuccugaucgccgagaauaagauauggggaagaaaaagcuggccauugaacgaagguaucauggccgugggcauuguuucgauccuccugucaucucuacugaagaacgaugugccccuugcugggccucucauugcaggaggcaugcugaucgccuguuacgucauaagugguuccagcgcggacuugucuuuagagaaagcugccgaggugagcugggaagaggaagcagagcauuccggggccucacacaauauucugguagaagugcaggaugacggaacuaugaagaucaaagaugaggagagggacgauacacucaccauccugcuuaaggcuacucuguuggcagucaguggcguuuauccccuaagcauuccagccacacuguucgugugguacuuuuggcaaaagaaaaagcagcgaucuggcgugcucugggacaccccuucacccccagaagucgagcgcgcggugcuggaugacgggauauaucggaucaugcagagaggacuuuuagguaggagccagguuggcguagggguguuccaagaaaacgucuuucauacgauguggcacgugacucguggagcuguucugauguaccagggcaaacgccucgagccgaguugggccagcgugaagaaagacuugauuuccuacggugggggauggcggcugcagggcucuuggaauaccggcgaggaaguccaggugaucgcaguagagccugggaagaaccccaagaauguccaaacagccccaggaaccuucaaaacaucggaaggugaggugggcgcuauugcccucgauuuuaagcccgggacuagcggaucaccuaucguuaacagagaaggcaaaauagugggucuguaugggaauggagucgugaccacguccggcacauacguuagugcaaucgcucaggccaaggcgucucaggagggcccacuucccgagauugaagacgagguguucaggaaacgaaaccugacuaucauggauuugcacccugggagcggaaagacccggcgcuaucuaccggccauugucagagaagcaaucaagaggaaacugcggacacucauauuagcuccaacccgagugguagccuccgagauggcugaagcacugaaggguaugcccauuagauaccaaacuaccgccgugaaaucagagcauacaggcaaggagaucguugaccuuaugugccacgccacguuuacuaugcgccugcucucuccugucagggugccaaauuauaacaugaucauuauggaugaagcucauuucaccgaccccagcaguaucgcggcacguggguacauauccacacgggugggaaugggcgaggccgcugccauuuuuaugaccgcaacuccuccggguagcgucgaagccuucccccagucuaaugcuguaauccaggaugaggaaagagacauuccagagaggucauggaacuccggguaugaguggaucacagauuuuccuggaaaaaccgugugguucguucccaguauaaagagcggcaaugacauugcgaacuguuugcgcaagaauggcaaacgagugauccagcugucgagaaagacguucgauacugaauaccagaagacaaagaacaacgacugggacuacgucgugaccaccgauaucucugagaugggggccaauuuucgggcagacaggguuauugauccacgccguugccucaaaccugugauccugaaggacggacccgaaagagucauucuugcugguccaaugccggugacuguagccuccgcagcccagcggaggggccgcauagggcgaaaccacaauaaggagggagaucaguauaucuacaugggccagccucuaaacaaugacgaggaucaugcucacuggacagaagccaaaaugcuguuggacaacauuaauacccccgaggguaucaucccagcguuauucgaacccgagagagaaaagagcgcagccauugauggggaguaucggcugaggggcgaggcucgcaaaacauuuguggaacucaugagaaggggagaccugccuguuuggcuuucauacaaggucgccagugagggcuuccaauauucugaucggcguuggugcuuugacggggaacgcaacaaucaggugcuggaggaaaacauggauguggagauauggacuaaagagggagaacgaaagaaacucagaccaaggugguuggacgcucggacguacuccgacccccuggcacuacgcgaguucaaggaauuugccgcugguagaaggagcgucucaggcgaucugauccucgagauugggaaacuuccucagcaccugacccagcgggcccaaaaugcauuagacaacuugguuaugcugcauaauagugaacagggaggccgagcguauagacacgccauggaggagcucccggauacaaucgaaacucugaugcuucuggcucucauugccguguugaccggugggguaacacuguucuuuuuaagcggccgcggacuaggcaaaaccuccaucgggcugcucugugugauggcaucuagcguccuucuguggauggcuuccguggagccacauuggauagccgcaucaaucauuuuggaguucuuucugaugguucuccugauccccgagccugacaggcagcggacuccccaggauaaccaacuugccuacguggucauuggacuccuguucaugaucuugacgguagcugcgaaugagaugggucuguuagaaaccacaaagaaagaccuaggcauagggcacguggccguugagaaccaccaucacgcagcuaugcuggauguggaccuccauccagccucugccuggacucuuuacgcagucgcuaccacaauuaucaccccuaugaugcgucacacuauugaaaacacaacggccaauaucagucugaccgcgauagcuaaccaggccgcaaucuugaugggacuggauaagggcuggcccauuucgaaaauggacaucggugugccacuccuggcccuugggugcuauagccaggucaauccuuuaacucugacagcugcagugcucauguugguugcccauuacgcgauuaucggcccgggacugcaagcuaaggccaccagagaggcacagaagaggaccgccgcuggcauaaugaaaaaccccacaguggaugggauuguagccaucgaccuagauccaguggucuaugacgcaaaguuugaaaaacagcugggacagaucaugcuccuuauucuguguacuucccaaaucuugcugaugcgcacgaccugggcucucugcgagucuauaacacuggccacuggcccuuuaaccacacuuugggaggguucacccgggaaguucuggaauaccacuauugcgguuagcauggccaacaucuuccggggauccuaccuggcaggcgcuggucucgccuuuagucuaaugaaaucucugggcgggggacgaagaggcacgggggcacagggagaaacauugggcgagaaguggaagaggcagcugaaucagcucagcaaaucagaguucaacaccuauaagcgcuccgguauuauggagguggaccggagugaagcuaaagaggggcuuaagagaggagagacuaccaaacacgccgucagccguggcacagccaagcugaggugguuuguggaacggaauuugguaaagccagaggguaaagugaucgaucugggcugugggcgcggaggcuggucuuacuauugcgcggggcucaagaaaguuacugaagugaagggauacaccaaaggcgguccugggcacgaggaacccauaccgauggcuacauacggauggaacuuagucaagcugcauuccggcaaagacguguucuuuaucccaccugagaagugugauacgcuucugugcgacauuggcgagucaagccccaauccaaccaucgaagaggggcgaacucuaagaguccucaagaugguggaacccuggcugaggggaaaccaauucuguauuaaaaucuugaauccuuauaugccgucgguuguagagacacuggagcagaugcagcggaagcacgguggcaugcucgugcgcaacccccuuucuagaaauaguacccaugaaauguacugggucuccugcgggacuggaaacauugugagcgcaguuaauaugacaucaaggaugcuguuaaaccgauuuaccauggcccaccggaaaccaacguaugagcgugauguggaccugggcgcugguaccagacacgucgccguggaaccugagguagcaaacuuggauaucauagggcagcgcauugaaaauaucaagcaugagcacaaauccacauggcauuacgacgaggauaaccccuauaagacuugggccuaccacggaucuuaugaagugaagccuagcggcagugcuuccagcaugguuaauggcgucgugaaacuccugaccaagccaugggacgugauccccauggucacacaaauugcgaugacugauaccacaccuuucgggcagcagaggguuuuuaaagagaagguggacacccggacuccaaaagccaagagaggaacggcacaaauaauggaaguaacagcuaaguggcuaugggguuuccuuucucgcaacaaaaagcccaggaucuguacccgagaggaauuuacucggaaagugagaucaaaugccgcaauuggcgccgucuucguggacgagaaccaguggaauagugcuaaggaggccguugaagaugagagguuuugggaccuggugcaucgcgaacgugagcuccacaaacaggggaagugcgcgaccugcgucuacaacaugaugggaaagcgggagaaaaagcugggcgaguucgguaaagcaaagggguccagagccaucugguacaugugguugggagcuagguuccuggaguuugaagcccucggcuucaugaaugaggaucacugguuuagccgcgaaaacucucuuucgggcguggagggggagggacugcauaaauuagguuauauucugcgagacaucucaaagauaccgggcgggaauauguacgcagaugacacagcuggaugggauacgcggaucaccgaagacgauuugcagaacgaggccaaaauuacugacaucauggaaccugagcacgcucuccuggccaagagcauuuucaagcuaacauaucaaaauaaaguaguuagagugcagaggccagcaaagaacggcaccgucauggaugugaucucccgcagagaccagcgggguaguggacaggugggaacuuacggccuuaauacauuuaccaacauggaagcgcaacugauaaggcagauggagucugagggcauuuucagccccuccgaacucgagacaccuaaccuggccgggcgugucuuggauugguuagaaaaacauggaguugagcgacugaagcgcauggcuaucucaggugacgacugugugguaaaaccaaucgaugacagauuugccacugcacucaccgcucuuaaugauaugggcaaggugcggaaggacauuccccagugggaaccgaguaaaggguggaacgauuggcagcaagucccuuucugcucucaccacuuucaucagcugauaaugaaggacggaagggagaucgugguucccugucgcaaucaggaugagcuagugggcagagcccgggucagccagggugcaggguggucccugagggaaacggccugccucggaaaaucauaugcgcaaauguggcaguugauguacuuccaccgacgugaccugagacuugcugccaacgcaauuuguagcgccgugccaguagauuggguuccuaccucucgcacaacuugguccauccaugcucaccaucaguggaugaccacagaggacaugcugaguguguggaaucgggucuggauugaagagaaccccuggauggaagauaagacucacaucagcucguggggcgacgugccauaucucggcaaaagggaggaccaauggugcggguccuuaauaggacugaccgccagagcaacgugggcuacaaauauccagguugccauuaaccaggugcgccgguugaucgguaaugagaacuaccuggauuacaugaccucuaugaagagguuuaagaaugaaucagaccccgagggcgcgcucugguga

SEQ ID NO: 13776 - RNA, 9879 nt, Artificial Sequence
  derived and/or modified CDS sequence (opt3) from DENV-1__FJ882548__SS-prME
agcgugaccaugcugcucaugcuuaugcccacugcccuggcuuuccacuugacuacgagaggaggggaaccucauaugaucgucuccaagcaggaaaggggaaaaucuuuacuguuuaagaccucagcggguguuaacaugugcacacugauugccauggaccucggagagcugugugaagauacuaugaccuacaaaugcccacggauaacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaagaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguacuucacacagaccgccggaccguggcaucugggcaaacuugaguuggauuucgaccugugcgaagggacuacagugguagucgaugagcacugcggaaacagaggccccuccuuaaggaccacgacugugaccgguaagaucauacacgaaugguguugccgcaguuguacacucccuccacugcgguuuagaggggaggacggaugcugguauggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaccuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaucagcucugggccacccugcuaucucugacuuucauuaagaccacauuuagccuucacuaugcauggaaaacuauggcuauggugcucuccaucguuucacuguugccccuguguuuaagcaccacgagucagaagacaaccuggcucccggugcugcuugggucucugggaugcaagccuuugacuauguuccucauagccgagaauaaaaucugggguaggaaguccuggccacugaacgaaggcauuauggccgucgggaucguaagcauucuacugucgucacuucucaaaaacgaugugccccuggcuggaccuuugaucgcaggcgguauguuaauagccuguuacguuauuucugggaguuccgcggaccugagccucgagaaggcugccgaggugucuugggaagaggaagcagagcauagcggagccucccacaauauccuggucgaagugcaggaugacggcacaaugaaaaucaaggaugaggagcgagacgauacccuuacuauucuguugaaagcuacacuacuggcaguaucaggcguguauccccucaguauaccagccacccuguuugucugguacuucuggcaaaagaagaaacagcgcagcgggguucuuugggacacgccuucucccccagaaguggagcgggcgguguuagaugacggaaucuauagaauuaugcagaggggucugcucggccguucccaggucggggugggaguuuuccaagaaaacguauuucauacuauguggcacgugacccgcggcgcugucuugauguaccaggguaagcggcuggagccgucaugggccagugugaaaaaggaccucaucagcuacgggggaggcuggagacugaggggcuccuggaauacaggggaggaaguucaggugauugcagucgagccuggcaaaaaucccaagaaugugcagaccgccccagguacauucaagacucccgaaggcgagguaggggcuaucgcccuugauuuuaaaccuggaaccucuggcucgccaauagucaaccgagaagguaagaucguggggcuguauggaaauggcguugugacgacaagcggcacuuacgucucagcaauugcucaagccaaagcgucccaggaggggcccuugccugagaucgaagacgagguguuccggaagcgcaaccuaaccauuauggaucugcacccgggaagugguaaaacaagaagguaucucccagccaucguucgggaagcaauaaagcgaaaguuaagaacccugauucuugcucccacucgcguggucgccucugagauggcugaagcacugaaaggcaugccuaucagguaccagaccacagccguaaagagcgagcauacggggaaagagaucguagaccucaugugccacgccacuuuuaccaugcguuugcuguccccagugcggguucccaauuauaacaugauuaucauggaugaagcucauuucacagacccuucaucuauagcggcaagaggauacauuagcaccagggucggcaugggugaggccgcugccaucuuuaugacugcaacaccgcccgggaguguggaagccuucccacaauccaaugcugugauucaggaugaggaacgcgacaucccugagcgaagcuggaacucuggacacgaguggauaaccgauuuucccggcaagacggucugguucguaccaucaauuaaauccggcaaugacaucgcgaacugucucagaaagaaugggaagcgggugauccagcugaguaggaaaacuuuugauacagaauaucagaagaccaaaaacaacgacugggacuacguugugaccacugauauuagcgagaugggagccaauuuccgcgcagaccgugucaucgauccuagacggugccuuaagcccgugauucuaaaagacgguccagaaaggguuauacuggcuggcccgaugccugugacagucgccucggcagcccaacgccgagggagaaucggacggaaccauaauaaggagggcgaucaguacauuuauaugggucagcccuugaacaaugacgaggaucacgcucacuggaccgaagccaagauguuacuggacaacaucaauacaccagaggggaucauucccgcacucuucgaaccugagagggaaaaaucugcagccguggauggcgaguaccgccugagaggagaggcuaggaagacuuuuguagaacuuaugcggcguggcgaccugccaguguggcucuccuauaaaguugccagcgagggguuccaguacucagaucgccgauggugcuuugacggagaaagaaacaaucaagucuuggaggaaaacauggauguggagauauggacgaaggagggugaaaggaaaaagcugcggccccgcuggcuagacgcuagaaccuauagugacccucuggcacucagggaguucaaagaauuugccgcuggccggcgaucuguguccggggaucuuauccuggagauuggaaaguuaccgcagcauuugacacagagagcccagaaugcacuggacaaccucgucaugcugcacaauagcgaacaaggcggucgcgcguacaggcaugccauggaggagcuuccagauacuaucgaaacccugaugcucuuggcucugauugccguuuuaacagggggcgugacccuauucuuucugucaggacggggccucgggaagacaaguaucggacuucuguguguaauggcaagcuccguguugcuguggauggcuucugucgagccccacuggauagccgcaagcaucauucucgaguucuuucugauggugcuucucaucccugagcccgaccgucagagaacgccacaggauaaccagcuggccuauguugugauugguuugcuguucaugaucuuaaccgucgcugcgaaugagaugggccuacuggaaacaacuaaaaaggaccucgggauaggacacguagccguggagaaccaucaccaugcagcuaugcuugauguugaccugcacccugccuccgccuggaccuuguacgcaguggcuacaaccauuaucacucccaugaugaggcauacaauugaaaacacgaccgccaauaucucacugacugcgauagcuaaccaagccgcaauccucaugggccuggauaaagguuggccaauuucuaagauggacaucggggucccucuuuuagcccugggcugcuacagucaggugaauccgcucacauugaccgcugcaguccugaugcuaguggcccacuaugcgauuaucggacccggccugcaggcuaaagccacccgcgaggcacaaaagcggacagccgcugggauaaugaagaacccaacuguugauggaauuguggccaucgaccucgauccuguaguguacgacgcaaaauuugaaaagcagcuuggccagaucaugcuguugauucuguguacgucgcagauccuccugaugcgaaccacaugggcuuuaugcgagagcauaacucuugccaccgguccccugacaacccucugggagggguccccaggaaaauucuggaauacuacgauugcggucucuauggccaacaucuuuagaggcucauaucuagcaggagcuggccuggccuucagcuugaugaagucccuaggggguggcaggcgcgggacaggagcacaaggcgaaacccucggugagaaauggaagcggcagcuuaaucagcugaguaagucugaguucaacacuuacaaaagaagcgggauuauggagguugaccguucagaagcuaaggagggauugaaaaggggcgagaccacaaagcacgccgugucccgggguacugccaaacugcgcugguuugucgaacgaaaucucgugaagccugagggcaagguaaucgauuuaggguguggaagaggcggguggaguuauuacugcgcgggacugaaaaaggugaccgaaguuaaaggcuauacaaagggugggcccggacaugaggaaccgauaccaauggcuacguacggcuggaaccuugugaaacugcacagcggcaaggacgucuucuuuaucccucccgagaaaugugauacccuacucugcgacauuggggagucuuccccaaaucccacuaucgaagagggaaggacacugcggguguugaagauggucgaaccuuggcugcgcgguaaccaguucuguauuaagauccucaauccguacaugcccucagugguugagacccuugagcaaaugcagagaaaacauggcgggaugcugguaaggaacccauuaagccgaaauucgacucacgaaauguauugggugucuugcggaacaggcaacauugucagugcagugaauaugaccucccggaugcuguugaaccguuuuacgauggcccacagaaagccuaccuacgagcgcgauguugaccucgguacagggacuaggcauguggcugucgaacccgagguggccaaccuggauaucauaggacagcggauugaaaauaucaaacacgagcauaagagcaccuggcacuaugacgaggauaacccuuacaaaacaugggcauaucauggcucauacgaaguaaagccauccggcucugccagcaguauggugaaugggguugucaagcuacuuacuaaacccugggacgugaucccuauggugacccagauugcuaugacagauaccacuccauucggacaacagagagucuuuaaggagaaaguugacacgcgcacacccaaggcgaaaagggguaccgcccagauaauggaagugacugcacgauggcuguggggcuuccucucccggaacaagaagccgagaaucuguaccagggaggaauuuacacgcaaaguacguagcaaugcugccauuggggcaguguucgucgacgagaaccaauggaacucugccaaggaggcuguggaagaugagcgguuuugggaccugguucacagagaaagggaguugcacaaacagggaaagugcgccacgugcguguauaacaugaugggcaaacgcgaaaagaagcugggugaguucgggaaagcgaagggaucacgagcaaucugguacauguggcucggcgcccgguuucuugaguucgaagcucugggcuucaugaaugaggaucauugguuuaguagagaaaacuccuuaagcggggucgagggagagggucugcacaaauugggcuacauucucagggacaucucuaagauaccugggggaaauauguaugccgaugacaccgcaggcugggauacucgcaucacagaagacgaucugcagaacgaggcuaaaauuaccgacaucauggaaccagagcaugcccuacuugcuaaggccauuuucaaacugacuuaccagaauaaggugguaagaguucaacggcccgcaaagaacgguacagugauggaugucaucucgaggcgugaccagcgagggucaggacaggugggcaccuauggccucaauacauuuacuaacauggaagcgcagcugauacgccaaauggagagcgaggggauuuucuccccuagugaauuggagaccccaaacuuagccgaaagagcucuggauuggcucgagaaauacggaguggaacggcuuaagaggauggccaucucuggugacgacugugucguuaaacccaucgaugaccgcuuugcaacggcucugaccgcccuaaaugauaugggcaaggugagaaaagacauuccgcagugggagccuagcaagggguggaacgauuggcagcagguacccuucugcucccaccacuuucaucaacugauaaugaaggacggacgggagaucguggucccauguaggaaucaggaugaacucgugggccgagcacguguuucacagggugccggguggaguuugagagagacagcgugccugggaaaaucuuaugcucagauguggcaacuuauguacuuccaccgccgggaccugaggcucgccgcaaacgccauuuguagcgcugugccugucgauugggugcccacuuccagaaccacauggucaauccaugcccaccaucaguggaugacuaccgaagacauguuaagcguauggaaucgcguuuggauugaggaaaacccauggauggaggauaagacgcacaucucuuccugggaggacgugcccuaucugggcaaacgggaagaccaguggugcggcaguuugauagggcugacagcaagggcuaccugggccacuaauauccaagucgcgauuaaccaggugcgaagacucaucggaaaugagaacuaccuugauuacaugacaagcaugaagcgguuuaaaaaugaaucggacccugagggugcucugugguga

SEQ ID NO: 13777 - RNA, 9879 nt, Artificial Sequence
  derived and/or modified CDS sequence (opt3) from DENV-1__GQ199801__SS-prME
agcgugaccaugcugcucaugcuuaugcccacagcacuggcuuuccacuugacuacgagaggcggggaaccucauaugaucgucuccaagcaggaaagggggaaaucuuuacuguuuaagaccucagccgguguuaauaugugcacacuaauugccauggaccucggcgaacugugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaggcuggaggggaaaauugugcaguacgaaaacuuaaaguauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccacggacuggacuggacuucaacgaaauggucuugcuaacaaugaaagagaaguccuggcuggugcauaaacagugguuucucgaucugccgcuucccuggacgucaggcgcaagcaccagucaagagacuuggaaucgucaggaccuguugguaacauucaagaccgcucacgccaaaaagcaggaaguugugguccucgguucucaagagggggcuaugcacacagcccugacuggcgcaaccgaaauccagacguccggaaccacaacuauuuuugccggccauuuaaagugccgccugaaaauggauaagcuaacccucaaagggaugagcuaugugauguguacaggaucguucaagcuggagaaagaagucgcugagacucagcacgguaccgugcuuguucagauaaaguacgagggcacggacgcgccuugcaagaucccauucucuacacaagaugaaaaaggggugacccagaacggaagauugauuacugcaaaucccaucguaacagacaaggagaaaccugucaacauagaagccgagccacccuuuggcgaguccuauauugugaucggugcuggggaaaaggcccugaaacucucaugguucaagaagggcaguagcaucggaaaaauguuugaggcaaccgccaggggcgcucggcgaauggccauucugggggauacugcaugggacuucggauccaucgguggcguuuuuaccucuguggggaaacuuguccaucagauuuucggaacagcguacggcgugcuguuuagcgguguaucauggacgaugaaaauagggaucggcguguugcucaccuggcugggauuaaauagucgcuccacuagccugucuaugacauguauugcuguuggccuagucacccucuaccugggggugauggugcaggccgauucaggaugcgucaucaacuggaagggcagagaacuuaaaugugguagugggaucuucguuacaaaugaggugcacacuuggaccgaacaauauaaguuucaggcagacagcccgaagagguuguccgccgcuauuggaaaagccugggaggagggcgugugcgguauacggucugcaacgcgccuggaaaacaucauguggaagcagauuucgaacgagcucaaucauauccuguuagaaaacgacaugaaauucacaguagucgugggcgauguugcugggauucuggcccagggaaagaaaaugaucagaccucaacccauggaguacaaguauagcuggaaauccuggggcaaggcgaagauaaucggggccgacgugcagaauaccacuuuuauuaucgauggaccaaacaccccugaaugucccgacgaucagagggcuuggaauauuugggaggucgaggacuacggcuucgguaucuuuacaacuaacauauggcuuaaauugcgugauucauauacccaggugugcgaccaccggcucaugagugcagccauuaaggauucuaaagcuguucacgccgacaugggguacuggaucgaaagcgagaagaaugaaacauggaaacuggcacgagcguccuucauugaggugaagacguguaucuggccaaagucacauacccuauggagcaacggaguacuggaaucugagaugauaauccccaaaauuuauggcgguccuaucucccaacacaauuacagaccaggcuacuucacucagacagccgggccguggcaucucggaaagcuggagcuugauuuuaacuugugcgaaggcaccacugucgugguggacgagcacugcgggaauaggggacccagucugcgcacaaccacggucacuggcaaaauuauccacgaaugguguugccggagcuguaccuuaccuccacucagauucaagggugaggaugggugcugguauggaauggagauaaggcccguuaaagaaaaggaggaaaaccuggugaagucuaugguauccgcuggcucaggugagguggacaguuuuagccuuggccuguuguguauuucgaucaugaucgaagaggucaugcgcucccgauggucuaaaaagaugcucaugacagggacccuggccguguucuuucuacugauuaugggacagcucacuuggaaugaccugauccggcuuugcauuaugguuggcgcaaacgcuagcgaucguauggggaugggaacaaccuacuuggcccugauggcaacauucaaaaugagaccuauguuagccgugggccuccuguuuaggcgccuuacuucacgggagguccugcuacucaccauaggucugaguuugguggcuuccguugaacugccaaauucuuuagaggaacucggggacggacuggcgaugggcaucaugauucuuaagcuguugacggauuuccaaagccaucagcucugggccacacugcuaucccugaccuuuaucaaaacuaccuauucacuucacuacgcauggaagacaauggcuauggugcucagcauugucagucuguuccccuugugucugucuacuaccucccagaagacgacaugguuaccgguacuccugggcagccuugggugcaaaccucugaccauguuuuugaucgccgagaacaagauauggggaagaaaaucguggccacucaacgaagguaucauggccgugggcauuguuucaauccugcuaucuagucugcuuaagaaugacgugccccucgcugggccucugauugcaggaggcauguugaucgccuguuaugucauauccgguagcucugcggauuuaagccuggagaaagcugccgagguguccugggaagaggaagcagagcauucaggggccagucacaacauucucguagaagugcaggacgauggaacuaugaagaucaaagacgaggagagggaugacacacugaccauccuucugaaggcuacuuugcuagcagucagcggcguuuacccccugucuauuccagccacacucuucgugugguauuuuuggcaaaagaaaaagcagcgauccggcgugcugugggauaccccuucacccccagaagucgagcgcgcggugcuugacgaugggauauaccggaucaugcagagaggauuacuggguaggagucagguuggcguagggguguuccaagaaaaugucuuccauacgauguggcacgugacucguggagcuguucucauguaccagggcaaacgcuuggagccgagcugggccuccgugaagaaagaccugauuucuuauggugggggauggcggcuccagggcucguggaacaccggcgaggaaguccaggugaucgcaguagagccugggaagaaucccaagaacguccaaacagccccaggaaccuuuaaaacaagcgaaggugaggugggcgcuauugcccuggacuucaagcccgggacuucaggauccccuaucguuaauagagaaggcaaaauagugggucuuuacgggaacggagucgugaccacgaguggcacauauguuucugcaaucgcucaggccaaggcgagccaggagggcccacugcccgagauugaaaaugagguguuuaggaaacgaaacuugacuaucauggaucuacacccuggguccggaaagacccggcgcuaccugccggccauugucagagaagcaaucaagaggaaacuccggacauuaauacuggcuccaacccgagugguagccucagagauggcugaagcacuuaaggguauucccaucagauaucaaacuaccgccgugaaaucugagcauacaggcaaggagaucguugaccugaugugccacgccacguucacuaugcgccucuugagcccugucagggugccaaauuacaacaugauuaucauggaugaagcucauuuuaccgaccccaguuccauagcggcacguggguauauuagcacacgggugggaaugggcgaggccgcugccaucuucaugaccgcaacuccuccggguucugucgaagccuuuccccagucaaaugcuguaauucaggaugaggaaagagacaucccagagagguccuggaacaguggguacgaguggauaacagauuucccuggaaaaaccgugugguuuguucccagcauuaagucgggcaaugacaucgcgaacugucugcgcaagaacggcaaacgagugauccagcucucuagaaagacguucgauacugaauaccagaagacaaagaauaacgacugggauuaugucgugaccaccgacauuuccgagaugggggccaauuuucgggcagacaggguuaucgauccacgccguugccugaaaccugugauucuuaaggacggacccgaaagagucauacuagcugguccaaugccggugacuguagccagcgcagcccagcggaggggccgcaucgggcgaaaccacaauaaggagggagaucaguacauuuauaugggccagccucugaacaaugacgaggaucaugcucacuggacagaagccaaaauguuguuagacaacaucaauacccccgaggguaucauuccagcgcuguucgaacccgagagagaaaagucagcagccauagauggggaguaccggcucaggggcgaggcucgcaaaacauucguggaacugaugagaaggggagaccuuccuguuuggcugaguuauaaggucgccucugagggcuuucaauacuccgaucggcguuggugcuucgacggggaacgcaacaaucaggugcucgaggaaaacauggauguggagaucuggacuaaagagggagaacgaaagaaauugagaccaagguggcuggacgcucggacguauagcgauccccuagcacugcgcgaguuuaaggaguucgccgcugguagaaggucagucaguggcgaccucauucuugagaucgggaagcugccucagcacuuaacccagcgggcccaaaaugcauuggacaaccugguuaugcuccauaauagcgaacagggaggccgagcguacagacacgccauggaggagcugccggauacaauugaaacucuuaugcugcucgcuuugaucgccgugcugaccggugggguaacauuauuuuuccuauccggccgcggacugggcaaaaccucuauagggcuccuuugugugauggcaagcuccguccuguuguggauggcuucaguggagccacauuggaucgccgcaucuauuauccuggaauuuuuccucaugguucugcuuauucccgagccugacaggcagcggacuccccaggauaaccaacucgccuacguggucaucggacuguuguuuaugauacugacgguagcugcgaacgagauggguuuacuagaaaccacaaagaaagaccugggcauugggcacguggccguugagaaucaccaucacgcagcuaugcucgauguggaccuucauccagccagugccuggacucuguaugcagucgcuaccacaaucauuaccccuaugaugcgucacacuaucgaaaacacaacggccaauauaucguugaccgcgaucgcuaaccaggccgcaauucugaugggacucgauaagggcuggcccaucagcaaaauggacauuggugugccacugcuugccuuagggugcuacucccaggucaauccucugacucucacagcugcaguguugaugcugguugcccauuaugcgaucauaggcccgggacuacaagcuaaggccaccagagaggcacagaagaggaccgccgcuggcauuaugaaaaaccccacaguggaugggaucguagccaucgaccuggauccaguggucuacgacgcaaaguucgaaaaacagcucggacagauuaugcuucugaucuuguguacuucucaaauacugcucaugcgcacgaccugggcucugugcgagucaauuacauuagccacuggcccucuuaccacacugugggaggguagccccgggaaguuuuggaauaccacuaucgcgguuuccauggccaacauuuuccggggaaguuaucucgcaggcgcuggucuagccuuuucucugaugaagucauugggcgggggacgaagaggcacgggggcacagggagaaacacugggcgagaaguggaagaggcagcucaaucagcuuagcaaauccgaguucaacaccuacaagcgcagugguaucauggagguggaucggagcgaagcuaaagaggggcugaagagaggagagacuaccaaacacgccgucucucguggcacagccaaguugaggugguucguggaacggaaucugguaaagccagaggguaaagugauagaccucggcugugggcgcggaggcugguccuauuacugcgcgggguuaaagaaaguuacugaagugaagggauacaccaaaggcgguccugggcacgaggaacccaucccgauggcuacauauggauggaaccuggucaaacuucauucaggcaaagacguguuuuucauuccaccugagaagugugauacgcugcuaugcgacaucggcgagagcucgcccaauccaaccauugaagaggggcgaacucucagaguccugaagaugguggaacccugguugaggggaaaccaauuuuguaucaaaauucugaauccuuacaugccgucuguuguagagacacucgagcagaugcagcggaagcacgguggcaugcuugugcgcaacccccugaguagaaauuccacccaugaaauguauugggucagcugcgggacuggaaacaucgugucagcaguuaacaugacauccaggauguuacugaaucgauucaccauggcccaccggaaaccaacguacgagcgugauguggacuugggcgcugguaccagacacgucgccguggaaccugagguagcaaaccucgauauaauugggcagcgcaucgaaaauaucaagcaugagcacaaaucuacauggcauuaugacgaggauaaccccuacaagacuugggccuaucacggaagcuacgaagugaagccuaguggcuccgcuagcucuaugguuaauggcgucgugaaacugcuaaccaagccaugggacgugauucccauggucacacaaauagcgaugacugauaccacaccuuuugggcagcagaggguuuucaaagagaagguggacacccggacuccaaaagccaagagaggaacggcacaaaucauggaaguaacagcuaaguggcuuugggguuuucugucacgcaacaaaaagcccaggauuuguacccgagaggaguucacucggaaagugagaaguaaugccgcaaucggcgccgucuuuguggaugagaaccaguggaacuccgcuaaggaggccguugaagacgagagguucugggaccucgugcaucgcgaacgugagcugcacaaacaggggaagugcgcgaccugcgucuacaacaugaugggaaagcgggagaagaaguugggcgaguuugguaaagcaaaggggagcagagccauuugguauauguggcugggagcuagguuccucgaguuugaagcccuuggcuucaugaaugaggaucacugguucucucgcgaaaacucgcugucaggcguggagggggagggauuacauaaacuggguuacaucuugcgagacauaagcaagaucccgggcgggaauauguaugcagaugacacagcuggaugggauacgcggauuaccgaagacgaucuccagaacgaggccaaaaucacugacauuauggaaccugagcacgcucugcuagccaaguccaucuuuaaacuuacauaccaaaauaaaguaguuagagugcagaggccagcaaagaacggcaccgucauggaugugauaagucgcagagaccagcgggguucuggacaggugggaacuuauggccugaacacauucaccaauauggaagcgcaacucauuaggcagauggagagcgagggcaucuuuucccccucagaacuggagacaccuaacuuggccgggcgugucuuagauuggcuggaaaaacauggaguugagcgacucaagcgcauggcuaucaguggugacgauugugugguaaaaccaauugacgacagauucgccacugcacuuaccgcucugaaugauaugggcaaggugcggaaggacauaccccagugggaaccgucuaaaggguggaacgauuggcagcaagucccuuuuugcagccaccacuuccaucagcuaaucaugaaggacggaagggagauugugguucccugucgcaaucaggaugagcuggugggcagagcccgggucucccagggugcaggguggucacucagggaaacggccugcuugggaaaaagcuacgcgcaaauguggcagcugauguauuuucaccgacgugaccuuagacuggcugccaacgcaaucuguucugccgugccaguagauuggguuccuaccucccgcacaacuuggaguauucaugcucaccaucaguggaugaccacagaggacaugcucagcguguggaaucgggucuggaucgaagagaaccccuggauggaagauaagacucacauaucguccuggggcgacgugccauacuuaggcaaaagggaggaucaauggugcgggucucugaucggauugaccgccagagcaacgugggcuacaaauauucagguugccaucaaccaggugcgccggcugauugguaaugagaacuaccucgacuauaugaccucaaugaagagguucaagaaugaaagcgaccccgagggcgcgcuuugguga

SEQ ID NO: 13778 - RNA, 9879 nt, Artificial Sequence
  derived and/or modified CDS sequence (opt3) from DENV-1__GQ199802__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucaaaggugaggacgggugcugguauggaauggagauaagacccguuaaggaaaaggaggaaaaucuggugaaaagcaugguaucugcuggcuccggugagguggacucauuuagucuuggccuguuguguauuagcaucaugaucgaagaggucaugaggucgcgcuggucccgacggaugcucaugaccgggacucuggccguguucuuucuacugauuaugggacagcucacauggaacgaucugauccgucuuugcauuaugguuggcgcaaaugcuucugacagaauggggaugggaaccacauacuuggcccugauggcaacuuucaagaugaggccuauguuugccgugggcuuacucuuccgccggcugaccagcagagagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaagaccacauuuucccugcacuaugcauggaaaacuauggcuauggugcuuucaauugucagccucuucccccuguguuugaguaccacgucucagaagacaaccuggcugccgguauuacucggcucccuggggugcaagccucuuacuauguuucugaucgccgagaauaaaauauggggaaggcgaagcuggccauugaacgaagguaucauggccgugggcauuguuucgauccuccugucaucucuacugaagaacgaugugccccuugcugggccucucauugcaggaggcaugcugaucgccuguuacgucauaagugguuccagcgcggacuugucuuuagagaaagcugccgaggugagcugggaagaggaagcagagcauuccggggccucacacaauauucugguagaagugcaggaugacggaacaaugaagaucaaagaugaggagcgcgacgauacccucacuauccugcuuaaggcuacacuguuggcagucaguggcguuuauccccuaagcauuccagccacccuguucgugugguacuucuggcagaaaaagaagcagcggucuggcgugcucugggacacgccuucacccccagaagucgagagagcggugcuggaugacgggauauauaggaucaugcagcguggacuuuuaggucgcagccagguuggcguagggguguuucaagaaaacgucuuccauacuauguggcacgugacccggggagcuguucugauguaccagggcaaaagacucgagccgaguugggccagcgugaagaaagacuugauuuccuacggugggggauggaggcugcagggcucuuggaauacaggcgaggaaguccaggugaucgcaguagagccugggaagaaccccaaaaauguccaaaccgccccaggaacauuuaagacucccgaaggugaggugggcgcuauugcccucgauuucaagccugggaccucgggaagcccaaucguuaaccgagaaggcaaaauagugggucuguaugggaauggagucgugacgacaucaggcacuuacguuuccgcaaucgcucaggccaaggcgagucaggagggcccccuuccugagauugaagacgagguguuucggaaacgcaaccugaccaucauggauuugcacccggggucuggaaagacaagaagguaucuaccagccauuguccgggaagcaaucaaacgaaagcugagaacccucauauuagcucccacucgcgugguagccagcgagauggcugaagcacugaaggguaugccuauuagguaccaaaccacagccgugaaauccgagcauacgggcaaggagaucguugaccuuaugugccacgccacuuucaccaugcgucugcucucaccaguccgggugcccaauuauaacaugaucauuauggaugaagcucauuuuacagacccuucuagcaucgcggcaagaggguacauaaguaccagggugggaaugggcgaggccgcugccauuuucaugacugcaacaccgcccgguuccgucgaagccuuuccacagagcaaugcuguaauccaggaugaggaacgcgacauuccugagcgaucuuggaacucaggguaugaguggaucaccgauuuccccggaaaaacggugugguuuguuccauccauaaagaguggcaaugacauugcgaacuguuugaggaaaaauggcaagcgggugauccagcugagcaggaagacuuucgauacagaauaccagaaaaccaagaacaacgacugggacuacgucgugaccacugauaucucggagaugggggccaauuuccgcgcagaccguguuauugauccuagacggugccucaaacccgugauccugaaggacggaccagaaagggucauucuugcugguccgaugccugugacaguagccucugcagcccagcgccgaggcagaauagggcggaaccacaauaaagagggagaucaguauaucuacaugggccagccccuaaacaaugacgaggaucaugcucacuggaccgaagccaagaugcuguuggacaacauuaauacaccagaggguaucauccccgcguuauuugaaccugagagggaaaaguccgcagccauugauggggaguaucgccugagaggcgaggcuaggaaaacuuucguggaacucaugcggcguggagaccugccaguuuggcuuagcuacaaggucgccucagagggcuuucaauauagugaucgccgauggugcuucgacggggaaagaaacaaucaggugcuggaggaaaacauggauguggagauauggacgaaagagggagaaaggaagaaacuccggccccgcugguuggacgcuagaaccuacucugacccucuggcacuaagggaguuuaaggaguucgccgcuggucggcgauccgucagcggcgaucugauccucgagauugggaaacuuccgcagcaccugacacagagagcccaaaaugcauuagacaacuugguuaugcugcauaauucagaacagggaggccgcgcguauaggcacgccauggaggagcucccagauacuaucgaaacccugaugcuucuggcucucauugccguguugacaggugggguaacccuguuuuucuuaaguggccggggacuaggcaagacuagcaucgggcugcucugugugauggcauccucuguccuucuguggauggcuagcguggagccccauuggauagccgcauccaucauuuuggaauuuuuccugaugguucuccugaucccugagcccgaccgucagagaacgccacaggauaaccaacuugccuacguggucauuggacuccuguuuaugaucuugaccguagcugcgaaugagaugggucuguuagaaacaacuaagaaagaccuaggcauagggcacguggccguugagaaccaccaucacgcagcuaugcuggauguggaccuccauccugccucagccuggacccuuuacgcagucgcuacaaccauuaucacucccaugaugaggcacacaauugaaaacacgaccgccaauaucucucugacugcgauagcuaaccaggccgcaaucuugaugggacuggauaagggcuggccaauuaguaaaauggacaucggugugccucuccuggcccuugggugcuauucgcaggucaauccguuaacacugaccgcugcagugcucauguugguugcccauuacgcgauuaucggccccggacugcaagcuaaggccacccgcgaggcacagaaacggacagccgcuggcauaaugaagaacccaacuguggaugggauuguagccaucgaccuagauccuguggucuaugacgcaaaguucgaaaaacagcugggacagaucaugcuccuuauucuguguacgagccaaaucuugcugaugcgaaccacaugggcucucugcgaguccauaacucuggccaccggccccuuaacaacccuuugggaggguucuccagggaaguuuuggaauacuacgauugcgguuucaauggccaacaucuucagaggaagcuaccuggcaggcgcuggucucgccuucucccuaaugaaaagucugggcgggggaaggcgcggcacaggggcacagggagaaaccuugggcgagaaguggaaacggcagcugaaucagcucucuaagagcgaauuuaacacuuauaagagaucagguauuauggagguggaccguuccgaagcuaaagaggggcuuaagaggggagagaccacaaaacacgccgucagucggggcacugccaagcugcgcugguucguggaacgaaauuugguaaaaccugaggguaaggugaucgaucugggcugugggagaggaggcuggagcuacuauugcgcggggcucaagaaaguuaccgaagugaagggauacacaaaaggcggucccgggcacgaggaaccgauaccaauggcuacguacggauggaacuuagucaagcugcauucuggcaaagacguguuuuucaucccucccgagaagugugauacccuucugugcgacauuggcgaguccucaccaaaucccacuaucgaagaggggaggacacuacggguccucaaaaugguggaaccuuggcugcgcggaaaccaauuuuguauuaagaucuugaauccguauaugcccagcguuguagagacccuggagcagaugcagagaaagcacgguggcaugcucgugaggaacccacuuucgcgaaauucuacucaugaaauguacugggucaguugcgggacaggaaacauuguguccgcaguuaauaugaccagccggaugcuguuaaaccguuucacgauggcccacagaaaaccuaccuaugagcgcgauguggaccugggcgcugguacaaggcacgucgccguggaacccgagguagcaaacuuggauaucauagggcagcggauugaaaauaucaagcaugagcacaaaucaacuuggcauuacgacgaggauaacccuuauaagaccugggccuaccacggauccuaugaagugaaaccaucuggcagcgcuaguuccaugguuaauggcgucgugaagcuccugacaaagcccugggacgugaucccuauggucacucaaauugcgaugaccgauacaaccccauuugggcagcagagaguuuucaaagagaagguggacacucgcacgcccaaagccaagaggggaacagcacaaauaauggaaguaaccgcuaaauggcuauggguguuucuuagccgaaacaagaagccgcggaucuguacuagagaggaguucaccaggaaaguccgcucuaaugccgcaauuggugccguguuuguugacgagaaccaguggaacucagcuaaggaggccguggaagaugagcguuucugggaccugguccaucgggaaagagagcuccacaaacagggcaagugcgcgacaugcguguacaacaugauggggaaaagggaaaagaagcugggagaguuuggcaaagcaaaggguagucgcgccaucugguacaugugguugggggcucgauuccuggaguucgaagcccucggauuuaugaaugaggaucacugguucucccgggaaaacagccuuucuggcguagagggcgaggggcugcauaaauuaggauauauucugagagacaucucgaagauaccugguggcaauauguacgcagaugacacggcugggugggauaccaggaucacugaagacgauuugcagaacgaggcccgcauuacagacaucauggaaccagagcacgcucuccuggccaaaucaauuuuuaagcuaaccuaucaaaauaaaguugugagaguccagcggcccgcaaagaacggaacugugauggaugugaucagcaggcgugaccagcgaggcuccggucaggucgggacauacggacuuaauaccuucacaaacauggaagcgcaacugauacgccagauggagagugagggcauauuuucuccuagcgaacucgagacuccaaaccuggccgaaagaguuuuggauugguuagagaaguauggcguggaacggcugaaaaggauggcuaucuccggggacgacuguguagugaagcccaucgaugaccgcuucgccaccgcacucacggcucuuaaugauaugggaaaagucagaaaggacauuccgcagugggagccuucaaaagguuggaacgauuggcagcaagugcccuuuugcagucaucacuuccaccagcugauaaugaaggacggccgggagaucguugugccauguaggaaucaggaugagcuagucgggcgagcccgugugucucagggagcaggcuggagccugagagagaccgccugccucgguaaguccuacgcgcaaauguggcaguugauguauuuucaucgccgggaccugaggcuugcugccaacgcaauuuguucagccguaccuguugauuggauccccacaagcagaacuaccuggucuauucacgcucaucaccaguggaugacaacugaagacaugcuguccguguggaaucgcgucuggaucgaggaaaacccauggauggaggauaaaacccauauaaguagcuggggagacgugcccuaccucggaaagcgggaggaccaauggugcggcucguuaaucggccugacggccagggcaacaugggcuaccaauauucagguugccaucaaccaggugcgaagauugauugggaaugaaaacuaccuggauuauaugacuuccaugaaacgguucaagaaugagucugacccugaaggagcgcucugguga

SEQ ID NO: 13779 - RNA, 9879 nt, Artificial Sequence
  derived and/or modified CDS sequence (opt3) from DENV-1__JF937597__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggaucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggccauggugcaggcagauucuggaugcgugaucaacuggaaaggccgcgaacuuaagugugguucagggaucuucgucacuaaugagguucacaccuggacggaacaauauaaguuucaggccgacaguccgaaaagauugagcgcugccauuggaaaggcaugggaggagggcgugugcgguauaagguccgcuacacggcuggaaaacaucauguggaaacagauuucuaacgagcucaaucauauccuguuagaaaacgacaugaagcugaccgugguagucggcgauguggccgggauucuuggacagggcaaaaagaugauccgcccucaacccauggaguacaaauauucguggaaaagcugggggaaggcgaaaauaaucggagccgacgcucagaauacuaccuucauuaucgauggcccaaacacaccugaaugucccgacgaucagagagcauggaauauuugggagguugaggacuacgguuuugggaucuucacuaccaacauaugguugaagcucagggauuccuauacacaggugugcgaccaccgucugaugucagccgcuauuaaagauaguaaggccguccacgcagacaugggauacuggaucgaaucugagaaaaaugaaacguggaagcuagcgcgggccagcuuuauugaggugaagaccuguaucuggccaaaaucccauacucuguggucaaacggcguucucgaaagcgagaugauaauccccaagauuuaugguggcccuaucucucaacacaauuaccgaccaggguacuucacacagaccgcuggaccguggcaucugggcaaacuugaguuggauuucgaccugugcgaagggacuacagugguagucgaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgugaaagaaaaggaggaaaaucuugucaagagcaugguuucugccgguuccggcgagguggacucauucagucugggguugcucuguauuagcaucaugaucgaagagguaaugcgcucgcgauggucccggaaaaugcugaugaccggaacucuagcaguguuuuuccugcucauuaugggccagcugacauggaacgaucuuauccguuugugcauuauggucggggcuaaugccucugacagaaugggaaugggcaccacauaccuggcauuaauggccacuuuuaagaugaggccuauguucgcugugggucuccuguuucgccggcuuaccagcagagagguucugcuacucacgauagggcugucauugguggcgagugucgaacugccaaacuccuuagaggaacucggagauggccuggccaugggcaucaugauucuuaaacuguugacagacuuccaaucucaucagcucugggcaacccugcuaagccugacuuuuaucaagaccacauucucccuucacuaugcuuggaaaacuauggccauggugcucucaauuguuagccuguuucccuugugucugaguaccacgucucagaagacaaccugguuaccggugcuccuggggucccuuggaugcaagccucugacuauguucuugaucgccgagaauaaaauaugggguaggaaguccuggccacucaacgaaggcaucauggcugucgggauuguaucgauccugcuaucaucucugcuuaaaaacgaugugccccucgcaggaccucugauugccggcgguauguugaucgcguguuacguuauaaguggguccagcgcugacuuaucucuggagaaggccgcagaggugagcugggaagaggaagccgagcauuccggagcuucacacaauauucucgucgaagugcaggaugacggcacaaugaaaaucaaggaugaggagcgagacgauacccugacuauccuucugaaagcaacauugcuagccguaaguggcguguauccccugagcauuccagcgacccucuuugucugguacuucuggcaaaagaagaaacagcgcucugggguucugugggacacgccuucacccccagaaguggagcgggcugugcuugaugacggaauauauagaaucaugcagagggguuuacugggccguagccaggucggggugggaguuuuccaagaaaacguauuucauacuauguggcacgugacccgcggcgccguccucauguaccaggguaagcgguuggagccgaguugggcaagcgugaaaaaggaccugauuuccuacgggggaggcuggagacucaggggcucuuggaauacaggggaggaaguucaggugaucgccgucgagccuggcaaaaaucccaagaaugugcagaccgcuccagguacauucaagacucccgaaggcgagguaggggccauugcacuggauuuuaaaccuggaaccucgggcagcccaaucgucaaccgagaagguaagauaguggggcuuuauggaaauggcguugugacgacaucaggcacuuacgucuccgcuaucgcccaagcgaaagccagucaggaggggccccugccugagauugaagacgagguguuccggaagcgcaacuugaccaucauggaucuacacccgggaucugguaaaacaagaagguaucugccagcaauuguucgggaagcuaucaagcgaaagcucagaaccuuaauacuggcccccacucgcguggucgcuagcgagauggcagaagcccuuaaaggcaugccuauuagguaccagaccacagccgugaaguccgagcauacggggaaagagaucguagaccugaugugccacgcuacuuuuaccaugcgucucuugucaccagugcggguucccaauuauaacaugaucauuauggaugaagcgcauuucacagacccuucuagcaucgcagccagaggauacauaaguaccagggucggcaugggugaggcugccgcaauuuuuaugacugccacaccgcccggguccguggaggcuuucccacaaagcaaugcggugauccaggaugaggaacgcgacauuccugagcgaucuuggaacucaggauaugaguggaucaccgauuuucccggcaagacggucugguucguaccauccauaaaaaguggcaaugacauugccaacugucugagaaagaaugggaagcgggugauccagcucagcaggaaaacuuuugauacagaauaccagaagaccaaaaacaacgacugggacuacguugugaccacugauaucucggagaugggagcaaauuuccgcgcugaccgugucauugauccuagacggugccugaagcccgugauccuuaaagacgguccagaaaggguuauucuagccggcccgaugccugugacagucgcaucugccgcucaacgccgagggagaauaggacggaaccacaauaaggagggcgaucaguauaucuacaugggucagccccugaacaaugacgaggaucaugcccacuggaccgaagcgaagauguuguuagacaacauuaauacaccagaggggaucauccccgcacuguucgaaccugagagggaaaaauccgccgcuguggauggcgaguaucgccucagaggagaggccaggaagacuuuuguagaacugaugcggcguggcgaccuuccaguguggcugagcuacaaaguugcuucagagggguuccaguauagugaucgccgauggugcuuugacggagaaagaaacaaucaaguccucgaggaaaacauggauguggagauuuggacgaaggagggugaaaggaaaaaguugcggccccgcuggcuggacgcaagaaccuacucugacccucuagcccugagggaguucaaagaauuugcugccggccggcgauccgugagcggggaucucauacuugagaucggaaagcugccgcagcacuuaacacagagagcacagaaugcguuggacaaccuggucaugcuccauaauucagaacaaggcggucgcgccuauaggcacgcuauggaggagcugccagauacuauugaaacccuuaugcugcucgccuugaucgcaguucugacagggggcgugaccuuauucuuucuaaguggacggggccuggggaagacuagcauuggacuccuuuguguaauggcuuccucugugcuguuguggauggccagcgucgagccccauuggaucgcagccuccauaauccuggaguucuuucucauggugcugcuuauuccugagcccgaccgucagagaacgccacaggauaaccagcucgcuuacguugugaucggucuguuguucaugauucugaccgucgcggccaaugagaugggcuuacuagaaacaacuaaaaaggaccuggggaucggacacguagcaguggagaaccaccaucacgcugccaugcucgauguugaccuucauccugccucagcauggacccuguacgcuguggccacaaccauaauuacucccaugaugaggcacacaaucgaaaacacgaccgcgaauauuucuuugacugcuaucgccaaccaagcagccauacugaugggccucgauaaagguuggccaaucaguaagauggacauuggggucccucugcuugcuuuaggcugcuauagccaggugaauccgcugacacucaccgcagccgucuugaugcugguggcgcauuacgcuaucauuggacccggccuacaggccaaagcaacccgcgaggcccaaaagcggacagcugccgggaucaugaagaacccaacuguugauggaauaguggcaauugaccuggauccuguaguguaugacgcuaaauuugaaaagcagcucggccagaucaugcuucugaucuuguguacgagccagauucugcucaugcgaaccacaugggcccugugcgaguccaucacuuuagcgaccgguccccuuacaacccugugggaggggucuccaggaaaauucuggaauacuacgauagccgucucaauggcaaacauuuuuagaggcagcuaccucgcuggugccggccuagcauucucccugaugaagagucuagggggaggcaggcgcgggacaggagcucaaggcgaaacccugggugagaaauggaagcggcagcucaaucagcuuucuaagagcgaguucaacacuuauaaaagaucagggaucauggagguugaccguuccgaagccaaggagggacugaaaaggggcgagaccacaaagcacgccgugagucgggguacugcgaaauugcgcugguuugucgaacgaaaucuggugaagccugagggcaagguaauugaucucggguguggaagaggcggguggagcuacuauugcgcuggacuaaagaaggugaccgaaguuaaaggcuacacaaagggugggcccggacacgaggaaccgaucccaauggcaacguacggcuggaaccuggugaaacuucauucuggcaaggacgucuucuuuauaccucccgagaaaugugauacccugcuaugcgacaucggggaguccucaccaaaucccacuauugaagagggaaggacacuccgggugcugaagauggucgaaccuugguugcgcgguaaccaguucuguaucaagauucugaauccguauaugcccagcgugguugagacccucgagcaaaugcagagaaaacacggcgggaugcuuguaaggaacccacugucgcgaaauucuacucaugaaauguacugggugaguugcggaacaggcaacaucgucuccgccgugaauaugaccagccggauguuacugaaccguuuuacgauggcucacagaaagccuaccuaugagcgcgauguugacuuggguacagggacuaggcacguggccgucgaacccgagguggcaaaccucgauauuaucggacagcggauagaaaauauuaaacaugagcacaagucaaccuggcauuacgacgaggauaacccuuauaaaacaugggccuaccacggcuccuaugaaguaaagccaucuggcagcgcuaguuccauggugaaugggguugucaagcugcuaacuaaacccugggacgugaucccuauggugacccagaucgcgaugacagauaccacuccauucggacaacagagagucuuuaaggagaaaguugacacgcgcacacccaaggccaaaagggguaccgcacagauuauggaagugacugcucgauggcuuuggggcuuccugagccggaacaagaagccgagaauauguaccagggaggaauuuacacgcaaaguacguucuaaugccgcaaucggggccguguucgucgacgagaaccaauggaacucagcuaaggaggccguggaagaugagcgguuuugggaccucguucauagagaaagggagcugcacaaacagggaaagugcgcgacgugcguguacaacaugaugggcaaacgcgaaaagaaguugggugaguucgggaaagcaaagggaagucgagccauuugguacauguggcugggcgcucgguuucucgaguucgaagcccuuggcuucaugaaugaggaucacugguuuuccagagaaaacagccugucuggggucgagggagaggguuuacauaaacugggcuauaucuugagggacauuucgaagaucccugggggaaauauguacgcagaugacaccgcuggcugggauacucgcauaacagaagacgaucuccagaacgaggccaaaaucaccgacauuauggaaccagagcacgcucugcuagccaaggcaaucuucaaacuuacuuaucagaauaaggugguaagaguucaacggcccgcgaagaacgguacagugauggaugucauuucaaggcgugaccagcgagggagcggacaggugggcaccuacggccugaauacauuuacuaacauggaagcccagcucauccgccaaauggaguccgaggggauauucaguccuucugaacuggagaccccaaacuuggcugaaagagccuuaaauuggcuggagaaauauggaguggaacggcucaagaggauggcaauuagcggugaugacugugucguuaaacccaucgacgaucgcuuugcuacggcccuuaccgcacugaacgacaugggcaaggugagaaaagauaucccgcagugggagccuuccaagggguggaaugacuggcagcagguacccuucugcucacaucacuuucaccaacuaauuaugaaggauggacgggagauaguggucccauguaggaaccaggacgaacuggugggccgagcccguguuagucagggugcgggguggucucucagagagacagcuugcuugggaaaaagcuacgcccagauguggcaacugauguauuuccaucgccgggaucuuaggcuggcagccaaugcuaucuguuccgccgugccugucgacugggugcccacuucaagaaccacauggagcauucacgcacaucaccaguggaugacuaccgaagauaugcucucuguauggaaccgcguuuggaucgaggaaaauccauggauggaggacaagacgcauauuuccaguugggaggaugugcccuacuuaggcaaacgggaagaccaguggugcggcagccugaucggguugacagcuagggccaccugggcgacuaacauacaagucgcuaucaaucaggugcgaagacugauuggaaacgagaauuaccucgacuauaugacaucgaugaagcgguuuaaaaacgaauccgauccugagggugcccuuugguga

SEQ ID NO: 13780 - RNA, 9879 nt, Artificial Sequence
  derived and/or modified CDS sequence (opt3) from DENV-1__GQ868609__SS-prME
agcgugaccaugcugcucaugcuuaugcccaccgcccuggcuuuccacuugacuacgagaggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuagguugcgugauuccuacacacagguuugcgaccaccggcucaugucagcugcaauaaaggauaguaaagccgugcaugcugacaugggguauuggauugaaucugagaagaaugaaacguggaaacuggcccgagcauccuucaucgagguaaagaccuguauuuggccaaagucccacacucuauggucaaacggaguccuggaaagcgagaugaucauacccaaaaucuacggcgguccuauuucucaacauaauuauagaccaggcuacuucacacagaccgcggggccguggcaccucggaaagcuggagcuugauuuugacuugugcgaaggcacuacagugguggucgaugagcacugcgggaacaggggacccucccugcgcaccacgacuguuaccggcaaaaucauucaugaaugguguugccggaguuguacauuaccuccacucagauucaagggugaggacgggugcugguacggaauggagaucaggcccgugaaagaaaaggaggaaaaucugguaaagagcauggugucugccggcuccggugaggucgacucauuuagucuuggccuguuguguauaagcauuaugaucgaagaggugaugcgcucgcgauggucccggaaaaugcucaugaccgggacucuggcuguuuuccuacugcucaucaugggacagcugacauggaacgaucuuauucguuugugcaucauggugggcgccaaugcaucugacagaauggggaugggaaccacauaucuggcuuuaauggccacuuuuaagaugaggccuauguucgcagucggccuccuguuucgccggcuuaccagcagagaggugcugcuacucacgauuggucugucauugguugccaguguggaacugccaaacuccuuagaggaacucggggauggacuggcuaugggcauaaugauccuuaaacuguugacagacuuccaaucucaccagcucugggcgacccugcuaagccugacuuuuauuaagaccacacuuucccuccauuacgccuggaaaacuauggcaaugguccugucaaucgucagcuuguucccccuguguuuaaguaccacgucucagaagacaaccuggcucccggugcugcuuggcucccuggggugcaagccuuugacuauguuucucauuacagagaauaaaaucuggggaagaaagagcuggccacugaacgaagguauaauggcuguuggcguggucucgauccuacugucaucucuucucaaaaacgaugugccccuggccgggccuuugauugccggaggcauguuaaucgcuuguuauguaauuagugguuccagcgcagaccugucucucgagaaggccgcggaggugagcugggaagaggaagcugagcacuccggggccucacauaauauccuggucgaaguucaggaugacggaaccaugaaaauaaaggaugaggagcgagacgauacucuuacaauucuguugaaagcaacccuacuggccgugaguggcguguacccccucagcaucccagcuacgcuguucgucugguauuuuuggcaaaagaagaaacagcgcucuggcgugcuuugggacacuccuucacccccagaaguugagcgggcaguauuagaugacgggaucuacagaauuaugcagaggggacugcucggucguagccaggugggcgucgggguguuccaagaaaacguuuuccacaccauguggcacgugacacgcggagccgucuugauguaucagggcaagcggcuggagccgaguugggcgagcgugaaaaaggaccucauauccuacggugggggauggagacugcagggcucuuggaauaccggcgaggaaguacaggucaucgcuguggagccugggaaaaaccccaagaauguucaaacagccccaggaacuuuuaagacccccgaaggugaggugggcgcaauugcccuugauuucaaaccugggacgucgggaagcccaaucgucaacagggaaggcaagauugugggucuguacgggaauggaguugugacaacuucaggcaccuaugucuccgcuaucgcccaggcaaaagcuagucaggagggccccuugccugagauagaagacgagguguuucgaaagcggaaccuaacaaucauggaucugcauccggggucuggaaaaacccgcagauaccucccagccauuguaagggaagcgaucaagcggaaguuacgaacucugauucuugcccccaccagagugguugcaagcgagauggcugaagcccugaaagguaugccuauccgcuaucaaacaacggcugucaaguccgagcacacuggcaaagagauaguggaccucaugugccaugcaaccuucacaaugagguugcugucaccagugcguguccccaauuacaacaugauuaucauggaugaagcccacuuuaccgacccuucuagcaucgccgcucggggguauauuaguacuagaguaggaaugggcgaggcggcagccaucuucaugacagcuaccccgcccgguuccguggaagccuuuccacagagcaaugcaguuauacaggaugaggaaagggacauuccugagcgcucuuggaacucaggguacgaguggaucacggauuuccccggaaagacugugugguuugucccauccauuaaaaguggcaaugacaucgccaacugucuccgaaagaauggcaagagagugauacagcugagccggaaaacauucgauaccgaauaucaaaagaccaaaaacaacgacugggacuacguugugacuacagauauuucggagaugggggcuaauuuuagggcggaccgcgucaucgauccucguagaugccuuaagcccgugauccuaaaagacggaccagaacggguaauucuggccgguccgaugccugugaccguugcaucugcugcccagaggcgcggccgaaucgggagaaaccauaauaaggagggagaucaguacauuuauaugggccagcccuugaacaaugacgaggaucacgcacacuggacagaagccaagauguuacuggacaacauaaauacuccagaggguaucauucccgcucucuucgaaccugagcgggaaaaauccgccgcgaucgauggggaguacaggcugcgcggcgaggcaagaaagacguucgucgaacuuaugaggcggggagaccugccaguguggcucagcuauaaaguggccucagagggcuuucaauacagugaucgucgcuggugcuucgacggggaacgaaacaaucaggucuuggaggaaaacauggauguugagaucuggaccaaggagggagaaaggaaaaagcugaggccccgguggcuagacgcucgcacauauucugacccucuggcccucagagaguuuaaagaguucgcugcagguaggcgguccgugagcggcgaucuuauucuggagauagggaaguuaccgcagcauuugacucagcgagcccaaaaugcucuggacaaccucguaaugcugcacaauucagaacagggaggcagagccuaccgccaugcaauggaggagcuuccagauaccaucgaaacacugaugcucuuggcgcugauugccguguuaaccgguggggucacucuauuuuuccugaguggcaggggacucggcaagacgagcaucgggcuucugugugugauggcuuccucuguuuugcuguggauggccagcguggagccccacuggauugcagcuuccaucauacucgaauuuuuccugaugguccuucucaucccugagcccgaccggcagcguaccccacaggauaaccaacuggccuauguagugauuggauugcuguuuaugaucuuaacaguugcagccaaugagaugggucuacuggaaacuaccaaaaaggaccucggcauugggcacguggcugucgagaaccaucaccaugcgacaaugcuugauguggaccugcacccugccucagcauggaccuuguacgcugucgccacuacaaucauaacgcccaugaugagacauaccauugaaaacacuacagccaauaucucucugaccgcaauugcuaaccaggccgcgauccucaugggacuggauaaaggcuggccaauaaguaagauggacaucggugugccucuuuuagcucuggggugcuacucgcagguuaauccgcucaccuugacagccgcagugcugaugcuaguagcccacuaugcuauuaucggccccggacugcaagcaaaagccacuagggaggcgcagaagcgcacggcugccggcauuaugaagaacccaaccguggaugggaucgucgcaauagaccucgauccuguuguguacgacgccaaauucgaaaagcagcuuggacagauuaugcuguugauccuguguacaagccaaauccuccugaugcggacuaccugggcuuuaugcgaguccauuacacuugccaccggcccccugacuacgcucugggaggguucuccagggaaauuuuggaauacaaccaucgcagucucaauggcuaacauauuccgaggaagcuaucuagccggcgcgggucuggccuuuuccuugaugaagagucugggcgggggaagaaggggcacuggggcacagggagaaacccucggcgagaaauggaagcgccagcuuaaucagcugucuaagagcgaguucaacauuuacaaacggucagguaucauggagguggacagauccgaagcuaaggagggguugaaacguggagagacaacuaggcacgccguaagucggggcaccgcaaagcugcgcugguucguggaacgaaaucucguuaaaccugaggguaaggugauugauuuaggcugugggagaggaggcuggagcuauuacugcgcugggcugaagaaagucacagaagugaagggauauacgaaaggcggucccgggcaugaggaaccgaucccaauggccaccuacggauggaaccuugucaagcugcacucuggcaaagacguguuuuucacuccucccgagaagugugauacacuacucugcgacauaggcgaguccucaccaaaucccaccaucgaagaggggaggacucugcggguuuugaaaaugguagaaccuuggcugcgcggaaaccaauuuuguauuaagauccucaauccguacaugcccagcguggucgagacacuugagcagaugcagagaaagcaugguggcaugcuggugaggaacccauuaucgcgaaauucuacccacgaaauguauuggguuaguugcgggacgggaaacauuguguccgccgucaauaugaccagccggaugcuguugaaccguuucacaauggcgcacagaaaaccuacuuacgagaaggauguggaccucggcgcugguacccgccauguagcaguggaacccgagguugccaaccuggauaucauugggcagaggaucgaaaauauaaaacacgagcauaagucaacauggcacuaugacgaggauaacccuuacaaaacuugggcuuaucauggauccuacgaagucaagccaucuggcagcgccaguuccauggugaauggcguggucaagcuacuuaccaaacccugggacguuauuccuauggugacacaaaucgcaaugaccgauacuacgccauuugggcagcagcggguauucaaggagaaaguggacacaagaacccccaaggccaaacgcggaacugcucaaaucauggaagucaccgcgagguggcugugggguuuucucagccgaaacaagaagccgcggauuuguacaagagaggaguucacgaggaaagugcgcucuaaugccgcaauaggcgcuguuuuuguggacgagaaccaguggaacucagccaaggaggcagucgaagaugagcguuucugggaccuggugcagaaagaacgggaguugcacaagcaggggaaaugcgcaaccugcguauauaacaugaugggaaagagagaaaagaaacugggcgaguuugguaaggcuaaagggaguagggccaucugguacauguggcucggagcgcgcuuccuugaguuugaagcacugggcuucaugaaugaggaucacugguucucccgagaaaacagcuuaucuggcguugagggggagggacugcauaaguuggguuacauucuccgggacaucucgaaaauuccuggcgggaauauguaugccgaugacacugcuggaugggauacaagaaucaccgaagacgaucugcaaaacgaggccaagauaacugacaucauggaaccagagcacgcacuacuugcuacaucaauuuuuaaacugaccuaccagaauaagguggucagggugcagcgccccgccaagaacggcacagugauggaugucaucagcagacgggaccagagggguuccgggcaaguuggaacuuauggccucaauaccuucacgaacauggaagcucagcugauucgucagauggagagugagggcaucuuuuugccuucugaauuagagaccccaaaccuggccgaacgagugcucgauuggcuugagaaauacgggguagaacgccugaagagaauggcaauaagcggagacgacuguguggucaaacccauugaugaccgguucgcgacagcccuaacugcucugaaugauauggguaaggugaggaaagacaucccgcagugggagccuuccaagggcuggaacgauuggcaacagguucccuuuugcucacaucacuuccaccagcucaucaugaaggacgggcgcgagauuguggucccauguagaaaucaggaugaauuggugggacgggccaggguaagucaaggcgcagguuggucucugcgagagaccgcuugccuugggaaaagcuaugcccagauguggcagcugauguacuuucaucguagagaccuccgcuuagcagccaacgcgauauguuccgcuguuccuguggauuggguccccacaucacggacuaccuggagcauccacgcccaucaccaauggaugacgacagaagacaugcugucuguguggaauaggguuuggauugaggaaaacccauggauggaggauaagacccauguguccaguuggggagacguccccuauuugggcaaaagagaggaccaguggugcggcagccugaucgggcucacugcacgcgccacaugggcuucgaauauucagguggccaucaaccagguacggaggcuuauaggaaaugaaaacuaccuggauuacaugaccuccaugaagcgauucaaaaaugagggugacccugaaggcgcacuaugguga

SEQ ID NO: 13781 - RNA, 9879 nt, Artificial Sequence
  derived and/or modified CDS sequence (opt3) from DENV-1__GQ199803__SS-prME
agcgugaccaugcugcucaugcuuaugcccaccgcacuggcuuuccacuugacuaucagaggaggggagccucauaugauugucuccaagcaggaaaggggaaaaucuuuacuguuuaagacgucagccgguguuaauaugugcaccuuaauagccauggaccucggagagcugugugaagauacaaugacuuacaaaugcccacggaucaccgaggcggaaccggacgauguggacuguuggugcaaugcuacagauaccuggguaacuuaugggacauguagucagaccggagagcaccgccgagacaagcguagcguggcccuugcaccccaugucggccuggguuuggagacgagaacugaaaccuggauguccucugagggggccuggaaacagauucagaggguggaaacaugggcucuccggcacccuggauucacuguuaucgcacuguuucuggcccaugcuauuggcaccucgaucacacagaagggcauaaucuucauucucuuaaugcuggugaccccaucaauggccaugcgcugcgucgggaucggaagcagagauuuuguggagggucuuaguggcgcgacguggguagacguuguguuggagcacggguccugugucacuacaauggcaaaggauaaacccacccuggacauugaauugcucaagacugaggugacaaacccugccgugcugaggaaacuuugcaucgaagcuaagauaucuaauaccacgaccgauagccgguguccaacacaaggagaggccacucuggucgaagaacaggacgcaaacuucguuugccgccgaaccuuuguggauagaggcugggguaauggguguggauuguucggcaaaggcucccucauuacaugcgcuaaguuuaagugcguaacuaaacuggaggggaagaucgugcaguacgaaaacuuaaaauauucagucauugugaccguucacacaggagaccagcaucaaguggguaaugagaguaccgaacacggcacuacggccacaaucacaccccaggcgccuacuaccgagauccagcugacagacuacggggcccucacccuugauuguagcccaaggacuggacuggacuucaacgaaauggucuugcuaacaaugaaggagaaaucuuggcuggugcauaagcagugguuucucgaucugccgcuucccuggacguccggcgcaucaaccagccaagagacuuggaaucggcaggaccuguugguaacauucaaaaccgcucacgccaagaagcaggaaguugugguccucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugugauguguacaggcagcuucaaacuggagaaggaagucgcugagacucagcacgguaccgugcuuguucagaucaaguacgagggcacggacgcgccuugcaaaauuccauucucgacacaagaugaaaagggggugacccagaacggacgcuugaucacugcaaaucccauaguaacagacaaagagaagccugucaacauugaagccgagccacccuuuggcgagucuuauaucgugaucggugcuggggaaaaagcccugaagcucuccugguucaagaaaggcucaaguauuggaaagauguuugaggcaaccgccagaggcgcuaggcggauggccauccugggggauacugcaugggacuucggaagcauugguggcguuuuuaccuccguggggaaacuuguccaucagauauucggaacagcguacggcgugcuguuuucugguguaagcuggacgaugaagaucgggauuggcguguugcucaccuggcugggauuaaauucacgaaguacuucccugagcaugacauguaucgcuguuggccuagucacccucuaccugggggugauggugcaggccgauucuggaugcgucaucaacuggaaaggccgcgaacuuaagugugguucagggauuuucguuacaaaugaggugcacacuuggaccgaacaauauaaguuucaggcagacaguccgaaaagauugagcgccgcuauaggaaaggccugggaggagggcgugugcgguaucagguccgcaacgcggcuggaaaacauuauguggaaacagaucucuaacgagcucaaucauauucuguuagaaaacgacaugaagcugacaguagucgugggcgauguugcugggauccuuggacagggcaaaaagaugauacgcccucaacccauggaguacaaauauucguggaaaagcugggggaaggccaaaaucauuggagcggacgcccagaauaccacuuucaucauugauggcccaaacaccccugaaugucccgacgaucagagagcuuggaauaucugggagguggaggacuacgguuuugggauauucacaacuaacauuugguugaagcucagggauuccuauacccaggucugcgaccaccgucugaugucagcagccaucaaagauaguaaggcugugcacgccgacaugggauacuggauugaaucugagaaaaaugaaacauggaagcuagcacgggcgagcuuuaucgagguuaagacguguauauggccaaaaucccauacccuguggucaaacggcgugcucgaaagcgagaugaucauucccaagaucuaugguggcccuauuucucaacacaauuaccgaccaggguacuucacucagacagccggaccguggcaucugggcaaacuugaguuggauuucgaccugugcgaagggaccacuguagucguggaugagcacugcggaaacagaggccccuccuuaaggacaaccacggugacugguaagaucauacacgaaugguguugccgcaguuguacccucccuccacugcgguuuagaggggaggacggaugcugguauggcauggagauuaggcccgucaaagaaaaggaggaaaaucuuguuaagagcauggugucugcugguuccggcgagguagacucauucagucugggguugcucuguaucagcaucaugauugaagaggugaugcgcucgcgauggucccggaaaaugcugaugacaggaacccuagccgucuuuuuccugcucaucaugggccagcugacuuggaacgaucuuauucguuugugcauaauggugggggcaaaugcuucugacagaaugggaaugggcacaaccuaccuggccuuaauggcaacauuuaagaugaggccuauguucgccguuggucuccuguuucgccggcuuacuagcagagaggugcugcuacucaccaucgggcugucauuggucgcuaguguggaacugccauccucuuuagaggaacucggagauggccuggcgaugggcauuaugauccuuaaacuguugacggacuuccaaagccaucagcucugggccacacugcuaucccugaccuuuauuaagacugcauucucacuucacuaugcuuggaaaaccauggccaugguucucagcaucgugagucuguuucccuugugucugucuacaacuucccagaagaccacgugguuaccgguccuccuggggagccuuggaugcaagccucugacaauguucuugauagccgagaacaaaaucugggguaggaagucguggccacucaaugaaggcauuauggcuguagggaucgugucaauucugcuaucuagucugcuuaaaaacgauguuccccucgcaggaccucugaucgccggcgguauguugauagcguguuacgugauuuccgggagcucugcugacuuaagccuggagaaggccgcagaggucuccugggaagaggaagccgagcauucaggagcuagucacaacauccucguggaaguacaggaugacggcaccaugaaaaucaaggaugaggagcgagacgauacucugacaauucuucugaaagcaaccuugcuagccgugagcggcgucuauccccugucuauaccagcgacucucuuuguuugguacuucuggcaaaagaagaaacagcgcuccggggugcugugggacacaccuucacccccagaaguggagcgggcuguccuugaugacggaaucuauagaauuaugcagagggguuuacugggccguagucagguggggguuggaguauuccaagaaaauguguuucauaccauguggcacgucacgcgcggcgccgugcucauguaccaggguaagcgguuggagccgagcugggcauccguuaaaaaggaccugaucucuuacgggggaggcuggagacucaggggcucguggaacacuggggaggaagugcaggucauugccguggagccuggcaaaaaucccaagaacguacagaccgcuccagguacauucaagacccccgaaggcgaggucggggccaucgcacuggauuuuaaaccuggaacaagcggcucaccaauagugaaucgagaagguaagaucguugggcuuuauggaaacggcguggucacuaccuccggcacguacgugagugcuauugcccaagcgaaagccucucaggaggggccccugccugagaucgaagacgagguuuuccggaagcgcaauuugacaauuauggaucuacacccgggaagcgguaaaacuagaagguaucugccagcaaucgugcgggaagcuauaaagcgaaagcucagaaccuuaauucuggcccccacacgcgucguggcuuccgagauggcagaagcccuuaaaggcaugccuaucagguaccagaccacugccguaaagucagagcauaccgggaaagagaucguggaccugaugugccacgcuacauuuacgaugcgucucuugucuccaguucggguccccaacuauaauaugauuaucauggaugaagcgcauuucacugacccuagcaguauagcagccagaggauacauuuccaccagggugggcaugggugaggcugccgcaaucuuuaugacagccaccccgcccgggagcguggaggcuuucccacaaucuaacgcggucauucaggaugaggaacgcgacaucccugagcgaucauggaacuccggauaugaguggauaacugauuuucccggcaagacaguaugguucgugccaaguauuaaaagcggcaacgacaucgccaauugucugagaaagaacgggaagcggguuauccagcucucgaggaaaaccuuugauacggaauaccagaagacuaaaaauaacgacugggacuacguggucacaaccgauauuucugagaugggagcaaacuuccgcgcugaccgugugaucgauccuagacggugccugaagcccguuauucuuaaagacgguccagaaagggugauacuagccggcccgaugccugucaccguggcauccgccgcucaacgccgagggagaaucggacggaaucacaacaaggagggcgaucaguauauuuacaugggucagccccugaauaacgacgaggaucaugcccacuggacugaagcgaagauguuguuagacaauaucaacacaccagaggggaucauucccgcacuguucgaaccugagagggagaaaagcgccgcuguagauggcgaguaucgccucagaggagaggccaggaagaccuuuguggaacugaugcggcguggcgaccuuccaguuuggcugucauacaaagucgcuagugagggguuccaguauucugaucgccgauggugcuuugacggagaaagaaauaaccaagugcucgaggaaaauauggauguggagauauggacaaaggagggugacaggaaaaaguugcggccccgcuggcuggacgcaagaacuuacuccgauccucuagcccugagggaguucaaagaguuugcugccggccggcgaagcgucucaggggaccucauccuugaaauuggaaagcugccgcagcacuuaacgcagagagcacagaacgcguuggauaaucugguuaugcuccauaacagugagcaaggcggucgcgccuauaggcacgcuauggaagaacugccagacaccaucgagacacuuaugcugcucgccuugauugcagugcugacugggggcguaaccuuauucuuucuaagcggacggggccuggggaagacauccaucggacuccuuugugugauggcuucuagcguccuguuguggauggccuccguggaaccccauuggauagcagccucaaucauucuggaguucuuucucaugguucugcuuaucccugaacccgaucgucagagaaccccacaggacaaucagcucgcuuacguggucauuggucuguuguucaugauccugacuguagcggccaacgagaugggcuuacuagagacgaccaaaaaggaucuggggauaggacacguggcaguugaaaaucaccaucacgcugccaugcucgacguggaucuucauccugccucugcauggacacuguacgcugucgccacuaccauuaucacacccaugaugaggcacaccauugagaacacuacagcgaacaucaguuugacggcuauagccaaucaagcagccauccugaugggccucgacaaagguuggccaauuucgaagauggauaucggggugccucugcuugcuuuaggcugcuauagccaggucaacccgcugacccucacugcagccguguugaugcugguugcgcauuacgcuauuaucggacccggccuacaggccaaagcaacacgcgaagcccaaaagcggaccgcugccgggauaaugaagaauccaaccguggacggaauuguagcaaucgaucuggacccuguggucuaugacgcuaaauuugagaagcagcucggccagaucaugcuucugauuuuguguacaucccagauccugcucaugcgaacuacgugggcccugugcgaaucuauaaccuuagcgacagguccccuuacuacccugugggaggggucaccaggaaaauucuggaacacaaccauugccguuagcauggcaaauaucuuuagaggcuccuaccucgcuggugccggccuagcauucagucugaugaagucucuagggggaggcaggcgcgggacuggagcucaaggcgagacgcugggugaaaaauggaagcggcagcucaaccagcuuagcaagucagaguucaauacauauaaaagauccgggauuauggaaguggaucguagugaggccaaggaaggacugaaaaggggcgagaccacuaagcacgccgucagccgggguaccgcgaaauugcgcugguuuguggagcgaaaccugguaaagccugaaggcaaggugaucgaccucggguguggaagaggcggguggucuuacuauugcgcuggacuaaagaagguuacagaggugaaaggcuacacuaagggugggcccggacacgaagaaccgauaccaauggcaaccuacggcuggaaucuggucaaacuucauuccggcaaggauguguucuuuaucccucccgaaaaaugugacacacugcuaugcgauauuggggagucaagcccaaaccccacgaucgaggaaggaaggacccuccggguccugaagaugguggagccuugguugcgcgguaaucaguucuguauuaagauccugaacccguauaugcccucgguuguagaaacucucgagcaaaugcagagaaaacacggcgggaugcuugugaggaauccacugucucgaaacaguacacaugagauguacugggucuccugcggaaccggcaauauugugagcgccguuaacaugacuucacggauguuacugaaucguuuuacaauggcucacagaaagccuaccuaugaacgcgacguggauuuggguacggggaccaggcacgucgccguggagcccgaaguagcaaaccucgacaucauaggacagcggauugagaacaucaaacaugaacacaaguccacauggcauuacgaugaggacaauccuuauaaaacuugggccuaccacggcucuuaugaggugaagccaagcggcagugcuuccagcaugguuaacggggucgugaagcugcuaaccaaacccugggaugugaucccuauggucacacagauugcgaugacugacaccacaccauucggacaacagagaguuuuuaaggaaaaaguggacacccgcacucccaaggccaaaagggguacggcacagauaauggagguaacagcucgauggcuuuggggcuuccugucucggaauaagaagccgagaaucuguaccagggaagaguuuacucgcaaagugcguucaaacgccgcaauuggggccgucuucguggaugaaaaucaauggaacagugcuaaggaggccguugaggacgaacgguuuugggaucucgugcauagagagagggaacugcacaaacagggaaagugcgcgaccugcgucuacaauaugaugggcaaacgcgagaagaaguugggugaguucgggaaagcaaagggaucccgagccaucugguacauguggcugggcgcucgguuucucgaguucgaggcccuuggcuucaugaacgaagaccacugguuuagcagagaaaauucucugucggggguggaaggagaggguuuacauaaacugggcuauauuuugagggauaucucaaagauaccugggggaaacauguacgcagacgauacagcuggcugggacacgcgcaucaccgaggaugaccuccagaaugaagccaaaauuacugauaucauggagccagaacacgcucugcuagccaaggcaauuuucaaacuuacauaucagaacaagguaguuagagugcaacggcccgcgaagaaugguaccgucauggacgugaucagcaggcgugaucagcgaggguccggacaggugggcacuuacggccugaacacauuuaccaauauggaggcccagcucauacgccaaauggaaagugaggggauuuucucuccuagcgagcuggaaacaccaaacuuggcugagagagccuuagacuggcuggaaaaauauggagucgagcggcucaagaggauggcaaucuccggugacgauuguguugugaaacccaucgacgaucgcuuugcuacugcccuuaccgcacugaacgacaugggcaagguaagaaaagauauuccgcagugggaaccuucaaagggguggaaugacuggcaacaggugcccuucugcagucaucacuuucaccaacuaauaaugaaggauggacgggagaucgucgugccauguaggaaccaggacgagcugguuggccgagcccgugugucucagggugcgggguggagccucagagaaacggcuugcuugggaaaauccuacgcccagauguggcaacugauguauuuccaucgccgggaucuuaggcuggcagccaaugcuauuuguucagccgucccuguggacuggguacccaccagcagaacaacuuggucuauccacgcacaucaccaguggaugaccacagaggauaugcucuccguuuggaaccgcguguggauugaagagaauccauggauggaagacaagacucauaucaguagcugggaggacguccccuacuuaggcaaacgggaggaucaguggugcggcucgcugauaggguugaccgcuagggccacgugggcgacaaacauccaaguggcuauuaaucagguucgaagacugaucggaaacgaaaauuaccucgacuauaugaccuccaugaagcgguuuaaaaacgagucugauccugaaggugcccuuugguga

SEQ ID NO: 13782 - RNA, 9879 nt, Artificial Sequence
  derived and/or modified CDS sequence (opt3) from DENV-1__GQ199804__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagacgccacacugguugaggaacaggaugcuaacuucgugugccgccgaacuuuuguagacagaggcugggguaauggguguggauuguucggcaaaggcucccucauaaccugcgccaaguuuaagugcgugacaaaacuggaggggaagauuguccaguacgagaacuuaaaauauucagugaucguuaccgugcacacuggagaccagcaucaagucgguaaugaaaguacggagcacggcacaaccgcaacuauuacaccccaagcuccuaccaccgaaauccagcugacugauuacggggcccucacacuugacuguagcccaaggacgggacuggauuucaacgagaugguguugcuaaccaugaaggaaaaaucuuggcugguacauaagcagugguuucucgaccugccgcuucccuggacuuccggcgcgucaacaagccaagagaccuggaaucggcaggaucuguugguuacauucaaaacugcccacgcaaagaagcaggagguggucgugcucgguagucaagaaggggcuaugcacaccgcccugacgggcgcuaccgagauccagacaucuggaacuaccacaauuuuugccggccauuuaaaaugccgucugaagauggacaaacuaacucucaaggggauguccuaugucauguguaccgggagcuucaaacuggaaaaggagguggcagaaacgcagcacgguacaguucuugugcagauaaaguacgagggcaccgaugccccuugcaaaaucccauucucgacucaagacgagaaggggguaacacagaacggacgcuugauuaccgcuaaucccaucgucacugauaaagaaaagccugugaacauagaggcggaaccacccuuuggcgagucuuauauuaucaucggugcaggggagaaagcccugaagcucuccugguucaagaaaggcucaaguauuggaaagauguuugaagcuaccgccagaggcgcaaggcggauggccauccugggggacacagcuugggauuucggaagcauugguggcguuuuuacguccguggggaaacuuguccaucagauauucggaaccgccuacggcgugcuguuuucugguguaagcuggacuaugaagaucgggauuggcguguugcucacauggcugggauuaaauucacgaaguaccucccugagcaugacauguaucgcaguuggccuagucacucucuaccugggggugauggugcaggcggacucuggaugcgucaucaacuggaaaggccgcgagcuuaagugugguucagggauuuucguuaccaaugaagugcacacguggacagagcaauauaaguuucaggcugacaguccgaaaagauugagcgccgcaauaggaaaggccugggaagagggcgugugcgguaucagguccgcuacccggcuggagaacauuauguggaaacagaucucuaacgaacucaaucauauucuguuagagaacgauaugaaguucacuguagucgugggcgacguugccgggauccuggcacagggcaaaaagaugauacgcccucaacccauggaauacaaauauucguggaaguccuggggcaaggcuaaaaucauuggggccgaugugcagaauaccacauuuaucauugacggaccaaacacuccugagugucccgaugaccagagagcguggaauaucugggaagucgaggauuacggcuucgguauauuuaccacaaacauuuggcuuaaguugagggacuccuauacgcaagugugcgaucaccgucucaugucagccgcuaucaaagacaguaaggcaguucacgccgauaugggguacuggauugagucugagaaaaaugagaccuggaagcuggcucgggccagcuucaucgaagugaagacuuguauauggccaaaaucccauacacuauggucaaacggaguacuggagagcgaaaugaucauucccaagaucuauggcgguccuauuucucaacacaauuaccgaccaggcuacuucacccagacugcagggccguggcaucucggaaaacuggagcuugacuuugauuugugcgagggcacaaccgucgugguggacgaacacugcgggaacagaggacccucccugaggacgacuaccgucacaggcaagaucauacacgagugguguugccgcaguuguaccuuaccuccacuccgguucagaggugaagacgggugcugguauggaauggagauuaggcccguuaaagagaaggaagagaaucugguaaagagcaugguaucugcgggcuccggugaaguggauucauuuagucuuggccuguuguguaucagcaucaugauugaggaagucaugcgcucgcgauggucccggaaaaugcucaugacugggacacuggccguguucuuucuacugaucaugggacagcucaccuggaacgaccugauucgucuuugcauaaugguuggcgcuaaugccucugauagaauggggaugggaacaacuuacuuggcacugauggcuaccuucaagaugaggccuauguuugccgugggcuuacucuuccgccggcugacgagcagagagguccuucugcuaacaaucggucucucacugguggcaaguguugaguugccaaacucccuggaagaguuaggggacggacucgccaugggcauuaugauccugaaacuucugaccgauuuucaaucucaucaguugugggcuacucuccugagccuaaccuucauuaagacaacuuuuucccugcacuaugcguggaaaaccauggccauggugcuuucaaucgucagccucuucccccuguguuugaguacgacaucucagaagaccacuuggcugccgguauuacucggcucccuggggugcaagccucuuacaauguuucugauagcagaaaauaaaaucuggggaaggcgaagcuggccauugaacgaggguauuauggcugugggcaucguuucgauucuccugucaucucuacugaagaacgacgugccccuugccgggccucucaucgccggaggcaugcugauagcuuguuacgucauuagugguuccagcgcagauuugucuuuagaaaaagccgcggaggugagcugggaggaagaggcugaacauuccggggccucacacaauauccugguagaggugcaggacgauggaaccaugaagaucaaagacgaagaacgcgaugacacucucacaauucugcuuaaggcaacccuguuggccgucaguggcguuuauccccuaagcauaccagcuacgcuguucgugugguacuucuggcagaaaaagaagcagcggucuggcgugcucugggauacuccuucacccccagaggucgaaagagcagugcuggacgacgggaucuauaggauuaugcagcguggacuuuuaggucgcagccagguuggcguagggguguuucaagagaacgucuuccauaccauguggcacgugacacggggagccguucugauguaccagggcaaaagacucgaaccgaguugggcgagcgugaagaaagauuugaucuccuacggugggggauggaggcugcagggcucuuggaauaccggcgaggagguccaggugauugcuguagaaccugggaagaaccccaaaaauguccaaacagccccaggaacuuuuaagacccccgagggugaagugggcgcaaucgcccucgacuucaagccugggacgucgggaagcccaauaguuaaccgagagggcaaaaucgugggucuguaugggaauggagucgugacaacuucaggcaccuacguuuccgcuauugcccaggcaaaggcuagucaggaaggcccccuuccugagaucgaggaugaaguguuucggaaacgcaaccugacaauuauggacuugcacccggggucuggaaagaccagaagguaucuaccagccaucguccgggaggcgauaaaacgaaagcugagaacucucauuuuagcccccacccgcgugguagcaagcgaaauggcugaggcccugaaggguaugccuaucagguaccaaacaacggcugugaaauccgaacauacuggcaaggagaucguugaucuuaugugccacgcaaccuucacaaugcgucugcucucaccaguccgggugcccaauuauaacaugauuaucauggacgaggcccauuuuaccgauccuucuagcauagccgcuagaggguacauuaguacuagggugggaaugggcgaagcggcagccaucuucaugacagcuaccccgcccgguuccgucgaggccuuuccacagagcaaugcaguaauucaggacgaagaacgcgauaucccugaacgaucuuggaacucaggguaugaguggauaacggacuuccccggaaaaacugugugguuuguuccauccauuaagaguggcaaugauaucgccaacuguuugaggaaaaauggcaagcgggugauccagcugagcaggaagacauucgacaccgaguaccagaaaaccaagaacaacgacugggauuacgucgugacuacagacauuucggaaaugggggcuaauuuccgcgcggaucguguuaucgacccuagacggugccucaaacccgugauucugaaggauggaccagagagggucauacuugccgguccgaugccugugaccguagcaucugcugcccagcgccgaggcagaaucgggcggaaccacaauaaagaaggagaccaguauauuuacaugggccagccccuaaacaaugaugaggaccaugcacacuggacagaggccaagaugcuguuggauaacaucaauacuccagaagguaucauucccgcuuuauuugagccugaaagggagaaguccgccgcgauagacggggaauaucgccugagaggcgaggcaaggaaaacguucguggagcucaugcggcguggagaucugccaguuuggcuuagcuacaaggucgccucagaaggcuuucaauauagugaccgccgauggugcuucgauggggagagaaacaaucaggugcuggaagagaacauggacguggaaaucuggaccaaagagggagagaggaagaaacuccggccccgcugguuggacgcuagaacauacucugauccucuggcccuaagggaauuuaaggaguucgcugcaggucggcgauccgucagcggcgaccugauucucgaaaucgggaaacuuccgcagcaccugacucagagagcccaaaaugcuuuagauaacuugguuaugcugcauaauucagagcagggaggccgcgccuauaggcacgcaauggaggaacucccagacaccauugagacacugaugcuucuggcgcucaucgccguguugaccggugggguaacucuguuuuucuuaaguggccggggacuaggcaagacgagcauagggcugcucugugugauggcuuccucuguccuucuguggauggccagcguggaaccccauuggaucgcagcuuccauuaucuuggaguuuuuccugaugguucuccugauuccugaacccgaucgucagagaaccccacaggacaaccaacuugccuacguggucaucggacuccuguuuaugauauugacaguagcagccaaugagaugggucuguuagagacuaccaagaaagaucuaggcauugggcacguggcuguugaaaaccaccaucacgcggccaugcuggacguggaucuccauccugcaucagcuuggacacuuuacgccgucgccaccacuaucauuacacccaugaugaggcacacgaucgagaacaccacugcaaauauaucucugacagcuaucgccaaccaggcggcuauuuugaugggacuggacaagggcuggccaaucaguaaaauggauauuggugugccucuccuggcccuugggugcuauucgcaggucaauccguuaacccugaccgcagccgugcucauguugguugcucauuacgcaaucauaggccccggacugcaagccaaggcgacacgcgaagcucagaaacggacugccgcaggcauuaugaagaacccaacgguggacgggaucguagccaucgaucuagacccuguggucuaugacgcuaaguucgagaaacagcugggacagauuaugcuccuuauccuguguaccagccaaauauugcugaugcgaacaacuugggcccucugcgaauccauuacccuggcaacaggccccuuaaccacucuuugggaggguucuccagggaaguuuuggaauacgacaaucgcuguuucaauggccaacauuuucagaggaagcuaccuggcgggcgccggucucgcauucucccuaaugaaaagucugggcgggggaaggcgcggcaccggggcucagggagagacuuugggcgaaaaguggaaacggcagcugaaucagcucucuaagagcgaguuuaacaccuauaagagaucagguaucauggaaguggaucguuccgaggccaaagaagggcuuaagaggggagagacaacuaaacacgcagucagucggggcaccgcuaagcugcgcugguucguggagcgaaauuugguaaaaccugaagguaaggugauagaccugggcugugggagaggaggcuggagcuacuauugcgccgggcucaagaaaguuacagaggugaagggauacacgaaaggcggucccgggcacgaggagccgaucccaauggccaccuacggauggaacuuagucaagcugcauucuggcaaagauguguuuuucauuccucccgaaaagugugacacucuucugugcgauaucggcgaguccucaccaaaucccacaauugaggaagggaggacccuacggguccucaaaaugguggagccuuggcugcgcggaaaccaauuuuguaucaagauuuugaauccguauaugcccagcguuguagaaacucuggagcagaugcagagaaagcacgguggcaugcucgugaggaacccacuuucgcgaaauucuacacaugagauguacugggucaguugcgggaccggaaacaucguguccgcgguuaauaugacgagccggaugcuguuaaaccguuucaccauggcucacagaaaaccuacauaugaacgcgacguggaucugggcgcagguacuaggcacgucgccguggagcccgaaguagcuaacuuggacauaauugggcagcggaucgagaauaucaagcaugaacacaaaucaaccuggcauuacgaugaggacaacccuuauaagacaugggccuaccacggauccuaugaggugaaaccaucuggcagcgcaaguuccaugguuaauggcgucgugaagcuccugacuaagcccugggaugugauuccuauggucacccaaauagccaugacagacaccacuccauuugggcagcagagaguuuucaaagaaaagguggacacgcgcacacccaaagcuaagaggggaaccgcgcaaaucauggagguaacugccaaauggcuaugggguuuucuuagccgaaacaagaagccgcggauuuguaccagagaagaguucacaaggaaagugcgcucuaaugcagcuaucggcgccgucuuuguggaugaaaaccaguggaacucagcaaaggaggccguugaggacgaacguuucugggaucuggugcaucgggagagagaacuccacaaacaggggaagugcgcuacgugcgucuacaacaugaugggaaaaagggagaagaagcugggcgaauuugguaaagccaaggggagucgcgcgauuugguacaugugguugggagcacgauuccuggaguucgaggcccucggcuuuaugaaugaagaccacugguucucccgggagaacagccuuucuggcguggaaggggagggacugcauaaauuagguuauauccugagagauauaucgaagaucccuggcgggaauauguacgcugacgauaccgccggaugggacacuaggauuacagaggaugacuugcagaacgaagcacgcaucaccgauauuauggagccagaacacgcucuccuggccaaaucaaucuuuaagcuaacuuaucaaaauaaaguaguuagagugcagcggcccgcuaagaacggcacagucauggacgugauaagcaggcgugaucagcgagguuccggacaggugggaaccuacggccuuaauacauucacuaacauggaggcccaacugauucgccagauggaaagugagggcaucuuuucuccuagcgagcucgaaaccccaaaccuggcagagagagucuuggacugguuagaaaaguaugggguugagcggcugaaaaggauggcgaucuccggagacgauugugugguaaagcccauugacgaucgcuucgccacggcucucaccgcccuuaaugacauggguaaagugagaaaggauauaccgcagugggaaccuucaaaaggcuggaacgacuggcagcaaguccccuuuugcagucaucacuuccaccagcugaucaugaaggaugggcgggagauugugguuccauguaggaaucaggacgagcuagugggacgagcacgugucucucagggcgcugguuggagccugagagaaacagccugccucgggaaguccuacgcacaaauguggcaguugauguauuuucaucgccgggaucugaggcuugccgcgaacgcuaucuguucagccgugccuguagacuggauucccacuagcagaaccacauggucuauccacgcacaucaccaguggaugacuaccgaggauaugcuguccguuuggaaucgcguguggauagaagagaacccauggauggaagacaaaacgcauaucaguagcuggggagacguccccuaccucggcaagcgggaggaucaauggugcggcucguuaauugggcugacagccagggcuaccugggccacuaauauccagguggcaauuaaccagguucgaagauugaucggaaaugagaacuaccuggacuauaugacauccaugaaacgguucaagaaugaaucugauccugagggugcucucugguga

SEQ ID NO: 13783 - RNA, 9879 nt, Artificial Sequence
  derived and/or modified CDS sequence (opt3) from DENV-1__GQ199805__SS-prME
agcgugaccaugcugcucaugcuuaugcccaccgcccuggcuuuccacuugacuacgaggggaggggaaccucauaugaucgucaccaagcaggaaaggggaaaauccuuacuguuuaagacaucugcugguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcuccccaugucggccuggguuuggagaccagaacagaaacuuggaugagcuccgagggggccuggaaacagauccagaggguggaaaccugggcucuccggcacccuggauucacaguuauugcacuguuucuggcccaugugaucggcaccucuauuacgcagaagggcaucauuuucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuacaccccaggccccuacaagugagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacugguagcuucaaacuggagaaggaagucgccgagacccagcacggaacggugcuuguucagauaaaguacgagggcacagacgcuccuugcaaaaucccauucucgacccaagaugaaaagggggugacucagaacggacgcuugauuacagcgaaucccaucguaaccgacaaagagaagccugucaacauagaagcagagccacccuuuggcgagucuuauauugugaucggugccggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauaggguugggcgugcuccugacuugguuaggacuaaauucacgaaguacaucccuaagcaugaccuguaucgcgguuggccucgucacacuguaccuuggggugauggugcaggcugauucuggaugcgucauuaacuggaaaggccgcgaauugaagugugguucagggaucuucguuacuaaugaggugcacaccuggacggaacaauauaaguuucaggccgacaguccgaaaagacugagcgcagccaucggaaaggcuugggaggagggcgugugcgguauuagguccgccacacggcucgaaaacauaauguggaaacagaucucuaacgagcugaaucauauuuuacuggaaaacgacaugaaguucaccguagucgugggcgauguuguggggauccuugcacagggcaagaagaugauucgcccucaacccauggagcacaaauacucguggaaaagcuggggcaaggcuaagaucauaggggccgacguccagaauacuaccuuuaucauugauggaccaaacacaccugaaugucccgacgaucagagagcguggaauaucugggagguggaggacuauggcuucgguauuuuuacuaccaacaucugguugaagcucagggauucccacacacagguuugcgaccaucgucugaugucagccgcuauaaaagauaguaaggcagugcacgccgacaugggguacuggauugaaucugagaaaaaugaaacguggaagcuagcucgggccagcuucaucgagguaaagaccuguauuuggccaaaaucccauacucuguggucaaacggaguccucgaaagcgagaugaucauacccaagaucuauggcgguccuauuucucaacacaauuaccgaccaggcuauuucacacagaccgcagggccguggcaccugggaaaacuugaguuggauuuugaccugugcgaaggcacuacagugguggucgaugagcauugcgggaacagaggacccuccuuaaggaccacgacuguuaccggcaagaucauucacgaaugguguugccgcaguuguacacucccuccacugcgguucaaaggugaggacgggugcugguacggaauggagaucagacccgugaaggaaaaggaggaaaaucuuguaaaaagcauggugucugcgggcuccggugaggucgacucauuuagucugggcuugcucuguauaagcauuaugaucgaagaggugaugaggucgcgcuggucccgaaagaugcugaugaccgggacucuagccguuuuccugcuccugaucaugggacagcuuacauggaacgauuugacccggcugugcauuauggugggcgcuaaugccucugaccguauggggaugggaacaacuuacuuagcacucauggcuaccuuuaaaaugagaccuauguucgccgucggccugcuuuuuaggcgccugacgagccgggaggugcuacuccugacaaucgguuugucacugguugcaaguguggaauuaccaaacucccucgaggaacugggggauggacuugccaugggcauuaugauacugaaguugcucaccgacuuccaaucucaucagcugugggcuacucuacugagccuuaccuuuaucaaaacaacucucucccugcacuaugcguggaagaccauggccauggucuugucaauuguaagccuguuccccuuaugucucaguacgacaucucagaagaccacuuggcugccggugcuucugggcuccuuggggugcaaaccucucgcaauguuucugaucgcugagaauaagauuuggggaagaaaaagcuggccacuaaacgaagguaucauggccguuggcguggucucgauacugcuuucaucucuccugaagaacgaugugcccuuggccgggccuuuaaucgcuggaggcaugcugauugcauguuacguaaucagugguuccagcgccgaccucucucuggagaaagcggcugaggugagcugggaagaggaagccgagcauuccggggcaucacacaauauucuugucgaaguucaggaugacggaacaaugaagaucaaagaugaggagagggacgauacccugacuauauugcuaaaggccacacugcucgcugugaguggcguguauccccugagcauuccagcaacccuuuucgucugguacuuuuggcaaaagaaaaagcagcgaucuggcguguuaugggacacgccuucacccccagaaguugagcgcgccguacuggaugacgggaucuaucggaucaugcagagaggacucuuggguaggagccaggugggcgucgggguguuccaagaaaacguuuuccacacuauguggcaugugacccguggagcgguccugauguaccagggcaaacgccucgagccgaguugggcuagcgugaagaaagaccugauuuccuauggugggggauggcggcuucagggcucuuggaauacaggcgaggaaguacaggucauagccguggagccugggaagaaccccaagaauguucaaaccgcaccaggaacauuuaaaacucccgaaggugaggugggcgccaucgcucuggauuucaagccugggaccucgggaagcccaauugucaacagagaaggcaaaaucguggguuuguacgggaauggaguugugacgacaucaggcacuuacgucuccgccauugcacaggcuaaggccagucaggagggcccccuaccugagaucgaagacgagguguuuaggaaacgaaaccugaccauaauggaucuccacccggggucuggaaagacacggcgcuauuuaccagcgaucguaagagaagccauuaagaggaaacugcggacccuuauccuggcacccacucgagugguugcuagcgagauggccgaagcucucaaggguaugccuauuagauaccaaaccacagcagucaaauccgagcauacgggcaaggagaucguggacuugaugugccacgccacuuucaccaugcgccugcucucaccagugaggguccccaauuauaacaugauaauuauggaugaagcccauuuuacagacccuucuagcaucgcugcgcguggguacaucaguacccggguaggaaugggcgaggcagccgcuauuuucaugacugccacaccgcccgguuccguggaagcauuuccacagagcaaugccguuauccaggaugaggaaagagacauaccugagaggucuuggaacucaggguaugaguggauuaccgauuuccccggaaaaacggugugguuugucccauccaucaagaguggcaaugacauugcuaacugucugcgcaagaauggcaaacgagugauccagcuuagcagaaagacuuucgauacagaauaccagaaaaccaagaacaacgacugggacuauguugugaccacugauauaucggagaugggggcgaauuuucgggccgacagggucauugauccucgccguugccuaaaacccgugauccugaaggacggaccagaaagaguaaucuuggcagguccgaugccugugacaguugcuucugccgcacagcggaggggccgcauugggcgaaaccacaauaaggagggagaucaguacaucuacaugggccagcccuuaaacaaugacgaggaucacgcccauuggaccgaagcuaaaaugcugcucgacaacauuaauacaccagaggguauaauccccgcccuguucgaaccugagagagaaaaguccgcggcaauugauggggaguaucggcuuaggggcgaggcccgcaaaacuuucgucgaacugaugagaaggggagaccucccagugugguugagcuacaagguggcuucagagggcuuucaauauagugaucggcguuggugcuucgacggggaacgcaacaaucagguccuggaggaaaacauggauguugagaucuggacgaaagagggagaacgaaagaaacuaagacccagguggcuggacgcccggaccuacucugacccucucgcacuucgcgaguuuaaggaguucgcagccgguagaagguccgugagcggcgaucugaucuuagagauugggaaguugccgcagcaccugacacagcgggcucaaaaugcccucgacaaccugguaaugcuucauaauucagaacagggaggccgagcauauagacacgcgauggaggagcugccagauacuauagaaacccucauguugcuggccuuaaucgcugugcuaacagguggggucacccuguuuuuccucaguggccgcggacuuggcaaaacuagcauugggcuguugugugugauggccuccucuguucugcucuggauggcaagcguggagccccacuggaucgcugccuccauuauccuggaauuuuuccuuaugguccuccugauaccugagcccgacaggcagcggacgccacaggauaaccaauuggcauacguagugaucggacuguuauuuaugauucuaaccguugccgcuaaugagaugggucugcucgaaacaacuaagaaagaccuuggcaucgggcauguggcggucgagaaccaccaucacgccaccaugcuggauguggacuugcauccugcaucagcuuggacacuguaugccgucgccaccacuauuaucacacccaugaugcgucacacgauagaaaacaccacugcaaauauuucucucacagcuaucgccaaccaggcggcuauucugaugggacuugauaagggcuggccaaucaguaaaauggacauaggugugccuuuacuggcccucgggugcuacucgcagguuaauccguugacccugaccgcagccgugcuaaugcugguagcucacuacgcaaucauuggccccggacuccaagccaaggcgacaagagaggcucagaagaggacugccgcaggcaucaugaaaaacccaacgguggaugggauugucgccaucgaccuugauccuguuguguaugacgcuaaguucgaaaaacagcugggacagauaauguugcugauucucuguaccagccaaauccuguuaaugcgcacaacuugggcccuuugcgaguccaucacccuggcaacaggcccccucaccacucuaugggaggguucuccagggaaguuuuggaauacgacaauugcugucucaauggccaacaucuuccggggaagcuaccuggcgggcgccgguuuggcauuuucccugaugaaaagucucggcgggggacgaagaggcaccggggcucagggagaaacucuuggcgagaaguggaagaggcagcugaaucaguugucuaaaagcgaguucaacauauauaagcgcucagguauuauggagguggaccgguccgaagccaaagaggggcugaagagaggagagaccacacgucaugcaguaaguaggggcacugcuaaacuccggugguucguggaacgcaauuuaguuaagccugaggguaaggugaucgaucugggcugugggcgaggaggcuggagcuacuauugcgccgggcuuaaaaaggucaccgaagugaaaggauacacaaagggcggucccgggcacgaggaaccgauuccaauggccacguauggauggaaccuggucaaacuacauucuggcaaggacguguuuuucaccccucccgagaaaugugauacucuccugugcgacaucggcgaguccucaccaaaucccacaauagaagaggggagaaccuugaggguucugaagaugguagaaccuuggcuccggggaaaccaauuuuguaucaagauucuuaauccguacaugcccagcguggucgagacucuggagcagaugcagcgcaaacacgguggcauguuagugagaaacccacugucgagaaauucuacacacgaaauguacuggguuaguugcgggaccggaaacaucguguccgcggucaauaugacgagccgaauguugcucaaccgguucaccauggcucaucguaagccuacauaugagagagauguggaccugggcgcagguacucgccacguagccguggaacccgagguugcuaaccuagauauuaucgggcagaggauugaaaauaucaaacaugagcacaagucaaccuggcauuacgacgaggauaacccuuauaaaacaugggccuaccacggauccuaugaagucaagccaucuggcagcgcaaguuccauggugaauggcguggucaaacuucugacuaaacccugggacguuauaccuauggugacccaaauugccaugacagauaccacuccauuugggcagcagcggguauucaaggagaaaguggacacgagaacacccaaggcuaaacgcggaaccgcgcaaaucauggaagucacugccagguggcucugggguuuucugagccgaaacaagaagccgcggaucuguaccagagaggaguucacaaggaaagugcgcucuaaugcagcuauuggcgccguuuuuguggacgagaaccaguggaacucagcaaaggaggccgucgaagaugagcguuucugggacuuggugcagaaagaacgggagcugcacaagcaggggaaaugcgcuacgugcguauacaacaugaugggaaagagagaaaagaaacucggcgaguuugguaaggccaaagggaguagggcgauaugguauauguggcuuggagcacgcuuccuggaguuugaagccuuaggcuucaugaaugaggaucauugguucucccgagaaaacagccugucuggcguugagggggagggauugcacaagcucgguuacauccugcgggacauuucgaaaaucccuggcgggaauauguacgcugaugacaccgccggaugggauacuagaauuacagaagacgaucuacaaaacgaggcaaggaucaccgacauaauggaaccagagcaugcacuucuggccacuucaaucuuuaagcucacauaucagaauaaagugguccgcgugcagagacccgcuaagaacggcaccgugauggaugucauuagccggagggaccagcgugguuccgggcaaguuggaacauacggccugaauacuuucaccaacauggaagcccaguugauccgacagauggagagugagggcauauuuuuaccuucugaacuggagacgcagaaccucgcagaacgcgugcuugauuggcuggagaaguaugggguagaaagacuaaaacggauggcgaucagcggagacgacuguguggucaagccaauagaugacagguucgccaccgcucugacagcccucaaugauauggguaaagugcgcaaggacauuccccaaugggagccguccaaaggcuggaacgauuggcagcagguuccuuuuugcucacaccacuuccaucaguugaucaugaaggacgggagagagaucgugguccccugucggaaucaagaugaacuggugggaagggcacgaguaagucagggcgcugguuggucucuucgugagacugccugccuggggaaguccuacgcacagauguggcaacucauguauuuucacagacgcgacuuacggcuggccgcgaacgcuauuuguuccgccguuccaguggauugggucccuaccucaaggacaacuuggagcauacaugcacaccaucaguggaugaccacggaagacauguugucuguguggaauagaguuuggaucgaggaaaaccccuggauggaggauaaaacacacguguccaguuggggagacgucccauaccugggcaagcgcgaggaccaguggugcggcagccucauugggcuuaccgcccgggcuacuugggccucgaauauccagguggcaauuaaccaaguaaggcgacugaucggaaaugaaaacuaucuagauuacaugacauccaugaaaagauucaagaaugagggugaccccgaaggcgcucugugguga

SEQ ID NO: 13784 - RNA, 9879 nt, Artificial Sequence
  derived and/or modified CDS sequence (opt3) from DENV-1__GQ199806__SS-prME
agcgugacaaugcugcuaaugcuuaugcccacagcacuggcuuuccacuugacuacgcgaggcggggagccucauaugaucgucuccaagcaggaaagggggaaaucuuuacuguuuaagacaucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccauucucaggaaacugugcaucgaagcuaagauaucuaauacgaccacagauagccgguguccaacucaaggagaggccacccuuguggaggaacaagacgcaaacuuugucugccgccgaacauucguugauagaggcugggguaauggguguggacuguuuggcaaaggcuccuugauuacuugcgcuaaguucaagugcgugaccaaacucgaggggaagaucguacaguacgaaaaccugaaauauucagugauugucacagugcacaccggagaccagcaucaaguugguaaugagaguacugaacacggcacgacagccaccaucacuccccaggcgccuagcaccgagauccaguuaacagacuacggggcccugacccucgauuguucuccaaggacuggacuugacuuuaacgaaauggugcuguugacaaugaaggagaaauccuggcuaguccauaagcagugguuccuggaucucccgcugcccuggacgucaggcgcaagcaccagucaagagacuuggaaucggaaagaccuucuggugacauuuaagaccgcucacgccaagaaacaggaagcuguaguuuuggguucucaggagggggccaugcacacagcacucacuggcgccaccgaaauucaaacguccggaaccacaacuauauucgcuggccaucugaagugccguuuaaaaauggauaagcugacccuaaaagggaugagcuaugugauguguacaggaucguucaagcucgagaaggaagucgcggagacucagcacgguaccgugcugguccagaucaaauacgagggcacggacgcaccuugcaagauuccauuuucuacacaggaugaaaaaggggugacccaaaacggacgccuuaucacugccaaucccauaguuacagacaaggagaaaccugugaacauugaagcugagccacccuucggcgaguccuauaucguaaucggugccggggaaaaggcauugaagcugucaugguuuaaaaagggcaguagcauuggaaaaauguucgaggccaccgcuagaggcgccaggcggauggcaauccucggggauacugcgugggacuuuggauccauugguggcgucuucaccucuguggggaagcugguucaucagauauuuggaacagcuuacggcgugcuuuucagcggugucucauggacgaugaaaaucgggauuggcgugcuguugaccuggcucggacugaauagucgauccacuagcuuaucuaugacauguaucguagugggccugguuacccuauaccucggggucauggugcaggccgauucaggaugcgugaucaacuggaagggccgcgaacugaagugugguagugggauuuuugucacaaaugagguucacacuuggaccgaacaguauaaauuccaagcagacagcccgaagagacuuuccgccgcuauaggaaaagccugggaggagggcgugugcgguaucaggucugcaacgcgguuggaaaacauuauguggaagcagaucucgaacgagcugaaucauauucuccuggaaaacgacaugaaauuuacagugguagucggcgauguggcugggaucuuagcccagggaaagaaaaugauacgcccucagcccauggaguacaaguauagcuggaaguccuggggcaaagcgaagaucauuggggccgacguucaaaauaccacuuucaucauugauggaccaaacaccccugaaugucccgacgaucagagagcuuggaauaucugggagguggaggacuacggcuuugguauauucacaacuaacauuuggcugaaacuuagggauucauauacccaggucugcgaccaccguuugaugagugcagccaucaaggauucuaaagcugugcacgccgacaugggguacuggauugaaagcgagaagaaugaaacauggaagcucgcacgggcguccuucaucgagguuaaaacguguauauggccaaagucacauacccuguggagcaacggagugcuagaaucugagaugaucauucccaaaaucuauggcgguccuauuucccagcacaauuaccgaccaggcuacuuuacucaaacagccgggccguggcaucugggaaagcucgagcuggauuucgaccuuugcgaaggcaccacuguagucguggaugagcacugcgggaacagaggacccaguuugaggacaaccacggugacuggcaaaaucauacacgaaugguguugccgcagcuguacccugccuccauuacgguuuaagggugaggacgggugcugguauggaauggagauuagacccgucaaggaaaaagaggaaaaucucguuaagucuaugguguccgcuggcucaggugagguagacaguuucagccugggccuucuguguaucucgaucaugauugaagaggugaugaggucccgcuggucucgaaaaauguugaugacagggacccucgccgucuuuuuccugcuaaucaugggacagcugacuuggaacgaucucauucggcugugcauaauggugggcgcaaaugcuagcgaccguauggggaugggaacaaccuaccuugccuugauggcaacauuuaagaugagaccuauguucgccguuggccuguuauuuaggcgccucacuucacgggaggugcugcuucugaccaucggucuaagucucgucgcuuccguggaacugccaaacucuuuggaggaacugggggauggauuagcgaugggcauuaugauccucaaacugcuuacggacuuccagagccaucaacugugggccacauugcucucccugaccuuuauuaagacuaccuucucacuacacuaugcauggaagacaauggcuaugguucugagcaucgugagucuuuuuccccucugucugucuacuaccucccagaaaacgacaugguugccgguccuguuaggcagccucgggugcaagccucugaccauguuccuuauagccgagaauaaaaucuggggaagaaagucguggccacugaacgaagguauuauggccguaggcaucgugucaauuuugcucucuagucugcucaagaacgauguuccccuggcugggccucuuaucgcaggaggcaugcucauagccuguuacgugauuuccgguagcucugcggaccugagcuuggagaaggcugccgaggucuccugggaagaggaagcagagcauucaggggccagucacaauaucuuaguggaaguacaggaugacggaacuaugaaaaucaaggaugaggagagggacgauacacugaccauucuccugaaggcuacucuucuggcagugagcggcgucuaucccuugucuauaccagccacacuauucguuugguacuuuuggcagaaaaagaaacaacgauccggcgugcugugggacaccccuucacccccagaaguggagcgcgcgguccucgaugacgggaucuaucggauuaugcagagaggacugcuugguaggagucaggugggcguugggguauuccaggaaaacguguuucauacgauguggcacgucacucguggagcuguguuaauguaccaaggcaagcgccuggagccgagcugggccuccguuaaaaaggaccucaucucuuacggugggggauggcgguugcagggcucguggaauaccggcgaggaagugcaggucauugcaguggagccugggaagaaccccaaaaauguacagacagccccaggaaccuucaagacaagcgaaggugaggucggcgcuaucgcccuggauuuuaaacccgggacuucaggauccccuauagugaacagagaaggcaagaucguuggucucuaugggaauggaguggucaccacgaguggcacauacgugucugcaauugcucaagccaaagcgagccaggacggcccacugcccgagaucgaggaugaaguuuucaggaagcgaaaccuuacuauuauggaccugcacccuggguccggaaagacccggcgcuauuugccggccaucgugagagaggcaauaaaaaggaagcuacggacacugauucucgcuccaacccgagucguggccucagaaauggcugaggcauuaaaagguaugcccaucagauaccagacuaccgccguaaagucugaacauacaggcaaagagaucguggaucugaugugccacgccacguuuacuaugcgccuucugagcccuguuagggucccaaauuauaacaugauuaucauggacgaggcucauuucaccgaucccaguuccauagcggcacguggguacauuagcacacgggugggaaugggcgaagccgcugccaucuuuaugaccgcaacuccuccggguucuguggaggccuucccccaaucaaaugcugucauucaggacgaagagagagauaucccagaaagguccuggaacaguggguaugaguggauaacagacuuuccuggaaagaccguaugguucgugcccagcauuaagucgggcaaugauaucgcgaacugucuccgcaaaaauggcaagcgaguuauccaguugucuagaaaaacguucgacacugaguaccagaagaccaagaacaacgacugggauuacguggucaccaccgacauuuccgaaaugggggccaauuuucgggcagauagggugaucgacccacgccguugccugaagccuguuauucucaaggauggacccgagagagugauacuggcugguccaaugccggucacuguggccagcgcagcccaacggaggggccgcaucgggcgaaaccacaauaaagaaggagaccaguauauuuacaugggccagccucuuaacaaugaugaggaccaugcucacuggacagaggccaagaugcuacuggauaacaucaauacccccgaagguaucauuccagcguuguucgagcccgaaagagagaaaucagcagccauagacggggaauaucgguuaaggggcgaggcucgcaagacauuuguagagcugaugagaaggggagaucucccuguguggcugaguuacaaaguugccucugaaggcuuccaguauuccgaccggcguuggugcuuugauggggagcgcaacaaucaaguccuugaagagaacauggacguggaaaucuggacuaaggagggagagaggaaaaagcugagaccaagauggcucgacgcucggacguacagcgaucccuuggcacugcgcgaguucaaggaguuugccgcugguagaaggucagugaguggcgaccuaauucuggaaaucgggaaacucccucagcaccuuacccagcgggcccagaaugcacuggauaacuuagucauguugcauaauagcgagcaaggaggccgagcguauagacacgccauggaagaacugccggacacaauugagacucucaugcugcuugcucugaucgccguucucaccgguggggugacauuguucuuucuguccggccgcggauuaggcaagaccucuauagggcuacuguguguaauggcaagcuccgugcuccuuuggauggcuucagucgaaccacauuggaucgccgcaucuauuauccuggaguucuuuuugauggugcugcucauucccgaaccugauaggcagcggacuccccaggacaaccagcuggccuacguugugaucggacuucucuucaugauacugacggucgcugcgaaugagauggguuugcuggagaccaccaaaaaggauuuaggcauugggcacguagccguggaaaaccaccaucacgcagcuaugcuagacguugaucugcauccagccagugccuggacucucuacgcaguggcuaccacaaucauuaccccuaugaugcgucacacuaucgagaacacaacggccaauauaucgcuuaccgcgaucgcuaaccaagccgcaauucugaugggauuggacaaaggcuggcccaucagcaagauggauauuggugucccacugcucgcccuggggugcuauucccaggugaauccucuuacuuuaacagcugcaguccugaugcucguggcccauuacgcgaucauaggcccgggauugcaggcuaaggccaccagagaagcacagaaaaggaccgccgcuggcauuaugaagaaccccacaguugacgggaucguggccaucgaucuggacccaguaguguaugacgcaaaauuugagaagcagcuaggacagauuaugcugcucauccuuuguacuucucagauacuguugaugcgcacgaccugggcucugugcgaaucaauuacacucgccacuggcccucugaccacauuaugggaggguagccccgggaaauucuggaauaccacuaucgcggucuccauggccaacauuuuccggggaaguuaccuugcaggcgcuggucuggccuuuucucucaugaaaagccuaggcgggggacgaagaggcacgggggcacaaggagagacacugggcgaaaaguggaaaaggcaguugaaucagcugucaaaguccgaguucaacaccuauaaacgcagugguaucauggaaguugaucggagcgaggcuaaggaagggcucaaaagaggagagacuaccaagcacgccgugucucguggcacagccaaacuuaggugguuugucgagcggaaucuggugaaaccagaagguaagguaauagacuugggcugugggcgcggaggcugguccuacuauugcgcggggcugaaaaaggugacugagguuaaaggauacaccaagggcgguccugggcacgaggaacccaucccgauggcuacauacggauggaaccucgugaaauuaaauucaggcaaggaugucuucuuuauuccaccugaaaagugugacacgcugcuuugcgauaucggcgagagcucgcccaacccaaccauugaggaagggcgaacucugagagugcuaaaaauggucgagcccuggcucaggggaaaucaguucuguaucaagauucugaacccuuauaugccgucugugguugaaacauuggagcaaaugcagcggaaacaugguggcaugcugguacgcaauccccucaguagaaacuccacccacgagauguacugggugagcugcgggacuggaaauaucgucucagcagugaacaugacauccaggaugcuucugaaccgauuuaccauggcccaucggaagccaacguaugaacgugacguugauuuaggcgcugguaccagacacguggccgucgagccugaaguggcaaaucuggacauaauugggcagcgcaucgagaacaucaaauacgaacacaagucuacauggcauuaugaugaggacaaucccuacaagacuugggccuaucacggaagcuacgagguaaaaccuaguggcuccgcuagcucuauggugaacggcguugucaaguugcucaccaaaccaugggaugugauucccauggugacacagauagcgaugacugacaccacaccuuucgggcaacagagggucuuuaaggaaaaaguugacacccggacuccaaaggccaagagaggaacggcacagaucauggaggugacagcuaaauggcugugggguuuccuaucacgcaauaagaaacccaggauuuguacccgagaagaguuuacucggaagguaagaaguaacgccgcaaucggcgccguguucgucgaugaaaaucaauggaacuccgcuaaagaggccguggaggacgaaagguuuugggaucuuguucaucgcgagcgugaacugcacaagcaggggaagugcgcgaccugcguguacaauaugaugggaaaacgggagaagaaacucggcgaguucgguaaggcaaaagggagcagagccauuugguauauguggcugggagcuagguucuuggaguuugaggcccugggcuucaugaacgaagaccauugguuuucucgcgaaaauucgcucucaggcgucgaaggggagggacuucacaagcuggguuacaucuuacgagauauaagcaaaaucccgggcgggaacauguaugcagacgauacagcuggaugggacacgcggauuaccgaggaugaccugcagaaugaagccaagaucacugauauuauggagccugaacacgcuuugcucgccaaguccaucuucaaacugacauaccagaacaaggugguaagaguucaaaggccagccaaaaauggcaccgugauggacgucauaagucgcagagaucagcgggguucuggacaggugggaacuuauggccuaaacacauuuaccaacauggaggcgcagcuuauuaggcaaauggaaagcgagggcaucuucucccccucagagcuggaaacaccuaaucucgccgggcgugugcuggacugguuggagaagcauggagucgaacgauuaaaacgcauggcuaucaguggugacgauuguguugugaagccaauugacgauagauuugccacugcacugaccgcucucaacgacaugggcaagguacggaaagauauaccccagugggagccgucuaagggguggaaugacuggcaacaggugccuuucugcagccaccauuuucaccaacuuaucaugaaagauggaagggaaauugucgugcccugucgcaaccaggacgagcugguuggcagagcccgggugucccagggugcaggguggucacuaagggagacggccugccugggaaagagcuacgcgcagauguggcaacucauguauuuccaccgacgugauuugagacuggcugccaaugcaaucuguucugccgucccaguggacuggguaccuaccucccgcacaacuuggaguauucaugcucaccaucaguggaugaccacagaagauaugcuuagcguuuggaaccggguguggaucgaggaaaaucccuggauggaggacaaaacucacauaucguccugggaagacgucccauaccugggcaagagggaggaucaguggugcggcucucucaucggguuaaccgccagagcaacgugggcuacaaacauucaaguggccaucaaucagguucgccggcugauuggaaacgagaauuacuuggacuauaugaccucaaugaagagguuuaaaaacgaaagcgaucccgagggugcgcugugguga

SEQ ID NO: 13785 - RNA, 9879 nt, Artificial Sequence
  derived and/or modified CDS sequence (opt3) from DENV-1__GQ199809__SS-prME
uccgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguugacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugugggggaaaaagcucugaagcucuccugguucaagaaaggcucaaguauuggaaagauguuugaggccaccgcaagaggcgccaggcggauggcuauccugggggauacugccugggacuucggaagcauugguggcguuuuuaccuccguggggaaacuuguccaucagauauucggaacagcauacggcgugcuguuuucugguguaagcuggacgaugaagaucgggauuggcguguugcucaccuggcugggauuaaauucacgaaguacuucccugagcaugacauguaucgcgguuggccuagucacccucuaccugggggugauggugcaggcugauucuggaugcgucaucaacuggaaaggccgcgaacuuaagugugguucagggauuuucguuacaaaugaggugcacacuuggaccgaacaauauaaguuucaggccgacaguccgaaaagauugagcgcagccauaggaaaggcuugggaggagggcgugugcgguaucagguccguaacgcggcuggaaaacauuauguggaaacagaucucuaacgagcucaaucauauucuguuagaaaacgacaugaaguucacagucgugguuggcgauguggucgggauccuggcccagggcaaaaagaugauacgcccucaacccauggagcacaaauacucguggaaaagcuggggcaaggcaaagaucauuggggcugacgugcagaauaccacuuuuaucauugauggaccaaacaccccugaaugucccgacgaucagagagccuggaauaucugggagguugaggacuauggcuucgguauauuuacaacuaacauuuggcuuaaguugagggauuccuacacccaggcgugcgaccaccgucucaugucagccgcuaucaaagauaguaaggcagugcaugccgacaugggguauuggauugaaucugagaaaaaugaaacauggaagcuggcucgggccagcuucaucgagguaaagacguguauauggccaaaaucccacacccuauggucaaacggaguccuggaaagcgagauggugauccccaagauuuacggcgguccuaucucucaacauaauuaucgaccaggcuacuucacucagacagcagggccguggcaccucggaaaacuggagcuugauuuugacuugugcgaaggcaccacuguggucguugaugagcacugcgggaacagaggacccucccugaggacaaccacggugacuggcaagauuauccaugaaugguguugccgcaguuguaccuuaccuccacuccgguucaaaggugaggacgggugcugguacggaauggagauaagacccguaaaggaaaaggaggaaaaucuggugaaaagcauggucucugcgggcuccggugagguggacucauuuagucuuggccuguuguguauuagcaucaugaucgaagagguuaugaggucgcgcuggucccgaaagaugcucaugacagggacccuggccguguuccuacugcucauuaugggacagcugacuuggaacgaucuuauccgguugugcauuauggucggcgcuaaugccucugaccguauggggaugggaacaaccuaucuggcauuaauggcuacauuuaaaaugagaccuauguucgccgugggccuccuguuuaggcgccuuacuagccgggagguucugcuacucaccauaggucugucauugguggcaagugucgaacugccaaacuccuuagaggaacucggggauggacuggccaugggcaucaugauucuuaagcuguugacggacuuccaaucucaccagcucugggcuacacugcuaagccugaccuuuaucaaaacuacccuuucccuccauuacgcguggaagacaauggccaugguacugucaauugugagcuuguucccccuguguuuaaguacuaccucucagaagacgacauggcucccgguucugcuuggcucccuggggugcaaaccuuugaccauguuucucaucgcagagaauaagauauggggaagaaaaagcuggccacugaacgaagguaucauggcugugggcgucgugucgauucuacugucaucucuucucaagaacgauguaccccuggccgggccuuugaucgccggaggcauguuaauugcuuguuaugugaucagugguuccagcgcagaccugucucucgagaaagccgcggaggucagcugggaagaggaagcugagcacuccggggccucacauaauauacugguugaagugcaggaugacggaacuaugaagauuaaagaugaggagagggacgauacacuuaccauccuguugaaggcaacucuacuggccgugaguggcgucuacccccucagcaucccagcuacacuguucgugugguauuuuuggcaaaagaaaaagcagcgaucuggcguucuuugggacaccccuucacccccagaaguagagcgcgcaguguuagaugacgggauuuaccggauaaugcagagaggacugcucgguaggagccaggucggcguggggguuuuccaagaaaacguguuccacacgauguggcacgucacucguggagccguguugauguaucagggcaaacgccuggagccgaguugggcgagcguaaagaaagaccucaucuccuacggugggggauggcggcugcagggcucuuggaauaccggcgaggaaguccaggugauugcuguugagccugggaagaaccccaagaaugugcaaacagccccaggaaccuuuaaaacacccgaaggugaggucggcgcaaucgcccuugauuucaagccugggacuucgggaagcccaauugugaacagagaaggcaaaaucguuggucuguacgggaauggaguggucaccacgucaggcacauauguguccgcuauagcccaggcaaaggcuagucaggagggccccuugccugagaucgaagacgagguauuuaggaaacgaaaccuaacuauuauggaucugcauccggggucuggaaagacccggcgcuaccucccagccaucgugagagaagcgauuaagaggaaauuacggacacugauccuugcccccacccgaguugucgcaagcgagauggcugaagcccugaaggguaugccuauaagauaucaaacuaccgcugugaaauccgagcacacaggcaaggagauuguggaccucaugugccaugcaacguucacuaugcgcuugcugucaccagucaggguacccaauuacaacaugaucaucauggaugaagcccacuuuaccgacccuucuagcauugccgcucguggguauaucaguacacgggugggaaugggcgaggcggcagccauauucaugaccgcuacuccgcccgguuccguugaagccuuuccacagagcaaugcagugauucaggaugaggaaagagacaucccugagaggucuuggaacucaggguacgaguggauuacagauuuccccggaaaaaccgucugguuugugccauccaucaagaguggcaaugacauagccaacugucuccgcaagaauggcaaacgaguuauucagcugagcagaaagacguucgauacugaauaucagaaaaccaagaacaacgacugggacuacguggucaccaccgauaucucggagaugggggcuaauuuucgggcggacagggugaucgauccucgccguugccuuaaacccguaauucuaaaggacggaccagaaagagugauccuggccgguccgaugccuguuacugucgcaucugcugcccagcggaggggccgcauugggcgaaaccauaauaaggagggagaucaguacauauauaugggccagcccuugaacaaugacgaggaucacgcacacuggacagaagccaaaauguuacuggacaacaucaauaccccagaggguauuauccccgcucucuucgaaccugagagagaaaaguccgccgcgaucgauggggaguaccggcugaggggcgaggcacgcaaaacauucguggaacuuaugagaaggggagaccugccaguguggcucagcuauaaggucgccucagagggcuuucaauacagugaucggcguuggugcuucgacggggaacgcaacaaucagguuuuggaggaaaacauggauguggagauuuggacuaaagagggagaacgaaagaaacugagacccagguggcuagacgcucggacguauucugacccucuggcccuccgcgaguuuaaggaguucgcugcagguagaagguccguaagcggcgaucuuauacuggagaucgggaaguuaccgcagcauuugacccagcgggcccaaaaugcucuggacaaccucgugaugcugcacaauucagaacagggaggccgagccuacagacaugcaauggaggagcuuccagauacaauugaaacucugaugcucuuggcgcugaucgccgucuuaaccgguggggugacacuauuuuuccugaguggccgcggacucggcaaaaccagcauugggcuucuguguguuauggcuuccucuguguugcuguggauggccagcgucgagccccacuggaucgcagcuuccauaauccucgaauuuuuccugaugguacuucucauuccugagcccgacaggcagcggacuccacaggauaaccaacuggccuaugugguuaucggauugcuguuuaugauuuuaacgguggcagccaaugagaugggucuacuggaaaccacaaagaaagaccucggcaucgggcacgucgcuguggagaaccaucaccaugcgacuaugcuugaugucgaccugcacccugccucagcauggaccuuguacgcuguggccacaaccauaauuacucccaugaugcgucauacaaucgaaaacacgaccgccaauauuucucugacugcaaucgcuaaccaggccgcgauacucaugggacuggauaagggcuggccaaucaguaaaauggacauugguguuccucuuuuagcucuggggugcuacagccaggugaauccgcucacauugaccgccgcaguacugaugcuaguggcccacuaugcuaucauuggccccggacugcaagcaaaggccaccagagaggcgcagaagaggacagcugccggcaucaugaaaaacccaacugucgaugggauaguugcaauugaccucgauccuguggucuacgacgccaaguucgaaaaacagcuuggacagaucaugcuguugauccuguguacgagccaaauucuccugaugcgcaccacaugggcuuuaugcgaguccaucacucuugccaccggcccccugacaacccucugggaggguucuccagggaaguuuuggaauacuacgauagcagugucaauggcuaacauuuuccggggaagcuaucuagccggcgcgggucuggccuuuuccuugaugaaaagucugggcgggggacgaagaggcacaggggcacagggagaaacccucggcgagaaguggaagaggcagcuuaaucagcugucuaaaagcgaguucaacaucuacaagcgcucagguauuauggagguagaccgguccgaagcuaaagagggguugaagagaggagagacuacccgucacgccgugaguaggggcacagcaaaacugcggugguucguugaacgcaaucucgugaagccugaggguaaggucaucgauuuaggcugugggcgaggaggcuggagcuauuacugcgcugggcugaaaaaggugacugaagucaaaggauauaccaagggcggucccgggcaugaggaaccgauaccaauggccacauacggauggaaccuugugaaacugcacucuggcaaggacguauuuuucacgccucccgagaaaugugauacccuacucugcgacaucggcgaguccucaccaaaucccacuauugaagaggggagaacacugaggguauugaagaugguggaaccuuggcugcggggaaaccaauuuuguaucaagauucucaauccguacaugcccagcgucguggagacccuugagcagaugcagcgcaaacaugguggcaugcugguuagaaacccauuaucgagaaauucuacucacgaaauguauugggugaguugcgggacaggaaacaucgucuccgccgugaauaugaccagccgaaugcuguugaaccgguucacgauggcgcaccguaagccuaccuacgagagagauguagaccucggcgcugguacacgccauguggcaguugaacccgaggucgccaaccuggauauuaucgggcagaggauagaaaauauuaaacacgagcauaagucaacuuggcacuaugacgaggauaacccuuacaaaaccugggcuuaucauggauccuacgaagugaagccaucuggcagcgccaguuccauggugaauggcgucguuaagcuacuuacaaaacccugggacgugaucccuaugguaacucaaaucgcaaugaccgauacaaccccauuugggcagcagcggguguucaaggagaaagucgacacuagaacgcccaaggccaaacgcggaacagcucaaauuauggaagugaccgcgagguggcugugggguuuucucagccgaaacaagaagccgcggauauguacuagagaggaguucaccaggaaaguucgcucuaaugccgcaaucggcgcuguguuugucgacgagaaccaguggaacucagccaaggaggcaguggaagaugagcguuucugggaccugguacagaaagaacgggaguugcacaagcaggggaaaugcgccacaugcguuuauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguggagggggagggacugcauaaguuggguuacauccuccgggacauuucgaaaaucccuggcgggaauauguaugccgaugacacggcuggaugggauaccagaauaacugaagacgaucugcaaaacgaggccaagaucacagacauuauggaaccagagcacgcacuacuugcuaccucaaucuuuaaacugacuuaccagaauaaggucgugagggugcagcgccccgccaagaacggcacagucauggauguuauuagcagacgggaccagagggguuccgggcaagugggaaccuauggccucaauacauucacuaacauggaagcucagcugauccgucagauggagagugagggcauauuuuugccuucugaauuagagaccccaaaccuggccgaacgaguacucgauuggcuugagaaacaugggguggaacgccugaagagaauggcaauuagcggagacgacugugucgugaaacccaucgaugaccgguucgcgacggcccuaaccgcucugaaugauauggguaagguuaggaaagacaucccgcagugggagccuuccaagggcuggaacgauuggcaacaggugcccuuuugcucacaccacuuccaucagcucauuaugaaggacgggcgcgagauagucgugccauguagaaaucaggaugaauugguaggacgggccaggguuagucaaggcgcagguuggucucugcgagagacagcuugccuugggaaaagcuacgcccagauguggcagcugauguauuuucaccguagagaccuccgcuuagcagccaacgcgaauuguuccgcugugccugucgauugggugcccacuucacggaccacauggagcauccaugcccaccaucaauggaugacuaccgaagacaugcugucuguuuggaacaggguguggauugaggaaaauccauggauggaggauaagacgcacgucuccaguuggggagacgugcccuacuugggcaaaagagaggaccaguggugcggcagccugaucgggcucacagcacgcgccaccugggcuucgaacauucagguagccaucaaucaggugcggaggcuuauaggaaacgaaaauuaucuggauuacaugacuuccaugaagcgauucaaaaacgagggugacccugaaggcgcacuaugguga

SEQ ID NO: 13786 - RNA, 9879 nt, Artificial Sequence
  derived and/or modified CDS sequence (opt3) from DENV-1__GQ199810__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagccacacgcaggucugcgaccaccgucugauguccgcugcaaucaaagauucaaaggccgugcaugcugacaugggguauuggauugaaagugagaaaaaugaaaccuggaagcuagcccgggcaucuuucaucgagguuaagacuuguauauggccaaaaagccacacacugugguccaacggagugcucgaaucagagaugaucauucccaagaucuacggcgguccuauuagccaacauaauuaucgaccaggcuacuucacccagacugcggggccguggcaccugggaaaacuugaguuggauuuugaccugugcgaaggcacaaccguagucguggaugagcacugcgggaacagaggacccucuuuaaggacgacuaccgugacaggcaagaucauacaugaaugguguugccgcuccuguacccucccuccacugcgguucagaggugaggacgggugcugguacggaauggagauuaggcccgucaaagaaaaggaggaaaaucuuguuaagaguauggugagcgccggcucuggugagguagacuccuuuucacugggcuugcucuguaucaguaucaugauugaagaggugaugcgcagccgauggucgcggaaaaugcugaugacugggacacuagcugucuucuuucugcucaucaugggacagcugaccuggaacgaucuuauucguuugugcauaauggugggcgccaaugcauccgacagaauggggaugggaacaacuuaucuggcuuuaauggccaccuucaagaugaggccuauguuugcaguuggccuccuguuccgccggcuuacgucuagagaggugcugcuacucacaaucggucugagcuuggucgccucaguggaacugccaaacaguuuagaggaacucggggauggacuggcuaugggcauuaugauccuuaaacuguugaccgacuuucaaucccaccagcucugggcgacucugcuaucucugaccuucauuaagacaacuuuuagccuucauuacgccuggaaaaccauggcaaugguucucuccaucgugucacuguuccccuugugucugagcacgacaagucagaagaccacuugguuaccgguccuccugggcucucuugggugcaagccucugacaauguuuuugauagcugagaauaaaaucuggggaaggcgauccuggccacucaacgaagguauuauggccguaggcaucgugagcauucugcuaucgucacugcuuaagaacgauguuccccucgccgggccucugaucgcuggaggcauguugauagcauguuaugugauuucugguaguuccgccgacuuaagccuggagaaagcggcugaggucucuugggaagaggaaguggagcacagcggggccucccauaauauccucguagaagugcaggaugacggaaccaugaagaucaaagaugaggagcgcgacgauacucugacaauucuucugaaggcaaccuugcuagccgucucaggcguuuacccccugaguauaccagcuacacucuucgugugguauuucuggcagaagaagaagcagcggagcggcgugcugugggacacuccuucucccccagaagucgagagagcagugcuugaugacgggaucuacaggauuaugcagcguggauuacugggucgcucccagguuggcguagggguguuucaagaaaacgucuuccacaccauguggcacgugacacggggagccguucucauguaucagggcaaaagauuggagccgucaugggcgagugugaagaaagaccugaucagcuacggugggggauggaggcuccagggcuccuggaauaccggcgaggaaguccaggugauugcuguagagccugggaagaaccccaaaaauguccaaacagccccaggaacuuuuaagacccccgaaggugaggugggcgcaaucgcccuggauuucaagccugggacgucuggaucgccaauaguuaaccgagaaggcaaaaucgugggucuuuacgggaauggagucgugacaacuagcggcaccuauguuucagcuauugcccaggcaaaggcuucccaggagggcccccugccugagaucgaagacgagguguuucggaaacgcaacuugacaauuauggaucuacauccggggaguggaaagaccagaagguaccugccagccaucguccgggaagcgauaaaacgaaagcucagaacuuuaauucuggcccccacccgcgugguagcaucugagauggcugaagcccuuaaggguaugccuaucagguaucaaacaacggcugugaaaagcgagcacacuggcaaggagaucguugaccugaugugccaugcaaccuucacaaugcgucucuuguccccaguccgggugcccaauuacaacaugauuaucauggaugaagcccacuuuaccgacccuucaucuauagccgcuagaggguauauuagcacuagggugggaaugggcgaggcggcagccaucuucaugacagcuaccccgcccgguagugucgaagccuuuccacaguccaaugcaguaauucaggaugaggaacgcgacaucccugagcgaagcuggaacucuggguacgaguggauaacggauuuccccggaaaaacugugugguuuguuccaucaauuaaguccggcaaugacaucgccaacugucugaggaaaaauggcaagcgggugauccagcucaguaggaagacauucgauaccgaauaucagaaaaccaagaacaacgacugggacuacgucgugacuacagauauuagcgagaugggggcuaauuuccgcgcggaccguguuaucgauccuagacggugccugaaacccgugauucuuaaggacggaccagaaagggucauacuagccgguccgaugccugugaccguagcaucggcugcccagcgccgaggcagaaucgggcggaaccauaauaaagagggagaucaguacauuuauaugggccagccccugaacaaugacgaggaucacgcacacuggacagaagccaagauguuguuagacaacaucaauacuccagaggguaucauucccgcucuguuugaaccugagagggaaaagucugccgcgauagauggggaguaccgccucagaggcgaggcaaggaaaacguucguggaacugaugcggcguggagaccuuccaguuuggcuguccuauaaggucgccagcgagggcuuucaauacucagaucgccgauggugcuucgacggggaaagaaacaaucaggugcucgaggaaaacauggauguggagaucuggaccaaagagggagaaaggaagaaauugcggccccgcuggcuggacgcuagaacauauagugacccucuagcccugagggaguuuaaggaguucgcugcaggucggcgaucugucuccggcgaucucauucuugagaucgggaaacugccgcagcauuuaacucagagagcccaaaaugcuuuggacaaccugguuaugcuccacaauagcgaacagggaggccgcgccuacaggcaugcaauggaggagcugccagauaccauugaaacacuuaugcugcucgcguugaucgccgugcugaccggugggguaacuuuauuuuuccuaucaggccggggacugggcaagacgaguauagggcuccuuugugugauggcuagcuccguccuguuguggauggccucuguggagccccacuggaucgcagcuagcauuauccuggaauuuuuccucaugguucugcuuauuccugagcccgaccgucagagaaccccacaggauaaccaacucgccuauguggucaucggacuguuguuuaugauacugacaguagcagccaaugagauggguuuacuagaaacuaccaagaaagaccugggcauugggcacguggcuguugagaaccaucaccaugcggccaugcucgauguggaccuucacccugcauccgcuuggacacuguacgccgucgccaccacuaucauuacacccaugaugaggcauacgaucgaaaacaccacugcaaauauaucauugacagcuaucgccaaccaggcggcuauucugaugggacucgauaagggcuggccaaucucuaaaauggacauuggugugccucugcuugccuuagggugcuacagucaggucaauccgcugacccucaccgcagccguguugaugcugguugcucacuaugcaaucauaggccccggacuacaagccaaggcgacacgcgaggcucagaaacggacugccgcaggcauuaugaagaacccaacgguggaugggaucguagccaucgaccuggauccuguggucuacgacgcuaaguucgaaaaacagcucggacagauuaugcuucugaucuuguguaccucgcaaauacugcucaugcgaacaacuugggcccugugcgagagcauuaccuuagcaacaggcccccuuaccacucugugggaggguuccccagggaaguuuuggaauacgacaaucgcuguuucuauggccaacauuuucagaggaucauaucucgcgggcgccggucuagcauucagccugaugaaauccuugggcgggggaaggcgcggcaccggggcucagggagaaacucugggcgagaaguggaaacggcagcucaaucagcuuaguaagucugaauuuaacaccuacaagagaagcgguaucauggagguggaccguucagaagccaaagaggggcugaagaggggagagacaacuaaacacgcagucucccggggcaccgcuaaguugcgcugguucguggaacgaaaucugguaaaaccugaggguaaggugauagaucucggcugugggagaggaggcuggaguuauuacugcgccggguuaaagaaaguuacagaagugaagggauauacgaaaggcggucccgggcaugaggaaccgaucccaauggccaccuacggauggaaccuggucaaacuucacagcggcaaagacguguuuuucauuccucccgagaagugugauacucugcuaugcgacaucggcgagucuuccccaaaucccacaauugaagaggggaggacccuccggguccugaaaaugguggaaccuugguugcgcggaaaccaauuuuguaucaagauucugaauccguacaugcccucaguuguagagacucucgagcagaugcagagaaagcaugguggcaugcuugugaggaacccacugagccgaaauucgacacacgaaauguauugggucucuugcgggaccggaaacaucgugagugcgguuaauaugacgucccggauguuacugaaccguuucaccauggcucacagaaaaccuacauacgagcgcgauguggacuugggcgcagguacuaggcaugucgccguggaacccgagauagcuaaccucgauauuaucgggcagcggaucgaaaauauuaagcacgagcauaaaagcaccuggcacuaugacgaggauaacccuuacaagacaugggccuaucauggaucauacgaaguaaaaccauccggcucugcaagcaguauggugaauggcguugucaagcugcuaacuaagcccugggacgugauaccuauggugacccaaaucgccaugacagauaccacuccauuugggcagcagagagucuucaaagagaagguugacacgcgcacacccaaagcuaagaggggaaccgcgcaaauuauggaagugacugccaaauggcuuugggguuuucugucccgaaacaagaagccgcggaucuguaccagagaggaguucacaaggaaaguacgcagcaaugcagcuauuggcgccguguuugucgacgagaaccaguggaacucugcaaaggaggccguggaagaugagcguuucugggaccucguucaccgggaaagagagcugcacaaacaggggaagugcgcuacgugcguguauaacaugaugggaaaaagggaaaagaaguugggcgaguuugguaaagccaaggggucacgcgcgaucugguacauguggcugggagcacgauuccucgaguucgaagcccuuggcuuuaugaaugaggaucauugguucagucgggaaaacucccugagcggcgucgagggggagggauuacacaaacuggguuacauauugagagacaucucuaagauuccuggcgggaauauguaugcugaugacaccgccggaugggauacuaggaucacagaagacgaucuccagaacgaggcacgcauuaccgacaucauggaaccagagcaugcucugcuagccaaaucgauauuuaaacuuacuuaccaaaauaaagugguaagaguucagcggcccgcuaagaacggcacagugauggaugucauuucaaggcgugaccagcgagguagcggacaggugggaaccuauggccugaauacauucacuaacauggaagcccaacucauccgccagauggaguccgagggcaucuuuaguccuucugaacuggagaccccaaacuuggcagaaagaguguuagauuggcuggagaaguacggggucgaacggcucaaaaggauggcgauuagcggagacgacuguguugugaagcccauagaugaccgcuucgccacggcucuuaccgcccugaaugauauggguaaaguaagaaaggacaucccgcagugggagccuuccaaaggcuggaacgauuggcagcaagugcccuuuugcucacaccacuuccaucagcuaauuaugaaggacgggcgggagaucgucgugccauguaggaaucaggaugaacugguuggacgagcacgugugagucagggcgcugguuggucucucagagagacagccugcuugggaaagagcuaugcacaaauguggcagcugauguacuuucaccgccgggaccuuaggcuggccgcgaacgcuauuuguuccgccgucccuguggauuggauccccacuucaagaaccacauggagcauacaugcacaccaucaguggaugacuaccgaagacaugcucucuguauggaaucgcguuuggaucgaggaaaacccauggauggaggauaaaacgcacauuuccaguuggggagacgugcccuauuuaggcaagcgggaggaccaauggugcggcagccugaucggguugacagccagggcuaccugggccacuaauauucaggucgcaaucaaccaggugcgaagacugauuggaaaugaaaacuaccucgauuacaugacaucgaugaaacgguucaagaaugagggugacccugaaggcgcucuuugguga

SEQ ID NO: 13787 - RNA, 9879 nt, Artificial Sequence
  derived and/or modified CDS sequence (opt3) from DENV-1__GQ199811__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaauuacauccuccuggaaaacgacaugaaguuaacaguagucgugggcgauguugcugggauucuggcccagggaaaaaagaugauccgcccucaacccauggaguauaaauacagcuggaaguccuggggcaaggcgaaaauaaucggggccgacgugcagaauaccacuuuuauuaucgauggaccaaacaccccugaaugucccgacgaucagagagcuuggaauauuugggaggucgaggacuauggcuucgguaucuuuacaacuaacauauggcuuaaguugagggauucauacacccaggugugcgaccaucgucucaugagugcagccauuaaagauucuaaggcuguucacgccgacaugggguauuggaucgaaagcgagaaaaaugaaacauggaagcuggcacgggcguccuucauugaggugaagacguguaucuggccaaaaucacacacccuauggagcaacggaguacuggaaucugagaugauaauccccaagauuuacggcgguccuaucucccaacauaauuaccgaccaggcuauuucacucagacagccgggccguggcaccucggaaaacuggagcuugauuuugacuugugcgaaggcaccacugucgugguggaugagcauugcgggaacagaggacccagucugaggacaaccacggucacuggcaagauuauccacgaaugguguugccgcagcuguaccuuaccuccacuccgguucaaaggugaggacgggugcugguacggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuauuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaagccaccaguugugggccacacuccugucccuaaccuucgugagaacuaccuuuucacugcauuacgcauggaaaacaauggcuaugguccuuagcaucguaagucucuucccccuguguuugucuacuaccucccagaagacgacauggcugccgguguuacucggcagccuggggugcaagccucuuaccauguuucugauugccgagaauaaaaucuggggaaggaagucguggccauugaacgaagguauaauggccguuggcaucgugucaauucuccugucuagucuacugaaaaacgaugucccccuugcugggccucucaucgcaggaggcaugcugauugccuguuaugugaucuccgguagcucugcggacuugagcuuagagaaggcugccguaguguccugggaggaagaggcagaacacucaggggccagucauaauauacuggucgagguucaggaugacggaacuaugaaaauuaaggaugaagagcgagacgauacacucaccauccugcuuaaagcuacucuguuggcagugagcggcguguacccccuaucuaucccagccacacuguucgucugguauuucuggcaaaagaagaaacagcgcuccggcgugcucugggacaccccuucacccccagagguugaacgggcgguacuggaugacgggauuuacagaauaaugcagaggggacuuuuaggucguagucaggugggcgucgggguguuucaagagaacguuuuccacacgauguggcaugugacucgcggagcuguccugauguaccagggcaagcggcucgaaccgagcugggccuccgugaaaaaggacuugaucucuuauggugggggauggagacugcagggcucguggaauaccggcgaggagguacaggucauugcaguggaaccugggaaaaaccccaagaauguucaaacagccccaggaaccuuuaagacaagcgagggugaagugggcgcuaucgcccucgauuucaaacccgggacuucaggauccccuauugucaacagggagggcaagaucgugggucuguacgggaauggaguugugaccacgaguggcacauaugucucugcaauagcucaggccaaagcgagccaggaaggcccacuucccgagaucgaggacgaaguguuucgaaagcggaaccugacuauuauggauuugcacccuggguccggaaaaacccgcagauaccuaccggccaucguaagggaggcaauuaagcggaagcugcgaacacucaucuuagcuccaaccagagugguugccucagaaauggcugaggcacugaaagguaugcccauacgcuaucaaacuaccgccgucaagucugaacacacaggcaaagagauuguggaccuuaugugccaugccacguucacuaugaggcugcucagcccugugcgugucccaaauuacaacaugaucaucauggaugaggcucacuuuaccgaccccaguuccauugcggcacggggguauaucagcacaagaguaggaaugggcgaagccgcugccauauucaugaccgcaacuccuccggguucuguggaggccuuuccccagucaaaugcuguuauucaggaugaagagagggacaucccagaacgcuccuggaacaguggguacgaguggauuacagauuucccuggaaagaccgugugguuuguccccagcaucaaaucgggcaaugacauagcgaacuguuugcgaaagaauggcaagagagugauucagcugucucggaaaacguucgauacugaguaccaaaagacaaaaaacaacgacugggacuauguugugaccaccgauaucuccgaaaugggggccaauuucagggcagaccgcgucaucgauccacguagaugccucaagccugugauucugaaagacggacccgagcggguaauccuugcugguccaaugccggugacuguugccagcgcagcccagaggcgcggccgaauugggagaaaccauaauaaggaaggagaucaguacauauauaugggccagccucuaaacaaugacgaggaucacgcucauuggacagaggccaagaugcuguuggacaacaucaauacccccgaagguauuaucccagcguuauuugagcccgaacgggagaaaucagcagccaucgauggggaauacaggcugcgcggcgaggcuagaaagacauucgucgagcucaugaggcggggagaccugccuguguggcuuaguuauaaaguggccucugaaggcuuucaauacuccgaucgucgcuggugcuucgacggggagcgaaacaaucagguccuggaagagaacauggauguugaaauuuggacuaaggagggagagagaaaaaagcucaggccacggugguuggacgcucgcacguauagcgacccccuggcacuaagagaauuuaaagaguucgccgcugguaggcggucagugaguggcgaucugauacucgaaaucgggaagcuuccucagcaccugacccagcgagcccaaaaugcauuagacaacuugguaaugcugcacaauagcgagcagggaggcagagcguaccgccaugccauggaagagcucccggauacaauugagacucugaugcuucuggcucucaucgccguguugaccgguggggucacacuguuuuucuuauccggcaggggacuaggcaagaccucuauugggcugcucugugugauggcaagcuccguucuucuguggauggcuucaguggaaccacacuggaucgccgcaucuauaaucuuggaguuuuuccugaugguccuccugauucccgaaccugaccggcagcguacuccccaggauaaccaacuugccuacguagugaucggacuccuguuuaugauuuugacgguugcugcgaaugagaugggucuguuagagaccacaaaaaaggaccuaggcaucgggcauguggccgucgaaaaccaccaccaugcagcuaugcuggauguggaccuccacccagccagugccuggacucuuuaugcagucgcuaccacaauaauuaccccuaugaugagacauacuaucgagaacacaacggccaauauuucgcugaccgcgaucgcuaaccaggccgcaauauugaugggacuggauaaaggcuggcccaucagcaagauggacauuggugugccacuccuggcccuugggugcuacucccagguuaauccuuuaacucugacagcugcagugcucauguugguagcccacuaugcgaucauuggcccgggacugcaagcuaaagccaccagggaagcacagaagcgcaccgccgcuggcaucaugaagaaccccacaguggaugggauagucgccauugaccuagauccaguuguguacgacgcaaaauucgagaagcagcugggacagaucaugcuccuuauccuguguacuucucaaauuuugcugaugcggacgaccugggcucucugcgaaucaaucacacuggccacuggcccuuuaaccacacuuugggaggguagccccgggaaauuuuggaauaccacuauagcggucuccauggccaacauuuuccgaggaaguuaucuggcaggcgcuggucucgccuucucucuaaugaagagccugggcgggggaagaaggggcacgggggcacagggagagacauugggcgaaaaauggaagcgccagcugaaucagcucucaaaguccgaguuuaacaccuacaaacggagugguaucauggaaguggacagaagcgaggcuaaggaagggcuuaaacguggagagacuaccaagcaugccguaucuaggggcacagccaaacugcggugguucguggagcgcaauuugguuaagccagaagguaaggugauugaucugggcugugggcgaggaggcugguccuauuacugcgcggggcucaaaaaggucacugaggugaaaggauacaccaagggcgguccugggcacgaagagcccaucccgauggcuacauauggauggaacuuagucaaacugcacucaggcaaggacguguuuuucauaccaccugaaaaaugugauacgcuucugugcgacaucggcgagagcucgcccaauccaaccauugaggaagggagaacucuaaggguucucaagaugguagagcccuggcugcggggaaaccaauuuuguaucaagauuuugaauccuuacaugccgucuguggucgaaacacuggagcagaugcagcgcaaacaugguggcaugcucgugagaaacccccuuaguaggaauuccacccacgagauguauuggguuagcugcgggacuggaaacaucgugucagcagucaauaugacaucccgaaugcuguuaaaccgguucaccauggcccaucguaagccaacguacgaaagagauguggaccugggcgcugguacccgccacguagccguggagccugaaguugcaaacuuggauauuaucgggcagaggauagagaauauuaaacacgaacauaagucuacauggcacuaugacgaggauaaccccuacaaaacuugggccuaucauggaagcuacgaggucaagccuaguggcuccgcuagcucuauggugaauggcguggucaagcuccugaccaaaccaugggacguuauccccauggugacacaaaucgcgaugacugauaccacaccuuuugggcagcagcggguauucaaggaaaaaguggacaccagaacuccaaaggccaaacgcggaacggcacaaauuauggaggucacagcuaaguggcuaugggguuuucuuucaaggaacaagaaaccccgaauauguacccgggaagaguucacuagaaaggugaggaguaaugccgcaaucggcgccguuuuuguggacgaaaaccaguggaauuccgcuaaagaggccgucgaggaugaacgcuucugggaccuggugcaccgugagcgggaacuccauaagcaggggaaaugcgcgaccugcguauacaacaugaugggaaagagagagaagaaacugggcgaauuugguaaggcaaaagggagcagggccauuugguauaugugguugggagcucgcuuccuggaguucgaggcccucggcuuuaugaaugaagaucacugguucucucgagagaacucgcuuucaggcguugaaggggagggacugcacaaguuagguuacauccugcgggacauuagcaaaaucccgggcgggaauauguaugcagaugacacagcuggaugggauacgagaauaaccgaggacgauuugcagaacgaagccaagaucacugacauuauggagccugaacaugcucuccuggccaaauccaucuuuaagcuaacauaccaaaauaagguggucagggugcagcgcccagcaaaaaacggcaccgugauggaugucauuaguagacgggaccagagggguucugggcagguuggaacuuauggccuuaauacauucaccaacauggaggcgcaacugauccgucagauggaaagcgagggcauauuuucccccucagagcucgaaacaccuaaccuggccgggcgaguguuggauugguuagagaagcacggaguagaacgccugaaaagaauggcuauuaguggugacgacuguguggucaagccaaucgaugaccgguucgccacugcacucaccgcucuuaaugauaugggcaaagugaggaaggacaucccccagugggagccgucuaagggguggaacgauuggcagcaaguuccuuuuugcagccaucacuuccaccagcugauuaugaaagacggacgcgaaauagugguccccuguagaaaucaggaugagcuagugggccgggccaggguaucccagggugcaggguggucacugcgagagacggccugccucggaaagagcuacgcgcaaauguggcaguugauguauuuucaucguagagaccugcgccuugcugccaacgcaaucuguucugccguuccaguggauugggucccuaccucccggacaacuuggaguauucacgcucaucaccaguggaugaccacagaagacaugcugagcguguggaauaggguuuggaucgaggaaaaccccuggauggaggauaaaacucauauuucguccuggggcgacgugccauaccucggcaagagagaagaccaauggugcgggucuuuaaucggacugaccgcccgcgcaacgugggcuacaaauauacaggucgccaucaaccaggugcggagguugcuggguaaugagaacuaccucgauuauaugaccucaaugaaacgauucaagaaugagagcgaccccgaaggcgcgcuuugguga

SEQ ID NO: 13788 - RNA, 9879 nt, Artificial Sequence
  derived and/or modified CDS sequence (opt3) from DENV-1__FJ882549__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccaggcaaaggcuagccaggagggcccccuuccugagauugaagacgagguguucaggaaacgaaaccugacuaucauggauuugcacccgggguccggaaagacccggcgcuaucuaccagccauuguaagagaagcgaucaagaggaaacugcggacacucauauuagcccccacccgagugguugcaucagagauggcugaagcccugaaggguaugccuauuagauaccaaacuaccgcugucaaaucugagcauacaggccgcgagaucguggaccuuaugugccacgcaacguuuacuaugaggcugcucagcccagugcguguccccaauuauaacaugaucauuauggaugaagcccauuucaccgacccuaguuccaucgccgcucggggguacauaagcacaagaguaggaaugggcgaggcggcagccauuuuuaugaccgcuacuccgcccgguucuguggaagccuucccacagucaaaugcaguuauccaggaugaggaaagggacauuccugagcgcuccuggaacaguggguaugaguggaucacagauuuucccggaaagaccgugugguucgucccaagcauaaaaucgggcaaugacauugccaacuguuugcgaaagaauggcaagagagugauccagcugucucggaaaacguuugauacugaauaccaaaagacaaaaaacaacgacugggacuacguugugaccaccgauaucuccgagaugggggcuaauuucagggcggaccgcgucauugauccucguagaugccucaagcccgugauccugaaagacggaccagaacggguaauucuugccgguccgaugccugugacuguugcaagcgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggaaaaaucagccgcgauugauggggaguauaggcugcgcggcgaggcaagaaagacauuugucgaacucaugaggcggggagaccugccaguguggcuuaguuacaaaguggccucugagggcuuccaauauuccgaucgucgcuggugcuuugacggggaacgaaacaaucagguccuggaggaaaacauggauguugagauauggacuaaggagggagaaagaaaaaagcucaggccccggugguuggacgcucgcacguacagcgacccucuggcccuaagagaguucaaagaauuugcugcagguaggcggucagugaguggcgaucugauccucgagauugggaagcuuccgcagcaccugacccagcgagcccaaaaugcuuuagacaacuugguaaugcugcauaauagcgaacagggaggcagagccuaucgccacgcaauggaggagcucccagauacaaucgaaacucugaugcuucuggcgcucauugccguguugaccgguggggucacacuguucuuuuuauccggcaagggacuaggcaaaaccucuaucgggcugcucugugugauggcuagcuccgcccuucuguggauggcaucaguugagccccauuggauagcugccucuaucauuuuggaauucuuucugauggugcuccugaucccugagcccgacaggcagcggacuccacaggauaaccaacuugcauacgucguaauuggacuccuguucaugaucuugacgguggccgcuaaugagaugggucuguuagaaaccacaaagaaagaccuaggcauagggcacguugcgguggagaaccaccaucacgccacuaugcuggaugucgaccuccauccugcaagugcuuggacccuuuacgccguggccacaaccauuaucacucccaugaugcgucacacaauugaaaacacgaccgcaaauaucucgcugacugcuauagccaaccaggcggcuaucuugaugggacuggauaagggcuggccaauuagcaaaauggacaucggugucccucuccuggcccuugggugcuauucccaggugaauccguuaacacugaccgcagccguucucauguugguggcucauuacgcaauuaucggccccggacugcaagccaaggcgaccagagaggcucagaagaggacagccgcaggcauaaugaaaaacccaacuguagaugggauuguggccaucgaccuagauccugucguuuaugacgcuaaguuugaaaaacagcugggacagaucaugcuccuuauucuguguacgucucaaaucuugcugaugcgcaccacaugggcccucugcgagucaauaacucuggcaaccggccccuuaacaacccuuugggaggguagcccagggaaguucuggaauacuacgauugcuguguccauggccaacaucuuucggggaaguuaccuggcgggcgccggucucgcauucucucuaaugaaaagccugggcgggggacgaagaggcacaggggcucagggagaaaccuugggcgagaaguggaagaggcagcugaaucagcucucaaaauccgaauucaacacuuauaagcgcagugguauuauggaggucgaccggagcgaagccaaagaggggcuuagacguggagagaccacaaagcacgcagugucuaggggcacugcuaaacugcggugguuuguagaacgcaauuuggugaagccugaggguaagguuaucgaucugggcugugggcgaggaggcugguccuacuauugcgccgggcucaaaaaggugaccgaagucaaaggauacacaaagggcggucccgggcacgaggaaccgauaccaauggccacguacggauggaacuuagugaaacugcauucaggcaaggacgucuucuuuaucccucccgagaaaugugauacccuucugugcgacauuggcgagagcucgccaaaucccacuaucgaagaggggagaacacuaagggugcucaagaugguugaaccuuggcugcggggaaaccaauucuguauuaagaucuugaauccguauaugcccucuguaguggagacccuggagcagaugcagcgcaaacacgguggcaugcucgucagaaacccacuuaguaggaauuccacucaugaaauguacugggugagcugcgggacaggaaacauuguuucagcggugaauaugaccucccgaaugcuguuaaaccgguuuacgauggcucaccguaagccuaccuaugagagagaugucgaccugggcgcagguacacgccacguggccguagaacccgagguggcuaacuuggauaucauagggcagaggauugaaaauaucaaacaugagcacaagucuacuuggcauuacgacgaggauaacccuuauaaaaccugggccuaccacggaagcuaugaaguuaagccaaguggcuccgcaagcucuauggucaauggcguggugaagcuccugacaaaacccugggacgucaucccuaugguuacucaaauugccaugaccgauacaaccccauucgggcagcagcgggugcuaaaggagaaaguagacacuagaacgcccaaggcuaaacgcggaacagcgcaaauaauggaagugaccgccaaguggcuuugggguuuucugucaaggaacaagaaaccgcgaaucuguacucgggaggaauucaccagaaaggucaggaguaaugcagcuauuggcgccguguuuguugacgagaaccaguggaauuccgcaaaagaggccguggaagaugagcgcuucugggaccucguccaucgugaacgggagcugcacaagcaggggaaaugcgcuacaugcguguacaacaugaugggaaagagagaaaagaaauugggcgaguuugguaaggccaaagggagcagggcgaucugguacauguggcugggagcacgcuuccucgaguuugaagcccuuggcuucaugaaugaggaucacugguucucucgagaaaacucgcugucaggcguagagggggagggauuacauaagcuggguuauauuuugcgggacaucagcaaaauaccuggcgggaauauguacgcugaugacacggccggaugggauaccagaaucacugaagacgaucuccagaacgaggcaaagauuacagacaucauggaaccagagcacgcucugcuagccaccuccauuuuuaaacuuacuuaucaaaauaagguugugaggguccagcgccccgcuagaaacggcacagugauggaugugaucagucggagggaccagcgugguucugggcaggucggaaccuacggccugaauacauucacuaacauggaagcccaacucauacgacagauggagagcgagggcauuuuuuccccuucagaacuggagaccccaaacuuggcagaacgcguuuuagauuggcuggagaagcaugggguggaaagacucaaacggauggcgaucaguggagacgacuguguagugaagcccaucgaugacagguucgccacggcucuuucugcccugaaugauauggguaaaguccgcaaggacauuccgcagugggagccuagcaaaggcuggaacgauuggcagcaagugcccuuuugcucccaccacuuccaucagcuaauaaugaaggacgggagagagaucguugugccaugucggaaucaggaugaacuggucggaagggcacgagugucacagggcgcugguuggagccuccgugagaccgccugcuuggggaagucuuaugcacaaauguggcagcugauguacuuucacagacgcgaccuucggcuggccgcgaacgcuauuuguuccgccguaccuguugauugggugcccacaaguaggacuaccuggagcauccaugcacaccaucaguggaugacaacugaagacaugcucucggucuggaauagaguguggauugaggaaaacccauggauggaggauaaaacccacaucuccucuuggggagacguucccuauuuaggcaagcgcgaggaccaauggugcggcucacugauaggguugacggcccgggcuacaugggccaccaauauccagguggcaauuaaccaggucaggcgacugaucggaaaugaaaacuaccucgauuacaugacuagcaugaaaagauucaagaaugagagugacccugaaggugcucuuugguga

SEQ ID NO: 13789 - RNA, 9879 nt, Artificial Sequence
  derived and/or modified CDS sequence (opt3) from DENV-1__GQ199814__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagauaagccugucaacauagaggccgaaccacccuucggcgaguccuauauugugaucggugcuggggagaaagccuugaagcugucaugguuuaagaaaggcaguagcaucggaaagauguucgaagcaaccgccagaggcgcuaggcggauggccauucucggggacacugcaugggauuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgacucaggaugcgucaucaacuggaaaggccgcgagcugaagugugguagugggaucuuuguuacaaaugaagugcacacuuggaccgagcaauauaaguuccaggcagacagcccgaaaagacuuuccgccgcuauuggaaaggccugggaagagggcgugugcgguauaaggucugcaacgcgguuggagaacaucauguggaaacagauuucgaacgaacugaaucauauccuccuggagaacgauaugaaguuuacaguagucgugggcgacguugcugggauuuuagcccagggaaaaaagaugauccgcccucaacccauggaauacaaauauagcuggaaguccuggggcaaggcgaaaauaaucggggccgaugugcagaauaccacuuucauuaucgacggaccaaacaccccugagugucccgaugaccagagagcuuggaauauuugggaagucgaggauuacggcuuugguaucuucacaacuaacauauggcugaagcuuagggacucauauacccaggugugcgaucaccguuugaugagugcagccauuaaagacucuaaggcuguucacgccgauaugggguacuggaucgagagcgaaaaaaaugagacauggaagcucgcacgggcguccuucauugaagugaagacguguaucuggccaaaaucacauacccuguggagcaacggaguacuagagucugaaaugauaauccccaagauuuauggcgguccuaucucccaacacaauuaccgaccaggcuacuuuacucagacagccgggccguggcaucugggaaaacucgagcuggacuucgaucuuugcgagggcaccacugucgugguggacgaacacugcgggaacagaggacccaguuugaggacaaccacggucacuggcaagauuauccacgagugguguugccgcagcuguacccugccuccauuacgguuuaaaggugaagacgggugcugguauggaauggagauaagacccguuaaggagaaggaagagaaucucgugaaaucuaugguauccgcuggcucaggugaaguggauaguuucagccugggccuucuguguauuucgaucaugacagaggaagucaugaggucccgcuggucucgaaagauguugaugaccgggacucucgccguguuuuuccugcuaaucaugggacagcugacauggaacgaccucauucggcugugcaucaugguuggcgcaaaugcuagcgaucguauggggaugggaaccacauaccuugccuugauggcaacuuuuaaaaugagaccuauguucgccgugggccuguuauuuaggcgccucaccucacgggagguccugcuucugacgauuggucuaagucucguggcuuccguugagcugccaaacucuuuggaagagcugggggacggauuagcgaugggcauaaugauccucaagcugcuuacagauuuccaaagccaucagcugugggccaccuugcucucccugacuuuuauuaaaaccacauucucacuacacuaugcauggaagacuauggcuauggugcugagcaucgucagucuuuuuccccucugucugucuaccacgucccagaagacaaccugguugccgguacuguuaggcagccucgggugcaaaccucugacuauguuccuuauugccgaaaauaagaucuggggaagaaaaucguggccacugaacgaggguauaauggccgugggcaucguuucaauuuugcucucuagucugcuaaagaacgacgugccccuggcugggccucuuaucgcaggaggcaugcucauugccuguuacgucaucuccgguagcucugcggaucugagcuuggaaaaagcugccgagguguccugggaggaagaggcagaacauucaggggccagucacaauauauuaguagaggugcaggacgauggaacaaugaagauuaaagacgaagagagggaugacacccugacuauccuccugaaggcuacacuucuggcagucagcggcguuuaucccuugucuaucccagccacccuauucgugugguacuuuuggcaaaagaaaaagcagcgauccggcgugcugugggauacgccuucacccccagaggucgaacgcgcggugcucgacgacgggauuuaucggauaaugcagagaggacugcuugguaggagucagguuggcguagggguguuccaagagaacgucuuucauacuauguggcacgugacccguggagcuguuuuaauguaccagggcaaacgccuggaaccgagcugggccuccgugaagaaagaucucaucucuuacggugggggauggcgguugcagggcucguggaauacaggcgaggagguccaggugauugcaguagaaccugggaagaaccccaagaauguccaaaccgccccaggaacauucaaaacuagcgagggugaagugggcgcuaucgcccuggacuuuaagcccgggaccucaggauccccuauuguuaacagagagggcaaaaucgugggucucuaugggaauggagucgugacgacaaguggcacuuacguuucugcaauagcucaggccaaggcgagccaggaaggcccacugcccgagaucgaggaugaaguguucaggaaacgaaaccuuaccauuauggaccugcacccuggguccggaaagacacggcgcuauuugccggccaucgucagagaggcaauuaagaggaaacuacggacccugauccucgcuccaacucgagugguagccucagaaauggcugaggcauuaaaggguaugcccauaagauaccaaaccacagccgugaaaucugaacauacgggcaaggagauuguugaucugaugugccacgccacuuuuaccaugcgccuucugagcccugucagggugccaaauuauaacaugaucaucauggacgaggcucauuucacagaucccaguuccauugcggcacguggguacaucagcacccgggugggaaugggcgaagccgcugccauauuuaugacugcaacaccuccggguucugucgaggccuucccccagucaaaugcuguaauucaggacgaagagagagauaucccagaaagguccuggaacaguggguaugaguggauuaccgacuuuccuggaaaaacggugugguucguucccagcaucaagucgggcaaugauauagcgaacugucuccgcaagaauggcaaacgagugauucaguugucuagaaagacuuucgacacagaguaccaaaaaaccaagaacaacgacugggauuacgucgugaccacugacaucuccgaaaugggggccaauuuucgggcagauaggguuaucgacccacgccguugccugaaaccugugauucucaaggauggacccgagagagucauccuggcugguccaaugccggugacaguagccagcgcagcccagcggaggggccgcauugggcgaaaccacaauaaggaaggagaccaguauguguacaugggccagccucuuaacaaugaugaggaccaugcucacuggaccgaggccaaaaugcuacuggauaacauaaauacacccgaagguaucauuccagcguuguucgagcccgaaagagagaagucagcagccaucgacggggaauaucgguuaaggggcgaggcucgcaaaacuuuuguugagcugaugagaaggggagaucucccugucuggcugaguuacaagguggccucugaaggcuuccaauauuccgaccggcguuggugcuuugauggggagcgcaacaaucaggugcuugaagagaacauggacgucgaaaucuggacgaaagagggagagcgaaagaaacugagaccaagguggcucgacgcucggaccuacagcgaucccuuggcacugcgcgaauucaaggaguuugccgcugguagaaggucaguuaguggcgaccuaauucuggaaauagggaagcucccucagcaccuuacacagcgggcccaaaaugcacuggauaacuuagugauguugcauaauagcgagcagggaggccgagcguauagacacgccauggaagagcugccggacacuaucgagacccucaugcugcuugcucugauugccguacucacagguggggugaccuuguucuuucuguccggccgcggauuaggcaaaacuucuaucgggcuacugugugucauggcaagcuccgugcuccuuuggauggcuucaguugaaccacauuggauugccgcaucuaucauacuggaguucuuuuugauggugcugcucauccccgaaccugauaggcagcggacgccccaggacaaccaacuggccuacgucguaauuggacuucucuucaugauccugaccguggcugcgaaugagauggguuugcuggagacaacuaagaaagauuuaggcauugggcacguugccguggaaaaccaccaucacgcagcuaugcuagacgucgaucugcauccagccagugccuggacccucuacgcaguggcuacaaccaucauaacuccuaugaugcgucacacaauugagaacacgaccgccaauaucucgcuuacugcgauugcuaaccaggccgcaauccugaugggauuggacaagggcuggcccauaagcaaaauggauaucggugucccacugcucgcccuggggugcuauucccaggugaauccucuuacauuaaccgcugcaguucugaugcucguggcccauuacgcgauuaucggcccgggauugcaagcuaaggccaccagagaagcacagaagaggacagccgcuggcauuaugaaaaaccccacuguagacgggaucguggccauagaucuggacccagucguuuaugacgcaaaguuugagaaacagcuaggacagauuaugcugcucauccuuuguacgucucaaauccuguugaugcgcaccacaugggcucugugcgaaucaauuacucucgccaccggcccucugacaaccuuaugggaggguagccccgggaaguucuggaauacuacgaucgcgguguccauggccaacauauuccggggaaguuaccuugcaggcgcuggucuggccuuuucucucaugaaaagccuaggcgggggacgaagaggcacaggggcacagggagagacccugggcgaaaaguggaagaggcaguugaaucagcugucaaaauccgaguucaacacuuauaagcgcagugguauuauggaagucgaucggagcgaggcuaaagaagggcucaagagaggagagaccacaaaacacgccgugucucguggcacugccaagcuuaggugguuuguagagcggaaucuggugaagccagaagguaaaguuaucgacuugggcugugggcgcggaggcugguccuacuauugcgcggggcugaagaaagugaccgaggucaagggauacacaaaaggcgguccugggcacgaagagcccauuccgauggcuacguacggauggaaccucgugaaguuacauucaggcaaagaugucuucuuuaucccaccugaaaagugugacacccugcuuugcgauauaggcgagagcucgcccaauccaacuaucgaggaagggcgaacacugagagugcuaaagaugguugagcccuggcucaggggaaaccaauucuguauuaaaauccugaauccuuauaugccgucuguaguggaaaccuuggagcagaugcagcggaagcacgguggcaugcugguccgcaacccccucaguagaaauuccacucaugagauguacugggugagcugcgggacaggaaacauuguuucagcagugaauaugaccuccaggaugcuucugaaccgauuuacgauggcccaccggaaaccaaccuaugaacgugacgucgauuuaggcgcugguacaagacacguggccguagagccugaaguggcaaaccuggacaucauugggcagcgcaucgagaauauaaagcaugaacacaaaucuacuuggcauuacgaugaggacaaccccuauaagaccugggccuaccacggaagcuaugagguuaagccuaguggcuccgcuagcucuauggucaauggcguggugaaauugcucacaaagccaugggaugucauucccaugguuacucaaaucgcgaugaccgacacaaccccuuucgggcagcagaggguguuuaaagaaaagguagacacucggacgccaaaagccaagagaggaacagcacaaaucauggaggugaccgcuaaguggcugugggguuuccuaucacgcaacaaaaagcccaggauuuguacucgagaagaguuuacccggaaagucagaaguaaugccgcaauaggcgccguguucguugaugaaaaccaguggaauuccgcuaaggaggccguggaggacgaaagguuuugggaucuuguccaucgcgagcgugaacugcacaaacaggggaagugcgcgacaugcguguacaacaugaugggaaagcgggagaaaaagcucggcgaauucgguaaagcaaaggggagcagagccaucugguacauguggcugggagcuagguucuuggaguuugaggcccugggcuucaugaaugaagaccacugguuuucucgcgagaacucgcucucaggcguagaaggggagggacuucauaaacuggguuauauuuuacgagauaucagcaagauuccgggcgggaauauguacgcagacgauacggcuggaugggacacccggaucacugaggaugaccugcagaacgaagccaaaauaacagauaucauggagccugaacacgcuuugcucgccaaguccauuuucaagcugaccuaucaaaauaaaguugugagaguccagaggccagcaaagaacggcacugugauggacgugaucagucgcagagaucagcgggguucugggcaggucggaacauacggccuaaauaccuuuacaaacauggaggcgcaacuuauuaggcagauggaaagcgagggcaucuucucccccucagagcuggaaacuccuaaccucgccgggcguguucuggacugguuggagaaacauggaguggaacgauuaaagcgcauggcuauaaguggugacgauuguguagugaaaccaauugacgauagauuugccaccgcacugacggcucucaaugacaugggcaagguccggaaggauaucccccagugggagccgucuaaaggguggaacgacuggcagcaagugccuuucugcagccaccacuuucaucagcuuaucaugaaggauggaagggaaauuguugugcccugucgcaaucaggacgagcuggucggcagagcccgggugucccagggugcaggguggucacuaagggagaccgccugccugggaaaaagcuaugcgcaaauguggcagcucauguacuuccaccgacgugauuugagacuggcugccaacgcaauauguucugccguaccaguugacugggugccuacaucccgcacuaccuggaguauccaugcucaccaucaguggaugacaacugaagauaugcuuagcgucuggaaucggguguggauugaggaaaaccccuggauggaggacaagacccacaucucguccuggggcgacguuccauaucugggcaaaagggaagaucaauggugcgggucucucauuggauuaacggccagagcaacaugggcuaccaauauccagguggccauaaaccagguccgccggcugaucgguaaugagaacuacuuggacuacaugacuucaaugaagagguuuaagaaugagagcgaucccgaaggcgcgcugugguga

SEQ ID NO: 13790 - RNA, 9879 nt, Artificial Sequence
  derived and/or modified CDS sequence (opt3) from DENV-1__GQ199816__SS-prME
agcgugaccaugcugcucaugcuuaugcccaccgcacuggcuuuccacuugacuacgagaggaggggaaccucauaugaucgucuccaagcaggaaaggggaaaaucuuuacuguuuaagaccucagccgguguuaacaugugcacccugauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacaucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauuccagguguccaacucaaggagaggccacccuugucgaagaacaggacgcaaacuuuguuugccggcgcacauucguggaucgaggcugggguaauggguguggacuguuuggcaagggcagcuugauaacuugcgcuaaguucaaaugcguaaccaagcucgaggggaaaacagugcaguacgaaaaccugaaguauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaagaacaggacuugacuuuaacgaaaugguccuguugacgaugaaagagaaggcauggcuagugcauaaacagugguuccuggaucucccgcugcccuggaccuccggcgcuucaacuagccaagagacauggaauaggaaggaccuucugguaaccuuuaagacagcccacgcuaaaaagcaggaaguuguggucuuggguagucaggagggggccaugcacacugcacucaccggcgccacggaaauccaaaccucuggaacaacuaccaucuucgcuggccaucugaaaugccgguuaaagauggauaaacugacacuaaaggggauguccuaugugauguguacuggguccuucaagcucgagaaagaagucgcggagacccagcacgguacggugcugguucagauuaaguacgagggcacagacgcaccuugcaaaauaccauuuucgacccaggaugaaaagggggugacucaaaacggacgucuuaucacagccaaucccauuguaaccgacaaagagaagccugucaacaucgaagcugagccacccuucggcgagucuuauauagugauuggugccggggaaaaggcauugaaacuguccugguuuaagaaaggcucaaguaucggaaagauguucgaggccacugcucgcggcgccagaaggauggcaauccucggggauaccgcgugggacuuuggaagcauugguggcguuuucacauccguggggaaacugguccaucagaucuuuggaacggcuuacggcgugcuuuucucugguguaagcuggaccaugaagauugggauaggcgugcuguugacuuggcucggacuaaauucacggaguacauccuuaagcaugaccuguaucgccguuggccuggucacacuauaccucggggugauggugcaggcagauucuggaugcgucauuaacuggaagggccgagaacugaaaugugguucagggaucuuuguuacuaaugaggugcacaccuggacggaacaguauaaguuccaagccgacaguccgaaacgccuuagcgcugccaucggaaaggcaugggaggagggcgugugcgguauuagauccgcuacaagguuggaaaacauaauguggaaacagaucucuaacgagcugaaucauauucuccuggaaaacgacaugaaguuuaccguagucgugggcgauguugccgggaucuuagcgcagggcaagaagaugauucggccucagcccauggaguacaaguauucguggaaaagcuggggcaaggccaaaaucauaggggcugacgugcaaaaugcaacuuucaucauugauggaccaaacaccccugaaugucccgacgaucagcgcgccuggaauaucugggaggucgaggacuacggcuuugguauuuucacaacuaacaucuggcugaaacuuagagauuccuauacccaggugugcgaccacagguugaugucagcugccauaaaagauaguaaggcaguucacgcggacaugggguacuggauugaaucugagaagaaugaaacauggaaacucgcccgugcuagcuucaucgaggugaagacguguauuuggccaaaaucccauacccuguggucaaacggaguacuagaaagcgagaugaucauacccaagaucuauggcgguccuauuucucagcacaauuaccggccaggcuacuuuacucaaacagccgggccguggcaucugggaaaacucgagcuggauuucgaccuuugcgaaggcaccacugucgugguggaugagcacugcgggaaccgaggacccuccuugagaacaaccacggucacuggcaagaucauucacgaaugguguugcaggaguuguacccugccuccauuacgcuuuaagggugaggacgggugcugguauggaauggagauccggcccguuaaagaaaaggaggaaaaucucgugaaaagcaugguaucugcaggcuccggugagguggacucauucagucugggccuucuguguauaagcauuaugaucgaagaggucaugagaucgagguggucccgcaagauguugaugacagggauccucgcuguguuuuuccugcuaauuaugggacagcugaccuggaacgaucucauccgacugugcauuaugguuggcgccaaugcaucugaccggauggggaugggaacuacauaccuugccuugauggcuaccuuuaaaaugcguccuauguucgcggugggccuguuauuuagaaggcucacaagccgcgagguccugcuucugacuauaggucuaucacucguggccaguguugaacugccaaacuccuuggaggaacugggggauggauuagcaaugggcaucaugauucucaagcugcuuaccgacuuccagucucaucaacugugggcuacguugcucagccugacauuuaucaagaccacuuucucccuacacuaugccuggaaaaccauggccauggugcugucaauugucagccuuuuuccccucugucugaguacaacuucucagaagaccacgugguugccgguacuguuaggcucccucgggugcaaaccucugacaauguuccuuaucgcugagaauaagauauggggacggaaaagcuggccacugaacgaagguaucauggcagugggcauuguuucgaucuugcucucaucucugcuaaagaacgaugugccccuggccgggccucuuauugcgggaggcaugcucaucgcuuguuacgucauaagugguuccagcgccgaccugucuuuggagaaagcagccgaggugagcugggaagaggaagcugagcauuccggggcaucacacaauauuuuaguagaagugcaggaugacggaaccaugaagaucaaggaugaggagagagacgauacucugacaauccuccugaaagccacccuucuggcggucaguggcguuuaucccuugagcauuccagcuacucuauucgugugguacuuuuggcagaagaaaaagcaaaggucuggcgugcugugggacacaccuucacccccagaagucgagcgagccgugcucgaugacgggauauaucgcaucaugcagcggggacugcuugguagaagccagguuggcguagggguguuccaggaaaacgucuuucauaccauguggcacgugacgaggggagcaguuuuaauguaccaaggcaaacgucuggagccgaguugggccagcgugaagaaggaccucauuuccuacggugggggauggcgcuugcagggcucuuggaauacuggcgaggaaguccaggugaucgcuguagagccugggaaaaaccccaagaauguccagaccgccccaggaacauucaaaaccucggaaggugaggugggcgcaauugcucuggauuuuaagcccgggacaagcggaucaccuaucguuaaccgggaaggcaaaauagugggucucuaugggaauggagucgugacuaccuccggcacguacguuagugccaucgcgcaagccaaggcaucucaggagggcccacugcccgagauugaagacgagguguucagaaagaggaaccuuacaaucauggaucugcacccugggagcggaaaaacucgacgguauuugccggcuauuguccgcgaagccaucaagagaaaacuaaggacccugauacucgcuccaacacgggugguagcauccgagauggccgaagccuuaaaggguaugcccauucgauaccagaccacugcugugaaaucagagcauaccggcaaggagaucguugaccugaugugccacgcgacauuuacgaugagacuucugucuccuguccgcgugccaaauuauaacaugaucauuauggaugaagcacauuucacugaccccagcaguaucgccgcuaggggguacauauccacccgugugggaaugggcgaggccgcagccauuuuuaugacagcuaccccuccggguagcgucgaagcguucccccaaucuaaugccguaauccaggaugaggaacgggacauuccagagagaucauggaacuccggguaugaguggaucacugauuuuccuggaaagacagugugguucguucccaguauaaaaagcggcaaugacauugcaaacugucucaggaagaauggcaaacgcgugauccaguugucgcgaaagaccuucgauacggaauaccagaaaacuaagaacaacgacugggacuacgucgugacaaccgauaucucugagaugggggcuaauuuuagagccgaccggguuauugauccaaggcgcugccugaagccugugauccucaaagacggacccgaacgugucauucuggcagguccaaugccggugaccguagccuccgcugcccaaagacggggcaggauagggcgcaaccacaauaaggagggagaucaguauaucuacaugggccagccucuuaacaaugacgaggaucaugcgcacuggacugaagcaaaaaugcuacuggacaacauuaauacacccgaggguaucaucccagccuuguucgaacccgagcgagaaaagagcgcugccauugauggggaguauagauuacggggcgaggcuaggaaaaccuuuguggaacugaugcgcagaggagaccucccuguuuggcugucauacaaggucgcaagugagggcuuccaguauucugauaggcgguggugcuuugacggggaacguaacaaucaagugcuugaggaaaacauggauguggagauauggacaaaagagggagaacgcaagaagcugcgaccaagauggcucgacgccaggacuuacuccgaccccuuggcucugcgggaguucaaagaauuugccgcaggucgcagaagcgucucaggcgaucuaauccuggagauugggaagcucccucagcaccuuacgcagagggcgcagaaugcccuggacaacuuaguuauguugcauaauagugaacaaggaggccgggcuuaucgacacgccauggaggagcugccggauaccaucgaaacacucaugcugcuugcacugauugcugugcucacuggugggguaaccuuguucuuucugagcggcagaggauuaggcaaaacauccaucgggcuacugugugugauggccucuagcguccuccuuuggauggcauccguggagccacauuggauagccgcuucaaucauucuggaguucuuuuugaugguucugcucauccccgagccugaccgccagaggacaccccaggauaaccagcuggcguacguggucauuggacuucucuucaugauccugacuguagccgcaaaugagauggguuugcuggaaacgaccaagaaagacuuaggcauagggcacguggcuguugagaaccaccaucacgccgccaugcuagauguggaccugcauccagcaucugcuuggacacucuacgccgucgcgacuaccauuaucacaccuaugaugcggcacaccauugaaaacacuacagcuaauaucagucuuacggccauagcaaaccaagccgcuauccugaugggauuggauaagggcuggcccauuucgaagauggacaucggugugccacugcucgcacuggggugcuauagccaggucaauccucuuaccuuaacugccgcggugcugaugcucguugcucauuacgccauuaucggcccgggauugcaggcaaaagccacacgugaggcucaaaagagaaccgccgcaggcauaaugaaaaaccccaccguggaugggauuguagcuaucgaccuggauccaguggucuaugacacaaaguuugaaaaacagcuaggacagaucaugcugcucauucuuuguacuucccagauccuguugaugaggacgaccugggcccugugcgagucuauaacacucgcgacuggcccucugaccacauuaugggaggguucacccgggaaguucuggaauaccacuauugccguuagcauggcaaacaucuuccgcggauccuaccuugcuggcgccggucuggcauuuagucucaugaagucucuaggcgggggacggcgaggcacgggggcucaaggagaaacacugggcgagaaauggaagagacaguugaaucagcugagcaaaucagaguucaacaccuauaagagguccgguauuauggagguggaccgcagugaagccaaagaggggcucaagcggggagagacuaccaagcacgccgucagcagaggcacagcgaaacuucguugguuuguggaaaggaaucugguaaagccagaggguaaagugaucgauuugggcugugggcggggaggcuggucuuacuauugcgcugggcugaagaaaguuacugaagugaagggauacaccaaaggcgguccugggcacgaggaacccauaccgauggcaacauacggauggaaccucgucaaguuacauuccggcaaggacguguucuuuaucccaccugagaaaugugauacgcugcuuugcgacauuggcgagucaagccccaauccaaccaucgaagaggggcgcacucugcgaguccuaaagaugguggaacccuggcucagaggaaaccaguucuguauuaaaauccugaauccuuauaugccgucgguuguagagacauuggagcaaaugcagaggaagcacgguggcaugcuggugcggaacccccucucucgcaauaguacccaugaaauguacugggucuccugcgggacuggaaacauugugagcgccguuaauaugacaucaagaaugcuucugaacagguuuaccauggcucaccgaaaaccaacguaugagcgggauguggacuuaggcgccgguacccgucacgucgcaguggaaccugagguagccaaccuggauaucauagggcagagaauugaaaauaucaagcaugagcacaaguccacauggcauuacgacgaggauaaccccuauaaaacuugggcuuaccacggaucuuaugaagugaagccuagcggcagugcguccagcaugguuaauggcgucgugaaauugcucaccaagccaugggacgugauccccauggucacacagauugccaugacugauaccacaccuuucgggcaacagcgcguuuuuaaagagaagguggacaccaggacuccaaaggcaaaacggggaacggcucagauaauggaaguaacagccaaguggcugugggguuuccuaucuagaaacaaaaagccccgcaucuguaccagggaggaauuuacucgaaaagugcggucaaaugcagccauuggcgcugucuucguggacgagaaccaauggaauagugccaaggaggcgguugaagaugagagauuuugggaccuugugcauagggaacgcgagcugcacaagcaggggaaaugcgcaaccugcgucuacaacaugaugggaaagcgugagaaaaagcucggcgaguucgguaaagccaaggggucccgggcuaucugguacauguggcugggagccagauucuuggaguuugaagcacugggcuucaugaaugaggaucacugguuuagcagggaaaacucucucucgggcguggagggggagggacuucauaaacuggguuauauuuuacgcgacaucucaaagauaccgggcgggaauauguacgcugaugacacagccggaugggauacgcgaaucaccgaagacgaucugcagaacgaggcuaagauuacugacaucauggaaccugagcacgccuugcucgcaaaaagcauuuucaagcugacauaucagaauaaaguaguucgggugcaaagaccagcgaagaacggcaccgucauggaugugaucuccaggcgcgaccagagagguaguggacaggugggaacuuacggccuaaauacauuuaccaacauggaagcccagcuuauacggcaaauggagucugagggcauuuucagccccuccgaacuggagacaccuaaccucgcugggaggguccuggauugguuggaaaaacauggaguugagcguuuaaagcgaauggccaucucaggugacgacugugugguaaagccaaucgaugaccgcuuugcaacugcucugaccgcccucaaugauaugggcaaagugagaaaggacauuccccagugggaaccgaguaaaggguggaacgauuggcagcaggucccuuucugcucucaccacuuucaucaacuuauaaugaaggacggacgggagaucgugguucccuguaggaaucaggaugagcuggugggccgcgcaagagucagccagggugccggguggucccuacgggaaacggcgugccugggaaaaucauaugcucagauguggcaacucauguacuuccacaggcgagacuugcgucuggccgcaaacgccauuuguagcgcugugccaguagauuggguuccuaccucuagaacaacuugguccauccaugcccaccaucaguggaugaccacagaggacaugcuuaguguguggaaucgcgucuggauugaagagaaccccuggauggaagauaagacucacaucagcucguggggcgacgugccauaucugggcaagcgggaggaccaguggugcgggucccucauaggauuaaccgcaagggcuacgugggccacaaauauccaaguugcgauuaaccaggugagacgccugaucgguaaugagaacuacuuggauuacaugaccucuaugaaacgguuuaagaaugaaauugaccccgagggcgcucugugguga

SEQ ID NO: 13791 - RNA, 9879 nt, Artificial Sequence
  derived and/or modified CDS sequence (opt3) from DENV-1__GQ199817__SS-prME
agcgugaccaugcugcucaugcuuaugcccacagcacuggcuuuccacuugacuacgagaggaggggaaccucauaugaucgucuccaagcaggaaagagggaaaucuuuacuguuuaagaccucagccgguguuaauaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggcaagaaaaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaaacuucugacggacuuucaaagccaucaguugugggccacacuccugucccuaaccuucaucagaacuaccuuuucacugcacuaugcauggaaaacaauggcuauggugcuuagcauugucagucucaucccccuguguuugucuacuaccucccagaagacgacauggcugccgguauuacucggcagccuggggugcaagccucuuaccauguuccugauagccgagaauaaaaucuggggaaggaagucguggccauugaacgaagguauuauggccgugggcaucguuucaauucuccugucuagucuacugaaaaacgaugugccccuugcugggccucucaucgcaggaggcaugcugauagccuguuacgucauuuccgguagcucugcggacuugagcuuagagaaggcugccgagguguccugggaagaggaagcagagcauucaggggccagucacaauauccugguagaagugcaggaugacggaacuaugaaaaucaaggaugaggagcgagacgauacacucaccauucugcuuaaagcuacucuguuggcagucagcggcguuuauccccuaucuauaccagccacacuguuuguguggugcuucuggcaaaagaagaaacagcgcuccggcgugcucugggacaccccuucacccccagaagucgagcgggcggugcuggaugacgggaucuacagaauuaugcagaggggacuuuuaggucguagucagguuggcguagggguguuccaagaaaacgucuuucauacgauguggcacgugacucgcggagcuguucugauguaucagggcaagcggcucgagccgagcugggccuccgugaaaaaggacuugaucucuuacggugggggauggagacugcagggcucguggaauaccggcgaggaaguccaggugauugcaguagagccugggaaaaaccccaagaauguccaaacagccccaggaaccuucaagacaagcgaaggugaggugggcgcuaucgcccucgauuuuaaacccgggacuucaggauccccuauaguuaacagggaaggcaagaucgugggucuguacgggaauggagucgugaccacgaguggcacauauguuucugcaauugcucaggccaaagcgagccaggagggcccacuucccgagaucgaagacgagguguuccgaaagcggaaccugacuauuauggauuugcacccuggguccggaaaaacccgcagauaccuaccggccaucgucagggaagcaauaaagcggcgacugagaacacucauuuuagcuccaacccgcgugguagccucagagauggcugaagcacugaaggguaugcccaucagguaucaaacuaccgccgugaaaucugagcauacaggcaaggagaucguugaccuuaugugucacgccacguuuacuaugcgucugcucagcccuguccgggugccaaauuacaacaugauuaucauggaugaagcucauuucaccgaccccaguuccauagcggcaagaggguauauuagcacaagggugggaaugggcgaggccgcugccaucuuuaugaccgcaacuccuccggguucugucgaagccuucccccagucaaaugcuguaauucaggaugaggaacgcgacaucccagagcgauccuggaacaguggguacgaguggauaacagauuuuccuggaaaaaccgugugguucguucccagcauuaagucgggcaaugacaucgcgaacugcuugaggaagaauggcaagcgggugauccagcugucuaggaagacguuugauacugaauaucagaaaacaaagaacaacgacugggacuacgucgugaccaccgauauuuccgagaugggggccaauuuccgcgcagaccguguuaucgauccaagacggugccucaaaccugugauucugaaggacggacccgaaagggucauacuugcugguccaaugccggugacuguagccagcgcagcccagcgccgaggcagaaucgggcggaaccacaauaaagagggagaucaguacauuuauaugggccagccucuaaacaaugacgaggaucaugcucacuggacagaagccaagaugcuguuggacaacaucaauacccccgaggguaucauuccagcguuauucgaacccgagagggaaaagucagcagccauagauggggaguaccgccugagaggcgaggcuaggaaaacauuuguggaacucaugcggcguggagaccugccuguuuggcuuaguuauaaggucgccucugagggcuuccaauacuccgaucgccgaugguguuuugacggggaaagaaacaaucaggugcuggaggaaaacauggauguggagaucuggacuaaagagggagaaaggaagaaacuccggccacgcugguuggacgcuagaacguauagcgacccccuggcacuaagggaguucaaggaauuugccgcuggucggcgaucagucaguggcgaucugauucucgagaucgggaaacuuccucagcaccugacccagagagcccaaaaugcauuagacaacuugguuaugcugcauaauagcgaacagggaggccgcgcguacaggcacgccauggaggagcucccggauacaauugaaacucugaugcuucuggcucucaucgccguguugaccggugggguaacacuguucuuacuauccggccggggacugggcaagaccucuauagggcuccuuugcgugauggcaagcuccguccuguuguggauggcuucaguggagccacauuggaucgccgcaucuauuauccuggaauuuuuccucaugguucugcuuauucccgagccugaccgucagagaacuccccaggauaaccaacucgccuauguggucaucggacuguuguuuaugauacugacgguagcugcgaaugagauggguuuacuagaaaccacaaagaaagaccugggcauugggcacguggccguugagaaccaccaucacgcagcuaugcucgauguggaccuucauccagccagugccuggacucuguacgcagucgcuaccacaaucauuaccccuaugaugaggcacacuaucgaaaacacaacggccaauauaucguugaccgcgaucgcuaaccaggccgcaauucugaugggacucgauaagggcuggcccaucagcaaaauggacauuggugugccacugcuugccuuaggguguuacucccaggucaauccucugacucucacagcugcaguguugaugcugguugcccauuaugcgaucauaggcccgggacuacaagcuaaggccacccgcgaggcacagaaacggaccgccgcuggcauuaugaagaaccccacaguggaugggaucguagccaucgaccuggauccaguggucuacgacgcaaaguucgaaaaacagcucggacagauuaugcuucugaucuugugcacuucucaaauacugcucaugcgaacgaccugggcucugugugagucaauuacauuagccacuggcccucuuaccacacugugggaggguagccccgggaaguuuuggaauaccacuaucgcgguuuccauggccaacauuuucagaggaaguuaucucgcaggcgcuggucuagccuuuucucugaugaagucauugggcgggggaaggcgcggcacgggggcacagggagaaacacugggcgagaaguggaaacggcagcucaaucagcuuagcaaguccgaguucaacaccuacaagagaagugguaucauggagguggaccguagcgaagcuaaagaggggcugaagaggggagagacuaccaaacacgccgucucucggggcacagccaaguugcgcugguucguggaacgaaaucugguaaaaccagaggguaaggugauagaucucggcugcgggagaggaggcugguccuauuacugugcgggguuaaagaaaguuacugaagugaagggauauaccaaaggcgguccugggcacgaggaacccaucccgauggcuacauacggauggaaccuggucaaacuucauucaggcaaagacguguuuuucauuccaccugagaagugcgauacgcugcuaugugacaucggcgagagcucgcccaauccaaccauugaagaggggaggacucuccggguccugaaaaugguggaacccugguugcgcggaaaccaauuuugcaucaagauucugaauccuuacaugccgucuguuguagagacacucgagcagaugcagagaaagcacgguggcaugcuugugaggaacccccugagucgaaauuccacccaugaaauguauugggucagcugugggacuggaaacaucgugucagcaguuaauaugacaucccggauguuacugaaccguuucaccauggcccacagaaaaccaacguacgagcgcgauguggacuugggcgcugguaccaggcacgucgccguggaaccugagguagcaaaccucgauauaauugggcagcggaucgaaaauaucaagcaugagcacaaaucuacauggcauuaugacgaggauaaccccuacaagacuugggccuaucacggaagcuacgaagugaaaccuaguggcuccgcuagcucuaugguuaauggcgucgugaagcugcuaaccaagccaugggacgugauucccauggucacacaaauagcgaugacugauaccacaccuuuugggcagcagagaguuuucaaagagaagguggacacccgcacuccaaaagccaagaggggaacggcacaaaucauggaaguaacagcuaaauggcuuugggguuuucugucacgaaacaagaagccccggauuugcaccagagaggaguucacuaggaaagugcgcaguaaugccgcaaucggcgccgucuuuguggacgagaaccaguggaacuccgcuaaggaggccguugaagaugagcguuucugggaccucgugcaucgggaaagagagcugcacaaacaggggaagugcgcgaccugugucuauaacaugaugggaaaaagggaaaagaaguugggcgaguuugguaaagcaaaggggagccgcgccauuugguacauguggcugggagcucgauuccucgaguuugaagcccuuggcuucaugaaugaggaucacugguucucucgggaaaacucgcugucaggcguggagggggagggauuacauaaacuggguuacaucuugagagacauaagcaagaucccgggcgggaauauguaugcagaugacacagcuggaugggauacgaggauuaccgaagacgaucuccagaacgaggccaaaaucacugacauuauggaaccugagcacgcucugcuagccaaguccaucuuuaaacuuacauaccaaaauaagguaguucgcgugcagagaccagcaaagaacggcaccgucauggaugugauaagucggagggaccagcgugguucuggacaggugggaacuuauggccugaauacauucaccaacauggaagcgcaacucauucgacagauggagagcgagggcaucuuuucccccucagaacuggagacaccuaacuuggccgggcgcgucuuagauuggcuggaaaaacauggaguugagagacucaagcggauggcuaucaguggugacgacugcgugguaaaaccaauugaugacagguucgccacugcacuuaccgcucugaaugauaugggcaaggugcgcaaagacauaccccagugggaaccgucuaagggguggaacgauuggcagcaagucccuuuuuguagccaccacuuccaucagcuaaucaugaaggacggaagagagauugugguucccugccggaaucaggaugagcuggugggcagggcccgagucucccagggugcaggguggucacuccgugaaacggccuguuugggaaaaagcuacgcgcaaauguggcagcugauguauuuucacagacgcgaccuucggcuggcugccaacgcaaucugcucugccgugccaguagauuggguuccuaccuccaggacaacuuggaguauucaugcucaccaucaguggaugaccacagaggacaugcucagcguguggaauagagucuggaucgaagagaaccccuggauggaagauaagacucacgugucguccuggggcgacguuccauacuuaggcaaacgcgaggaccaauggugugggucucugauaggauugaccgcccgggcaacgugggcuacaaauauccagguggccauuaaccaggucaggcgacugcucgguaaugagaacuaucuugauuacaugaccucaaugaagagauucaaaaaugaaagcgaccccgagggcgcgcugugguga

SEQ ID NO: 13792 - RNA, 9879 nt, Artificial Sequence
  derived and/or modified CDS sequence (opt3) from DENV-1__FJ882550__SS-prME
agcgugaccaugcugcucaugcuuaugcccaccgcacuggcuuuccacuugacuacgaggggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaaugacaacuauuuuugccggccauuuaaaaugccgucugaagauggauaaacuaacccucaaggggauguccuaugucauguguacagguagcuucaaacuggagaaggaaguggcugagacucagcacggaaccguccuugugcagauaaaguacgagggcacggacgcgccuugcaaaaucccauucucgacacaagaugaaaaggggguuacccagaacggacgcuugauuacugcaaaucccaucgugacagacaaagagaagccuguaaacauagaagccgagccacccuuuggcgagucuuauauugucaucggugcuggggaaaaagcccugaagcucuccugguucaagaaaggcucaaguaucggaaagauguuugaggcaaccgccagaggcgcuaggcggauggccauucugggggauacugcaugggacuucggaagcguggguggcguuuuuaccuccguggggaaacuuguccaucagaucuucggaacagcguacggcgugcuguuuucugguguaagcuggacgaugaagauugggauaggcguguugcucaccuggcugggauuaaauucacgaaguacuucccugagcaugacauguaucgcuguuggccuagucacccucuaccugggggugauggugcaggccgauucuggaugcgucauuaacuggaaaggccgcgaacuuaagugugguucagggaucuucguuacaaaugaggugcacacuuggaccgaacaauauaaguuucaggcagacaguccgaaaagauugagcgccgcuaucggaaaggccugggaggagggcgugugcgguauuagguccgcaacgcggcuggaaaacauaauguggaaacagaucucuaacgagcucaaucauauucuguuagaaaacgacaugaaguucacaguagucgugggcgauguuguggggauccuggcucagggcaaaaagaugauucgcccucaacccauggagcacaaauacucguggaaaagcuggggcaaggccaagaucauaggggcggacguccagaauaccacuuuuaucauugauggaccaaacaccccugaaugucccgacgaucagagagccuggaauaucugggagguggaggacuauggcuucgguauuuuuacaacuaacaucuggcuuaaguugagggauuccuacacccagguuugcgaccaccgucucaugucagcugcaauaaaagauaguaaggccgugcaugcugacaugggguauuggauugaaucugagaaaaaugaaacauggaagcuggcccgggcauccuucaucgagguaaagacguguauuuggccaaaaucccacacccuauggucaaacggaguccuggaaagcgagaugaucauacccaagaucuacggcgguccuauuucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagaucauucaugaaugguguugccgcaguuguaccuuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugacagggacccuggcuguuuuccuacugcucaucaugggacagcugacuuggaacgaucuuauucgguugugcaucauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauuggucugucauugguugccaguguggaacugccaaacuccuuagaggaacucggggauggacuggcuaugggcauaaugauccuuaagcuguugacggacuuccaaucucaccagcucugggcgacacugcuaagccugaccuuuauuaaaacuacccuuucccuccauuacgccuggaagacaauggcaaugguccugucaaucgucagcuuguucccccuguguuuaaguacuaccucucagaagacgacauggcucccggugcugcuuggcucccuggggugcaaaccuuugaccauguuucucauuacugagaauaagaucuggggaagaaaaagcuggccacugaacgaagguauaauggcuguuggcguggucucgauccuacugucaucucuucucaagaacgaugugccccuggccgggccuuugauugccggaggcauguuaaucgcuuguuauguaauuagugguuccagcgcagaccugucucucgagaaagccgcggaggugagcugggaagaggaagcugagcacuccggggccucacauaauauccuggucgaaguucaggaugacggaacaaugaagauaaaagaugaggagagggacgauacccuuacuauucuguugaaggcaacacuacuggccgugaguggcguguacccccucagcaucccagcuacccuguucgucugguauuuuuggcaaaagaaaaagcagcgaucuggcgugcuuugggacacgccuucacccccagaaguugagcgcgcaguauuagaugacgggaucuaccggauuaugcagagaggacugcucgguaggagccaggugggcgucgggguguuccaagaaaacguuuuccacacuauguggcacgugacccguggagccgucuugauguaucagggcaaacgccuggagccgaguugggcgagcgugaagaaagaccucauauccuacggugggggauggcggcugcagggcucuuggaauacaggcgaggaaguacaggucaucgcuguggagccugggaagaaccccaagaauguucaaaccgccccaggaacauuuaaaacucccgaaggugaggugggcgcaauugcccuugauuucaagccugggaccucgggaagcccaaucgucaacagagaaggcaaaauugugggucuguacgggaauggaguugugacgacaucaggcacuuaugucuccgcuaucgcccaggcaaaggcuagucaggagggccccuugccugagauagaagacgagguguuuaggaaacgaaaccuaaccaucauggaucugcauccggggucuggaaagacacggcgcuaccucccagccauuguaagagaagcgaucaagaggaaauuacggacccugauucuugcccccacucgagugguugcaagcgagauggcugaagcccugaaggguaugccuaucagauaucaaaccacagcugucaaauccgagcacacgggcaaggagauaguggaccucaugugccaugcaacuuucaccaugcgcuugcugucaccagugaggguccccaauuacaacaugauuaucauggaugaagcccacuuuacagacccuucuagcaucgccgcucguggguauauuaguacccggguaggaaugggcgaggcggcagccaucuucaugacugcuacaccgcccgguuccguggaagccuuuccacagagcaaugcaguuauacaggaugaggaaagagacauuccugagaggucuuggaacucaggguacgaguggaucaccgauuuccccggaaaaacggugugguuugucccauccauuaagaguggcaaugacaucgccaacugucuccgcaagaauggcaaacgagugauacagcugagcagaaagacuuucgauacagaauaucagaaaaccaagaacaacgacugggacuacguugugaccacugauauuucggagaugggggcuaauuuucgggcggacagggucaucgauccucgccguugccuuaaacccgugauccuaaaggacggaccagaaagaguaauucuggccgguccgaugccugugacaguugcaucugcugcccagcggaggggccgcaucgggcgaaaccauaauaaggagggagaucaguacauuuauaugggccagcccuugaacaaugacgaggaucacgcacacuggaccgaagccaaaauguuacuggacaacauaaauacaccagaggguaucauucccgcucucuucgaaccugagagagaaaaguccgccgcgaucgauggggaguaccggcugaggggcgaggcacgcaaaacuuucgucgaacuuaugagaaggggagaccugccaguguggcucagcuauaagguggccucagagggcuuucaauacagugaucggcguuggugcuucgacggggaacgcaacaaucaggucuuggaggaaaacauggauguugagaucuggacgaaagagggagaacgaaagaaacugagacccagguggcuagacgcucggaccuauucugacccucuggcccuccgcgaguuuaaggaguucgcugcagguagaagguccgugagcggcgaucuuauucuggagauagggaaguuaccgcagcauuugacacagcgggcccaaaaugcucuggacaaccucguaaugcugcacaauucagaacagggaggccgagccuacagacaugcaauggaggagcuuccagauacuaucgaaacccugaugcucuuggcgcugauugccguguuaacagguggggucacccuauuuuuccugaguggccgcggacucggcaaaacuagcaucgggcuucugugugugauggcuuccucuguuuugcuguggauggccagcguggagccccacuggauugcagcuuccaucauacucgaauuuuuccugaugguccuucucaucccugagcccgacaggcagcggacgccacaggauaaccaacuggccuauguagugauuggauugcuguuuaugaucuuaaccguugcagccaaugagaugggucuacuggaaacaacuaagaaagaccucggcauugggcacguggcugucgagaaccaucaccaugcgaccaugcuugauguggaccugcacccugccucagcauggacauuguacgcugucgccaccacuaucauaacacccaugaugcgucauacgauugaaaacaccacugccaauaucucucugacagcaauugcuaaccaggccgcgauccucaugggacuggauaagggcuggccaauaaguaaaauggacaucggugugccucuuuuagcucuggggugcuacucgcagguuaauccgcucaccuugaccgccgcagugcugaugcuaguagcccacuaugcuauuaucggccccggacugcaagcaaaggccacaagagaggcgcagaagaggacugcugccggcauuaugaaaaacccaacgguggaugggaucgucgcaauagaccucgauccuguuguguacgacgccaaguucgaaaaacagcuuggacagauuaugcuguugauccuguguaccagccaaauccuccugaugcgcacaacuugggcuuuaugcgaguccauuacccuugccacaggcccccugaccacucucugggaggguucuccagggaaguuuuggaauacgacaaucgcagucucaauggcuaacauauuccggggaagcuaucuagccggcgcgggucuggccuuuuccuugaugaaaagucugggcgggggacgaagaggcaccggggcacagggagaaacucucggcgagaaguggaagaggcagcuuaaucagcugucuaaaagcgaguucaacauuuacaagcgcucagguaucauggagguggaccgguccgaagcuaaagagggguugaagagaggagagaccacacgucacgccguaaguaggggcacugcaaaacugcggugguucguggaacgcaaucucguuaagccugaggguaaggugauugauuuaggcugugggcgaggaggcuggagcuauuacugcgcugggcugaaaaaggucaccgaagugaaaggauauacaaagggcggucccgggcaugaggaaccgaucccaauggccacguacggauggaaccuugucaaacugcacucuggcaaggacguguuuuucaccccucccgagaaaugugauacucuacucugcgacauaggcgaguccucaccaaaucccacaaucgaagaggggagaacccugaggguuuugaagaugguagaaccuuggcugcggggaaaccaauuuuguauuaagauccucaauccguacaugcccagcguggucgagacucuugagcagaugcagcgcaaacaugguggcaugcuggugagaaacccauuaucgagaaauucuacacacgaaauguauuggguuaguugcgggaccggaaacauuguguccgccgucaauaugacgagccgaaugcuguugaaccgguucaccauggcgcaccguaagccuacauacgagagagauguggaccucggcgcugguacucgccauguagcaguggaacccgagguugccaaccuggauaucauugggcagaggaucgaaaauauaaaacacgagcauaagucaaccuggcacuaugacgaggauaacccuuacaaaacaugggcuuaucauggauccuacgaagucaagccaucuggcagcgccaguuccauggugaauggcguggucaagcuacuuacuaaacccugggacguuauuccuauggugacccaaaucgcaaugacagauaccacuccauuugggcagcagcggguauucaaggagaaaguggacacgagaacacccaaggccaaacgcggaaccgcucaaaucauggaagucacugcgagguggcugugggguuuucucagccgaaacaagaagccgcggauuuguaccagagaggaguucacaaggaaagugcgcucuaaugccgcaauaggcgcuguuuuuguggacgagaaccaguggaacucagccaaggaggcagucgaagaugagcguuucugggaccuggugcagaaagaacgggaguugcacaagcaggggaaaugcgccacgugcguauauaacaugaugggaaagagagaaaagaaacugggcgaguuugguaaggcuaaagggaguagggccaucugguacauguggcucggagcgcgcuuccuugaguuugaagcacugggcuucaugaaugaggaucacugguucucccgagaaaacagcuuaucuggcguugagggggagggacugcauaaguuggguuacauucuccgggacaucucgaaaauuccuggcgggaauauguaugccgaugacaccgcuggaugggauacuagaaucacagaagacgaucugcaaaacgaggccaagauaaccgacaucauggaaccagagcacgcacuacuugcuacuucaauuuuuaaacugacauaccagaauaagguggucagggugcagcgccccgccaagaacggcaccgugauggaugucaucagcagacgggaccagagggguuccgggcaaguuggaacauauggccucaauacuuucaccaacauggaagcucagcugauucgucagauggagagugagggcaucuuuuugccuucugaauuagagacgccaaaccuggccgaacgagugcucgauuggcuugagaaauacgggguagaacgccugaagagaauggcaauaagcggagacgacuguguggucaaacccauugaugaccgguucgcgaccgcccuaacagcucugaaugauauggguaaggugaggaaagacaucccgcagugggagccuuccaagggcuggaacgauuggcaacagguucccuuuugcucacaucacuuccaccagcucaucaugaaggacgggcgcgagauuguggucccauguagaaaucaggaugaauuggugggacgggccaggguaagucaaggcgcagguuggucucugcgagagacugcuugccuugggaaaagcuaugcccagauguggcagcugauguacuuucaucguagagaccuccgcuuagcagccaacgcgauauguuccgcuguuccuguggauuggguccccaccucacggacaacuuggagcauccacgcccaucaccaauggaugaccacggaagacaugcugucuguguggaauaggguuuggauugaggaaaacccauggauggaggauaagacacauguguccaguuggggagacguccccuauuugggcaaaagagaggaccaguggugcggcagccugaucgggcucaccgcacgcgccacuugggcuucgaauauucagguggccaucaaccagguacggaggcuuauaggaaaugaaaacuaccuggauuacaugacauccaugaagcgauucaaaaaugagggugacccugaaggcgcacuaugguga

SEQ ID NO: 13793 - RNA, 9879 nt, Artificial Sequence
  derived and/or modified CDS sequence (opt3) from DENV-1__FJ882551__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuacuucccaacacaauuaccgaccaggcuacuucacacagaccgccgggccguggcaucucggaaaacuggagcuugauuuugacuugugcgaaggcacuacagucgugguggaugagcacugcgggaacagaggacccagucugaggaccacgacugucaccggcaagaucauucacgaaugguguugccgcagcuguacauuaccuccacuccgguucaaaggugaggacgggugcugguauggaauggagaucagacccguuaaggaaaaggaggaaaaucuggugaaaucuaugguauccgcuggcucaggugagguggacaguuuuagccuuggccuguuguguauaucgauuaugaucgaagaggucaugaggucccgcuggucucgaaagaugcucaugaccgggacucuggccguguucuuucuacugaucauuggacagcucacauggaacgaucugauccggcuuugcauuaugguuggcgcaaaugcuagcgaccguauggggaugggaaccacauacuuggcccugauggcaacuuucaaaaugagaccuauguuugccgugggcuuacucuucaggcgccugaccucacgggagguccuucugcuaacgauaggucucagucugguggcuuccguugaauugccaaacucucuggaggaauuaggggauggacucgcgaugggcaucaugauucugaagcuucugacagacuuucaaagccaucaguugugggccacccuccugucccuaacuuucaucagaaccacauuuucacugcacuaugcauggaaaacuauggcuauggugcuuagcauugucagucucuucccccuguguuugucuaccacgucccagaagacaaccuggcugccgguauuacucggcagccuggggugcaagccucuuacuauguuucugaucgccgagaauaaaauauggggaaggaagucguggccauugaacgaagguaucauggccgugggcauuguuucaauccuccugucuagucuacugaaaaacgaugugccccuugcugggccucucauugcaggaggcaugcugaucgccuguuacgucauauccgguagcucugcggacuugagcuuagagaaggcugccgugguauccugggaggaagaggcagaacauucaggggccagucacaauauucugguggagguccaggaugacggaacaaugaaaaucaaggaugaagagcgagacgauacccucacuauccugcuuaaagcuacacuguuggcaguuagcggcguguauccccuaucuauuccagccacccuguucgugugguacuucuggcaaaagaagaaacagcgcuccggcguccucugggacacgccuucacccccagagguggaacgggcgguucuggaugacgggauauauagaaucaugcagaggggacuuuuaggucguagucagguaggcgugggggucuuucaagagaacguguuccauacuauguggcacguuacccgcggagcugugcugauguaccagggcaagcggcucgaaccgagcugggccuccgucaaaaaggacuugauuucuuacggugggggauggagacugcagggcucguggaauacaggcgaggaggugcagguaaucgcagucgaaccugggaaaaaccccaagaaugugcaaaccgccccaggaacauuuaagacuagcgagggugaaguuggcgcuauugcccucgauuucaaacccgggaccucaggauccccuaucgugaacagggagggcaagauagucggucuguaugggaauggagugguuacgacaaguggcacuuacgugucugcaaucgcucaggccaaagcgagccaggaaggcccacuucccgagauugaggacgaagucuuucgaaagcggaaccugaccaucauggauuugcacccuggguccggaaaaacacgcagauaucuaccggccauugugagggaggcaaucaagcggaagcugcgaacccucauauuagcuccaacuagaguaguggccucagaaauggcugaggcacugaaagguaugcccauucgcuaccaaaccacagccguuaagucugaacauacgggcaaagagaucgucgaccuuaugugccacgccacuuucaccaugaggcugcucagcccugugcgugugccaaauuauaacaugaucauuauggaugaggcucauuuuacagaccccaguuccaucgcggcacggggguacauaagcaccagagucggaaugggcgaagccgcugccauuuucaugacugcaacaccuccggguucuguagaggccuuuccccagucaaaugcugugauccaggaugaagagagggacauuccagaacgcuccuggaacaguggguaugaguggaucaccgauuucccuggaaagacgguuugguuugugcccagcauaaaaucgggcaaugacauugcgaacuguuugcgaaagaauggcaagagagucauccagcugucucggaaaacuuucgauacagaguaccaaaagaccaaaaacaacgacugggacuacgugguuaccacugauaucuccgaaaugggggccaauuucagggcagaccgcgugauugauccacguagaugccucaagccugucauccugaaagacggacccgagcgggugauucuugcugguccaaugccgguaacaguggccagcgcagcccagaggcgcggccgaauagggagaaaccacaauaaggaaggagaucaguauaucuacaugggccagccucuaaacaaugacgaggaucaugcucacuggaccgaggccaagaugcuguuggacaacauuaauacacccgaagguaucaucccagcguuauuugagcccgaacgggagaaaucagcagccauugauggggaauauaggcugcgcggcgaggcuagaaagacuuucguugagcucaugaggcggggagaccugccugucuggcuuagucacaaaguggccucugaaggcuuucaauacuccgaucgucgcuggugcuucgacggggagcgaaacaaucaggugcuggaagagaacauggaugucgaaauauggacgaaggagggagagagaaaaaagcucaggccacggugguuggacgcucgcaccuauagcgacccccuggcacuaagagaauuuaaagaguucgccgcugguaggcggucaguuaguggcgaucugauccucgaaauugggaagcuuccucagcaucugacacagcgagcccaaaaugcauuagacaacuuggugaugcugcacaauagcgagcagggaggcagagcguaccgccaugccauggaagagcucccggauacuaucgagacccugaugcuucuggcucucauugccguauugacagguggggugacccuguuuuucuuauccggcaggggacuaggcaagacuucuaucgggcugcucugugucauggcaagcuccgugcuucuguggauggcuucaguugaaccacacuggauagccgcaucuaucauuuuggaguuuuuccugauggugcuccugauccccgaaccugaccggcagcguacgccccaggauaaccaacuugccuaugucguaauuggacuccuguuuaugaucuugaccguggcugcgaaugagaugggucuguuagagacaacuaaaaaggaccuaggcauagggcacguugccguggaaaaccaucaccaugcagcuaugcuggaugucgaccuccacccagccagugccuggacccuuuacgcaguggcuacaaccauuaucacuccuaugaugagacauacaauugagaacacgaccgccaauaucucgcugacugcgauagcuaaccaggccgcaaucuugaugggacuggauaaaggcuggcccauuagcaagauggacaucggugucccacuccuggcccuugggugcuacucccaggugaauccuuuaacacugaccgcugcaguucucauguugguggcccacuaugcgauuaucggcccgggacugcaagcuaaagccaccagggaagcacagaagcgcacagccgcuggcauaaugaagaaccccacuguagaugggauuguggccaucgaccuagauccagucguuuacgacgcaaaauucgagaagcagcugggacagaucaugcuccuuauucuguguacgucucaaaucuugcugaugcggaccacaugggcucucugcgaaucaauaacucuggccaccggcccuuuaacaacccuuugggaggguagccccgggaaauuuuggaauacuacgauugcgguguccauggccaacaucuuccgaggaaguuaucuggcaggcgcuggucucgccuucucucuaaugaagagccugggcgggggaagaaggggcacaggggcacagggagagaccuugggcgaaaaauggaagcgccagcugaaucagcucucaaaguccgaguuuaacacuuacaaacggagugguauuauggaagucgacagaagcgaggcuaaggaagggcuuaaacguggagagaccacaaagcacgccgugucuaggggcacugccaaacugcggugguucguagagcgcaauuuggugaagccagaagguaagguuaucgaucugggcugugggcgaggaggcugguccuauuacugcgcggggcucaaaaaggugaccgaggucaaaggauauacaaagggcgguccugggcaugaagagcccauaccgauggcuacguacggauggaacuuagugaaacugcacucaggcaaggacgucuuuuucaucccaccugaaaaaugugauacccuucugugcgacauuggcgagagcucgcccaauccaacuaucgaggaagggagaacacuaagggugcucaagaugguugagcccuggcugcggggaaaccaauuuuguauuaagaucuugaauccuuacaugccgucuguaguggaaacccuggagcagaugcagcgcaaacaugguggcaugcucgucagaaacccccuuaguaggaauuccacucacgagauguauugggugagcugcgggacaggaaacauuguuucagcagugaauaugaccucccgaaugcuguuaaaccgguucacgauggcccaccguaagccaaccuacgaaagagaugucgaccugggcgcugguacacgccauguggccguagagccugaaguggcaaacuuggauaucauagggcagaggauugagaauaucaaacaagaacacaagucuacuuggcauuaugacgaggauaaccccuacaaaaccugggccuaucacggaagcuacgagguuaagccuaguggcuccgcuagcucuauggucaauggcguggugaagcuccugacaaaaccaugggacgucauccccaugguuacucagauugcgaugaccgauacaaccccuuuugggcagcaacggguguucaaggaaaaaguagacacuagaacgccaaaggccaaacgcggaacagcacagauaauggaggugaccgcuaaguggcuaugggguuuucuuucaaggaacaagaaaccccgaaucuguacucgggaagaguucaccagaaaggucaggaguaaugccgcaauuggcgccguguuuguugacgaaaaccaguggaauuccgcuaaagaggccguggaggaugaacgcuucugggaccugguccaucgugagcgggaacuccacaagcaggggaaaugcgcgacaugcguguauaacaugaugggaaagagagagaagaaacugggcgaauuugguaaggcaaaagggagcagggccaucugguacaugugguugggagcucgcuuccuggaguucgaggcccucggcuuuaugaaugaagaucacugguucucucgagagaacucgcuuucaggcguagaaggggagggacugcauaaguuagguuacauucugcgggacaucagcaaaauaccgggcgggaauauguaugcagaugacacggcuggaugggauaccagaaucacugaggacgauuugcaaaacgaagccaagauuacagacaucauggagccugaacacgcucuccuggccaaauccauuuuuaagcuaaccuaccagaauaagguugugaggguccagcgcccagcaaaaaacggcacugugauggaugugaucaguagacgggaccagagggguucugggcaagucggaacauauggccuuaauaccuucacaaacauggaggcgcagcugauacgucagauggaaagcgagggcauuuuuucccccucagagcucgaaacuccuaaccuggccgggcgaguuuuggauugguuaaagaaacauggaguggagcgccugaagagaauggcuaucaguggugacgacuguguagugaaaccaaucgaugaccgguucgccaccgcacucacggcucuuaaugauaugggcaaggucaggaaggacauuccccagugggaaccgucuaaaggguggaacgauuggcaacaggugccuuuuugcagccaccacuuccaucagcugauaaugaaggacggacgcgagcuaguugugcccuguagaaaucaggaugaacuggucggccgggccagggugucccaaggugcaggguggucacuccgagagaccgccugcuugggaaaaagcuacgcgcagauguggcagcugauguauuuucaccguagagaccuucgccuggcugccaacgcaaucuguucugccguaccaguugauugggugccuacaucccggacuaccuggaguauucaugcucaccaucaauggaugacaacugaggacaugcucagcgucuggaauaggguguggaucgaagagaaccccuggauggaagauaagacccacauuucguccuggggcgacguuccauacuuaggcaaaagagaggaccaguggugcgggucucugaucggauugacggcccgcgcaacaugggcuaccaauauacagguggccaucaaccagguccggaggcugcucgguaaugaaaacuaucuugauuacaugacuucaaugaagcgauucaagaaugagagcgaccccgagggcgcgcugugguga

SEQ ID NO: 13794 - RNA, 9879 nt, Artificial Sequence
  derived and/or modified CDS sequence (opt3) from DENV-1__FJ882552__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuugggugacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacaucaagccuacacuaugcauggaagacuauggcuauggugcugaguaucgucucucuuuucccccucugucuguccaccacgagccagaaaacaaccugguugccgguacuguuaggcucgcucgggugcaagccucugacuauguuucuuauugccgagaauaaaaucuggggaagaaagucauggccacugaacgaagguauaauggccgugggcaucguuucuauuuugcucaguucccugcucaagaacgaugugccccuggcugggccucuuaucgcaggaggcaugcucauugccuguuacgucaucagcgguucuagcgcggaccuguccuuggagaaggcugccgaggugucaugggaagaggaagcagagcauaguggggccagccacaauauauuaguagaagugcaggaugacggaacaaugaaaauuaaggaugaggagagggacgauacccugacuauccuccugaaggcuacacuucuggcagucucuggcguuuaucccuuguccaucccagccacccuauucgugugguacuucuggcagaaaaagaaacaacgaucaggcgugcugugggacacgccuagucccccagaagucgagcgcgcggugcucgaugacgggauuuaucggauaaugcagagaggacugcuugguaggagccagguuggcguagggguguuucaggaaaacgucuuccauacuauguggcacgugacccguggagcuguuuuaauguaccaaggcaagcgccuggagccguccugggccucugugaaaaaggaccucaucucguacggugggggauggcgguugcagggcagcuggaauacaggcgaggaaguccaggugauugcaguagagccugggaagaaccccaaaaauguccagaccgccccaggaacauuuaagacuucagaaggugaggugggcgcuaucgcccuggauuucaaacccgggaccuccggaaguccuauuguuaacagagaaggcaagaucgugggucucuaugggaauggagucgugacgacaucuggcacuuacguuagcgcaauagcucaagccaaagcgucccaggagggcccacugcccgagaucgaagacgagguguuuaggaagcgaaaccuuaccauuauggaucugcacccugggucaggaaagacacggcgcuauuugccggccaucgucagagaagcaauuaaaaggaagcuacggacccugauccucgcuccaacucgagugguagccucugagauggcugaagcauuaaaagguaugcccauaagauaccagaccacagccguaaagagcgagcauacgggcaaagagauuguugaccugaugugccacgccacuuucaccaugcgccuucugaguccugucagggugccaaauuauaacaugaucaucauggaugaagcucauuuuacagaccccuccagcauugcggcacguggguacaucucuacccgggugggaaugggcgaggccgcugccauauucaugacugcaacaccuccggguucagucgaagccuuuccccaauccaaugcuguaauucaggaugaggaaagagacaucccagagaggaguuggaacagcggguaugaguggauuaccgauuucccuggaaagacggugugguuuguucccucgaucaagucuggcaaugacauagcgaacugucuccgcaaaaauggcaagcgagugauucaguuguccagaaaaacuuucgauacagaauaccagaagaccaaaaacaacgacugggacuacgucgugaccacugauaucagcgagaugggggccaauuuccgggcagacaggguuaucgauccacgccguugccugaagccugugauucucaaggacggacccgaaagagucauccuggcugguccaaugccggugacaguagccucagcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguuugaacccgagagagagaagagugcagccaucgauggggaguaucgguuaaggggcgaggcucgcaagacuuucguggaacugaugagaaggggagaccucccuguuuggcugucuuacaaagucgccuccgagggcuuucaguauagcgaucggcguuggugcuucgacggggaacgcaacaaucaagugcuugaggaaaacauggauguggagauuuggacgaaggagggagaacgaaagaaacugagaccaagguggcucgacgcucggaccuacucagaccccuuggcacugcgcgaguuuaaagaguucgccgcugguagaaggagugucagcggcgaucuaauacuggagaucgggaaacucccucagcaccuuacacagcgggcccagaaugcacuggacaacuuaguuauguugcauaauuccgaacaaggaggccgagcguauagacacgccauggaggagcugccggauacuauugaaacccucaugcugcuugcucugaucgccgugcucacaggugggguaaccuuguuuuuccugucuggccgcggauuaggcaagacuagcauugggcuacugugugugauggcauccucaguccuccuuuggauggcuucuguggagccacauuggaucgccgcaaguauaauccuggaauuuuucuugaugguucugcucauucccgagccugacaggcagcggacgccccaggauaaccagcuggccuacguggucaucggacuucucuuuaugauucugaccguagcugcgaaugagauggguuugcuggaaacaacuaaaaaggacuuaggcaucgggcacguggccguugagaaccaccaucacgcagcuaugcuagauguggaccugcauccagccucggccuggacccucuacgcagucgcuacaaccauaauuacuccuaugaugcgucacacaaucgaaaacacgaccgccaauauuagccuuacugcgaucgcuaaccaagccgcaauacugaugggauuggauaaaggcuggcccaucuccaagauggacauuggugugccacugcucgcccuggggugcuauucucaggucaauccucuuacauuaaccgcugcagugcugaugcucguugcccauuacgcgaucauuggcccgggauugcaggcuaaggccaccagagaggcacagaaaaggacagccgcuggcaucaugaagaaccccacuguggaugggauaguagccauugaccuggauccaguggucuaugacgcaaaauucgaaaagcagcuaggacagaucaugcugcucauccuuuguacgucacagauucuguugaugcgcaccacaugggcucugugcgagagcaucacucucgccaccggcccucugacaaccuuaugggaggguucccccgggaaauuuuggaauacuacgauagcgguuaguauggccaacauuuuccggggaucuuaccuugcaggcgcuggucuggccuucagccucaugaagucacuaggcgggggacgaagaggcacaggggcacaaggagaaacccugggcgagaaguggaaaaggcaguugaaucagcuguccaagagugaauuuaacacuuauaaacgcagcgguaucauggagguggaccggucugaagcuaaggaggggcucaaaagaggagagaccacaaaucacgccgucucccguggcacugccaaacuuaggugguucguggaacggaaccugguaaagccagaggguaaagugauugauuugggcugugggcgcggaggcuggucauacuauugcgcggggcugaagaaaguuaccgaagugaagggauacacaaaaggcgguccugggcacgaggaacccaucccgauggcuacguacggauggaaucucgucaaguuacauagcggcaaagacguguuuuucauaccaccugagaagugugauacccugcuuugcgacaucggcgagucgucucccaacccaacuauugaagaggggcgaacacugagaguccuaaagaugguggaacccuggcucaggggaaaucaguuuuguaucaaaauucugaacccuuauaugccgaguguuguagagaccuuggagcaaaugcagcggaagcacgguggcaugcuggugcgcaauccccucuccagaaacagcacucaugaaauguacugggucucaugcgggacaggaaauaucguguccgcaguuaacaugaccucuaggaugcuucugaaccgauucacgauggcccaccggaaaccaaccuaugagcgugauguggacuuaggcgcugguacaagacacgucgccguggaaccugagguagcaaaucuggauauuaucgggcagcgcauagaaaacauuaagcaugagcacaaaagcacuuggcauuacgacgaggauaaucccuauaagaccugggccuaccacggaaguuaugaagugaagccuuccggcagcgcuucuucaaugguuaacggcgucgugaaauugcucacaaagccaugggacgugauccccauggucacucagaucgcgaugaccgauacaaccccuuuugggcaacagaggguuuucaaagagaagguggacacucggacgccaaaagccaagagaggaacagcacagauuauggaaguaaccgcuaaguggcugugggguuuucuaagucgcaauaaaaagcccaggauauguacucgagaggaguucacccggaaagugagauccaacgccgcaaucggcgccgucuuuguggacgagaaucaauggaacagcgcuaaggaggccguugaagaugagagguucugggaccuugugcaucgcgaacgugagcugcacaaacaggggaagugcgcgacaugcgucuacaauaugaugggaaagcgggagaaaaagcucggcgaguuugguaaagcaaaggggucuagagccauuugguacauguggcugggagcuagguucuuggaguucgaagcccugggcuuuaugaacgaggaucacugguucucgcgcgaaaauucacucagcggcguggagggggagggacuucauaaacuggguuauaucuuacgagacauuuccaagaucccgggcgggaacauguacgcagaugacacggcuggaugggauacccggauaacugaagacgaucugcagaaugaggccaaaaucacagacauuauggaaccugagcacgcuuugcucgccaagaguaucuuuaagcugaccuaucagaacaaaguaguuagagugcaaaggccagcaaagaauggcacugucauggaugugauuucucgcagagaccagcgggguagcggacaggugggaacauacggccuaaacaccuucacaaacauggaagcgcagcuuaucaggcaaauggaguccgagggcauauuuucacccagugaacuggagacuccuaaucucgcccgucgaguccuggauugguuggaaaaacaugggguugagcgcuuaaagagaauggcuauuucuggagacgacugugugguaaaaccaaucgaugaccgguucgccaccgcacugacggcucucaacgauauggguaaggugaggaaggacaucccccagugggaaccgagcaaaggcuggaaugauuggcagcaggucccuuuuugcucccaccacuuccaucaacuuauuaugaaggacgggcgcgagauagugguucccuguagaaaccaggaugagcuggugggacgggccagggucucacagggcgcagguuggagccuacgagaaaccgccugccuggggaaaucuuaugcgcagauguggcaacucauguacuuucaccguagagacuugcgccuggcugccaaugcaaucuguuccgccgugccaguagauuggguuccuacaagucggacuaccuggagcauucaugcucaccaucaguggaugacaacugaggacaugcuuucgguguggaacagggucuggaucgaagagaaucccuggauggaagauaagacccacauuuccucuuggggagacgugccauaucugggcaaaagagaggaccaguggugcggcucacucaucggguuaacggcccgcgcaacaugggcuaccaacauacaaguugccaucaaucaggugcggaggcugauuggaaacgagaauuacuuggauuacaugacuagcaugaagcgauucaagaacgaaagugaccccgagggugcgcugugguga

SEQ ID NO: 13795 - RNA, 9879 nt, Artificial Sequence
  derived and/or modified CDS sequence (opt3) from DENV-1__FJ882553__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucagaaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuacuuggcucugauggccaccuucaaaaugcgcccuauguuugcagugggcuuacucuuccggagacugacgagcagggagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaaaacaacuuuuucccugcacuaugccuggaagaccauggcaauggugcuuucaauugucagccucuucccccuguguuugaguacgacaucucagaaaaccacuuggcugccgguauuacucggcucccuggggugcaagccucuuacaauguuucugaucgcugagaauaagauauggggacgacgcagcuggccauugaacgaagguaucauggccgugggcauuguuucgauccuccugucaucucuacugaaaaacgaugugccccuugccgggccucucauugcuggaggcaugcugaucgcauguuacgucauaagugguuccagcgccgacuugucuuuagagaaggcggcugaggugagcugggaagaggaagccgagcauuccggggcaucacacaauauucugguagaagugcaggaugacggaaccaugaaaaucaaggaugaggagcgggacgauacucucacaauccugcuuaaagccacccuguuggcugucaguggcguuuauccccuaagcauuccagcaacgcuguucgugugguacuucuggcaaaagaaaaagcagagaucuggcgugcucugggacacuccuucacccccagaagucgagagggccgugcuggaugacgggauauaucguaucaugcagcgcggacuuuuaggucggagccagguuggcguagggguguuucaagaaaacgucuuccauaccauguggcacgugacaagaggagcgguucugauguaccagggcaagaggcucgagccgaguugggcuagcgugaaaaaggacuugauuuccuacggugggggauggcgacugcagggcucuuggaauaccggcgaggaaguccaggugaucgccguagagccugggaaaaaccccaagaauguccaaacagcaccaggaacuuuuaaaacccccgaaggugaggugggcgccauugcucucgauuucaagccugggacgucgggaagcccaaucguuaaccgggaaggcaagauagugggucuguaugggaauggagucgugacaacuucaggcaccuacguuuccgccaucgcacaggcuaaagccagucaggagggcccccuuccugagauugaagacgagguguuucgcaagagaaaccugacaaucauggauuugcacccggggucuggaaaaaccaggcgguaucuaccagcgauuguccgagaagccaucaagagaaaacugcgcacucucauauuagcacccaccagggugguagcuagcgagauggccgaagcucugaaggguaugccuauucguuaccaaacaacggcagugaaguccgagcauacuggcaaagagaucguugaccuuaugugccacgccaccuucacaaugcggcugcucucaccagucagagugcccaauuauaacaugaucauuauggaugaagcccauuuuaccgacccuucuagcaucgcugcgaggggguacauaaguacucgcgugggaaugggcgaggcagccgcuauuuucaugacagccaccccgcccgguuccgucgaagcauuuccacagagcaaugccguaauccaggaugaggaacgagacauuccugagagaucuuggaacucaggguaugaguggaucacggauuuccccggaaagacugugugguuuguuccauccauaaaaaguggcaaugacauugcuaacuguuugcggaagaauggcaaaagggugauccagcugagccgcaagacauucgauaccgaauaccaaaagaccaaaaacaacgacugggacuacgucgugacuacagauaucucggagaugggggcgaauuuccgugccgacagaguuauugauccucggaggugccucaagcccgugauccugaaagacggaccagaacgcgucauucuugcagguccgaugccugugaccguagcuucugccgcacagcgaagaggccggauagggaggaaccacaauaaggagggagaucaguauaucuacaugggccagccccuaaacaaugacgaggaucaugcccacuggacagaagcuaaaaugcuguuggacaacauuaauacuccagaggguaucauccccgccuuauuugaaccugagcgcgaaaaguccgcggcaauugauggggaguauagacugaggggcgaggcccggaagacguucguggaacucaugcgucgcggagaccugccaguuuggcuuagcuacaaagucgcuucagagggcuuucaauauagugaucgaagauggugcuucgacggggaaaggaacaaucaggugcuggaggaaaacauggauguggagauauggaccaaggagggagaacggaaaaagcuccgccccagaugguuggacgccaggacauacucugacccucuggcucuacgggaguuuaaagaguucgcagccggucgaagauccgucagcggcgaucugauccucgagauugggaaacuuccgcagcaccugacucagcgcgcucaaaaugccuuagacaacuugguuaugcugcauaauucagaacagggaggcagggcauaucggcacgcgauggaggagcucccagauaccaucgaaacacugaugcuucuggcccucauugcuguguugaccggugggguaacucuguuuuucuuaaguggccguggacuaggcaaaacgagcaucgggcugcucugugugauggccuccucuguccuucuguggauggcaagcguggagccccauuggauagcugccuccaucauuuuggaauuuuuccugaugguucuccugaucccugagcccgacagacagaggaccccacaggauaaccaacuugcauacguggucauuggacuccuguuuaugaucuugacaguagccgcuaaugagaugggucuguuagaaacuaccaagaaggaccuaggcauagggcacguggcgguugagaaccaccaucacgccgcaaugcuggauguggaccuccauccugcuucagccuggacacuuuacgccgucgcaaccacuauuaucacacccaugaugcgccacacgauugaaaacaccacugcuaauaucucucugacagccauagcgaaccaggcugccaucuugaugggacuggauaaaggcuggccaauuaguaagauggacaucggugugccucuccuggcacuugggugcuauucgcaggucaauccguuaacccugaccgccgcugugcucauguugguugcacauuacgccauuaucggccccggacugcaagcgaaagcuacacgggaggcccagaagcgaacugcagccggcauaaugaaaaacccaacgguggaugggauuguagcuaucgaccuagauccuguggucuaugacgccaaguucgaaaagcagcugggacagaucaugcuccuuauucuguguaccagccaaaucuugcugaugagaacaacuugggcacucugcgaguccauaacccuggcuacaggccccuuaaccacucuuugggaggguucuccagggaaauuuuggaauacgacaauugccguuucaauggcgaacaucuucaggggaagcuaccuggccggcgcaggucucgcuuucucccuaaugaagagucugggcgggggacgccggggcaccggggcccagggagaaacuuugggcgagaaauggaagagacagcugaaucagcucucuaaaagcgaauuuaacaccuauaagcguucagguauuauggagguggacagguccgaagcaaaggaggggcuuaaacggggagagacaacuaagcacgcugucagucgcggcaccgccaaacugcgaugguucguggaaagaaauuugguaaagccugaggguaaagugaucgaucugggcugugggaggggaggcuggagcuacuauugcgccgggcucaagaagguuacagaagugaaaggauacacgaagggcggucccgggcacgaggaaccgauaccaauggcgaccuacggauggaacuuagucaaacugcauucuggcaaggacguguuuuucaucccucccgagaaaugugauacucuucugugcgacauuggcgaguccucaccaaaucccacaaucgaagaggggcggacccuacgcguccucaagaugguggaaccuuggcugagaggaaaccaauuuuguauuaaaaucuugaauccguauaugcccagcguuguagagacucuggagcagaugcagaggaagcacgguggcaugcucgugcgaaacccacuuucgagaaauucuacacaugaaauguacugggucaguugcgggaccggaaacauuguguccgcuguuaauaugacgagccguaugcuguuaaacagauucaccauggcacaccgcaagccuacauaugagagggauguggaccugggcgccgguacucggcacgucgcuguggaacccgagguagccaacuuggauaucauagggcagagaauugaaaauaucaaacaugagcacaagucaaccuggcauuacgacgaggauaacccuuauaaaacaugggcauaccacggauccuaugaagugaagccaucuggcagcgccaguuccaugguuaauggcgucgugaaacuccugacuaagcccugggacgugaucccuauggucacccaaauugcuaugacagauaccacuccauuugggcagcagcgcguuuucaaggagaaaguggacacgaggacacccaaggcgaaacgaggaaccgcccaaauaauggaaguaacugcaaaguggcuaugggguuuucuuagccggaacaaaaagccgagaaucuguaccagggaggaguucacacgcaaggugcguucuaaugcugccauuggcgcagucuuuguggacgagaaccaguggaacucagccaaagaggcuguugaagaugagcgguucugggaccuggugcauagagaaagggagcuccacaagcaggggaaaugcgccacgugcgucuacaacaugaugggaaagcgcgagaagaagcugggcgaguuugguaaggcgaaagggagucgagcaaucugguacaugugguugggagcccgguuccuggaguucgaagcucucggcuuuaugaaugaggaucacugguucuccagagaaaacagccuuucuggcguggagggggagggacugcauaaguuagguuauauucugagggacaucucgaaaauaccuggcgggaauauguacgccgaugacaccgcaggaugggauacucgcaucacagaagacgauuugcagaacgaggcuagaauuaccgacaucauggaaccagagcacgcccuccuggcuaagucaauuuuuaaacuaacuuaucaaaauaagguaguucgggugcagaggcccgccaaaaacggcacagucauggaugugaucagccgucgagaccagcgcgguuccggacaggugggaaccuacggccuuaauacauucacuaacauggaagcacaacugauaagacagauggagagugagggcauauuuucuccuagcgaacucgagaccccaaaccuggcggaacgggucuuggauugguuagagaaguaugggguugaaaggcugaagcgcauggccaucuccggagacgacugugugguaaaacccaucgaugacagauucgcuacggcccucaccgcacuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugcuagagucucucagggcgccgguuggagccugcgcgagacagcaugccucgggaaguccuacgcccaaauguggcaguugauguauuuucaucggagggaccugagacuugcggcuaacgccauuuguucagcagugccuguagauuggauccccacuagccgcaccacauggucuauucacgcccaucaccaguggaugacuaccgaagacaugcuguccguuuggaaucggguguggaucgaggaaaacccauggauggaggauaagacgcauauaaguagcuggggagacguccccuaccucggcaaaagggaggaccaauggugcggcucguuaaucgggcugacagcucgagccaccugggcaacuaauauucagguggcuaucaaccagguuagacgguugauuggaaaugaaaacuaccuggauuauaugacauccaugaagagguucaaaaaugagucugaaccugagggugcccucugguga

SEQ ID NO: 13796 - RNA, 9879 nt, Artificial Sequence
  derived and/or modified CDS sequence (opt3) from DENV-1__FJ882554__SS-prME
agcgugaccaugcugcucaugcuuaugcccaccgcccuggcuuuccacuugacuacgagaggaggggaaccucauaugaucgucuccaagcaggaaagggggaagucuuuacuguuuaagaccucagccgguguuaacaugugcacgcuaauugccauggaccucggagagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauugugaucggugccggggaaaaagcucucaagcugucuugguucaagaaaggcuccucaaucggaaagauguuugaggccaccgcaagaggcgccaggcggauggcuauucuuggggauacagccugggacuucggaaguaucgguggcguuuuuacgagcguggggaaacugguccaucagauuuucggaaccgcauacggcguguuguuuuccgguguaucuuggacuaugaagauagggaucggcgugcuccugacaugguuaggacugaauagccgaucaaccagucuauccaugacauguauugcgguuggccucgucacucuguaccuuggggugauggugcaggcugauagcggaugcgucaucaacuggaaaggccgcgaauugaagugugguucugggaucuucguuaccaaugaggugcacacguggacagaacaauauaaguuucaggccgacucaccgaaaagacugagugcagccauuggaaaggcuugggaggagggcgugugcgguauaaggagcgccacccggcucgaaaacaucauguggaaacagauuuccaacgagcugaaucauaucuuacuggaaaacgacaugaaguucacuguagucgugggcgauguugcagggauucuugcucagggcaagaaaaugauccgcccucaacccauggaguacaaauauucuuggaagucguggggcaaggccaaaauaaucggggcggacgugcagaauaccacauuuauuaucgauggaccaaacacuccugaaugucccgacgaucagagagccuggaauauuugggaggucgaggacuacggcuucgguaucuuuaccacaaacauaugguugaagcucagggauagcuauacacaggugugcgaccaccgucugauguccgcugcaauuaaagauucaaaggccguucacgcugacaugggguacuggaucgaaagugagaaaaaugaaaccuggaagcuagcccgggcaucuuucauugaggugaagacuuguaucuggccaaaaagccauacacugugguccaacggaguacucgaaucagagaugauaauccccaagauuuauggcgguccuaucagccaacacaauuaccgaccaggcuacuucacccaggcggccgggccguggcaucugggaaaacuugaguuggauuuugaccugugcgaaggcacuacagucgugguggaugagcacugcgggaacagaggacccucuuuaaggaccacgacugucaccggcaagauuauccacgaaugguguugccgcuccuguacacucccuccacugcgguucagaggugaggacgggugcugguauggaauggagauaaggcccguuaaagaaaaggaggaaaaucuugugaagaguaugguaagcgcuggcucuggugagguggacuccuuuucacugggcuugcucuguauuaguaucaugaucgaagaggucaugcgcagccgauggucgcggcguaugcugaugaccgggacucuagccguguucuuucugcucauuaugggacagcugacauggaacgaucuuaucagauugugcauuaugguuggcgcaaaugcuuccgacaggauggggaugggaaccacauaccuggccuuaauggcaacuuucaaaaugcgcccuauguuugccgugggccuccuguuccggagacuuaccucuagggagguccugcuacucacgauaggucugagcuugguggcuucaguugaacugccaaacaguuuagaggaacucggggauggacuggcgaugggcaucaugauucuuaagcuguugacagacuuucaaucccaucagcucugggccacccugcuaucucugacuuucaucaaaaccacauuuagccuucacuaugcauggaagacuauggcuauggugcucuccauugucucacuguuccccuugugucugagcaccacgagucagaaaacaaccugguuaccgguacuccugggcucucuugggugcaagccucugacuauguuuuugaucgccgagaauaagauauggggacgacgcuccuggccacucaacgaagguaucauggccgugggcauuguuagcauccugcuaucgucacugcuuaaaaacgaugugccccucgcugggccucugauugcaggaggcauguugaucgccuguuacgucauaucugguaguuccgcggacuuaagccuggagaaggcugccgaggugucuugggaagaggaagcagagcauagcggggccucccacaauauucucguagaagugcaggaugacggaacaaugaaaaucaaggaugaggagcgggacgauacccugacuauccuucugaaagcuacauugcuagcagucucaggcguuuauccccugaguauuccagccacccucuucgugugguacuucuggcaaaagaaaaagcagagaagcggcgugcugugggacacgccuucucccccagaagucgagagggcggugcuugaugacgggauauaucguaucaugcagcgcggauuacugggucggucccagguuggcguagggguguuucaagaaaacgucuuccauacuauguggcacgugaccagaggagcuguucucauguaccagggcaagagguuggagccgucaugggccagugugaaaaaggaccugauuagcuacggugggggauggcgacuccagggcuccuggaauacaggcgaggaaguccaggugaucgcaguagagccugggaaaaaccccaagaauguccaaaccgccccaggaacauuuaaaacucccgaaggugaggugggcgcuauugcccuggauuucaagccugggaccucuggaucgccaaucguuaaccgggaaggcaagauagugggucuuuaugggaauggagucgugacgacaagcggcacuuacguuucagcaaucgcucaggccaaagcgucccaggagggcccccugccugagauugaagacgagguguuucgcaagagaaacuugaccaucauggaucuacacccggggaguggaaaaacaaggcgguaucugccagccauuguccgagaagcaaucaagagaaaacuccgcaccuuaauacuggcucccacuagggugguagccucugagauggcugaagcacuuaaggguaugccuauucguuaccaaaccacagccguaaagagcgagcauacgggcaaagagaucguugaccugaugugccacgccacuuucaccaugcggcucuuguccccagucagagugcccaauuauaacaugaucauuauggaugaagcucauuuuacagacccuuacucaaucgcggcaaggggguauauaucuacccgcgugggaaugggcgaggccgcugccauuuucaugacugcaacaccgcccgguagcgucgaagccuuuccacagaguaaugcuguaaucaaggaugaggaacgagacauuccugagagauccuggaacagcggguacgaguggaucaccgauuuccccggaaaaacggugugguuuguuccaucuauaaagucaggcaaugacauugcgaacugucugcggaaaaauggcaagagggugauccagcucucccgcaagacuuucgauacagaauaccagaaaaccaagaacaacgacugggacuaugucgugaccacugauaucagugagaugggggccaauuuccgugcagacagaguuauugauccucggaggugccugaaacccgugauccuuaaggacggaccagaacgcgucauucuagcugguccgaugccugugacaguagccagcgcagcccaacgaagaggccggauagggaggaaccacaauaaagagggagaucaguacaucuauaugggccagccccugaacaaugacgaggaucaugcucacuggaccgaagccaagauguuguuagacaacauuaauacaccagaggguaucauccccgcgcuguuugaaccugagcgcgaaaagucggcagccauugauggggaguacagacucaggggcgaggcucggaaaacuuucguggaacugaugcgucgcggagaccuuccaguuuggcugucuuauaaggucgccuccgagggcuuucaguacagcgaucgaagauggugcuucgacggggaaaggaacaaucaagugcucgaggaaaacauggauguggagauauggacgaaagagggagaacggaagaaauugcgccccagauggcuggacgcuaggaccuauucagacccucuagcacugcgggaguuuaaggaguucgccgcuggucgaagaagugucucuggcgaucucauccuugagauugggaaacugccgcagcacuuaacacagcgcgcccagaaugcauuggacaaccugguuaugcuccauaauuccgaacaaggaggcagggcguaccggcacgccauggaggagcugccagauacuaucgaaacccuuaugcugcucgcuuugauugccgugcugacaggugggguaaccuuauuuuuccuaagcggccguggacugggcaagacuucaaucgggcuccuuugugugauggcaaguagcguccuguuguggauggcuuccguggagccccauuggauagccgcaucuaucauucuggaauuuuuccucaugguucugcuuaucccugagcccgacagacagaggacgccacaggauaaccagcucgccuacguggucauuggacuguuguuuaugauccugaccguagcugcgaaugagauggguuuacuagaaacaacuaagaaagaccugggcauagggcacguggccguugagaaccaccaucacgcagcuaugcucgauguggaccuucauccugccagcgccuggacccuguaugcagucgcuacaaccauuaucacucccaugaugcgccacacaauugaaaacacgaccgccaauaucuccuugacugcgauagcuaaccaagccgcaauccugaugggacucgauaagggcuggccaauuucaaaaauggacaucggugugccucugcuugccuuagggugcuacucucaggucaauccgcugacacucaccgcugcaguguugaugcugguugcccauuaugcgauuaucggccccggacuacaggcuaaggccacccgggaggcacaaaaacgaacagccgcuggcauaaugaagaacccaacuguggaugggauuguagccaucgaccuggauccuguggucuacgacgcaaaguucgaaaaacagcucggacagaucaugcuucugauuuuguguacgagucagauccugcucaugagaaccacaugggcucugugcgagucgauaacuuuagccaccggcccccuuacaacccugugggaggguagcccagggaaguuuuggaauacuacgauugcgguuuccauggccaacaucuucaggggaucuuaucucgcaggcgcuggucuagccuucucacugaugaaguccuugggcgggggacgccggggcacaggggcacaaggagaaacccugggcgagaaguggaaaagacagcucaaucagcuuagcaagagugaauuuaacacuuacaagcguucugguauuauggagguggacaggagcgaagcuaaagaggggcugaagcggggagagaccacaaaacacgccgucucacgcggcacugccaaguugcgaugguucguggaaagaaaucugguaaaaccugaggguaaggugaucgaucucggcugugggaggggaggcugguccuauuacugcgcgggguuaaagaaaguuaccgaagugaagggauacacaaaaggcggucccgggcacgaggaaccgauaccaauggcuacguauggauggaaccuggucaaacuucauaguggcaaagacguguuuuucaucccucccgagaagugugauacccugcuaugcgacauuggcgagagcucuccaaaucccacuaucgaagaggggcggacacuccgcguccugaaaaugguggaaccuugguugagaggaaaccaguuuuguauuaagauccugaauccguacaugcccuccguuguagagacccucgagcaaaugcagaggaagcacgguggcaugcuugugcgaaacccacugucacggaauagcacucaugaaauguauugggucucgugcgggacaggaaacauugugucugcaguuaauaugaccagucguauguuacugaacagauucacgauggcccaccgcaaaccuaccuacgagagggauguggacuugggcgcugguacacggcacgucgccguggaacccgagguagcaaaccucgauaucauagggcagagaauugaaaauaucaagcaugagcacaaauccacuuggcauuaugacgaggauaacccuuacaagaccugggccuaucacggaagcuacgaagugaaaccaucaggcuccgcuucuagcaugguuaauggcgucgugaagcugcuaacaaagcccugggacgugaucccuauggucacucagauugcgaugaccgauacaaccccauuugggcaacagcgcguuuucaaagagaagguggacacuaggacgcccaaagccaagcgaggaacagcacagauaauggaaguaaccgcuaaauggcuuugggguuuucugagucggaacaagaagccgagaaucuguacuagggaggaguucacccgcaaagugcguuccaaugccgcaauuggcgccgucuuuguggacgagaaccaauggaauagcgcuaaggaggccguugaagaugagcgguucugggaccucgugcauagagaaagggagcugcacaaacaggggaagugcgcgacaugcgucuacaacaugaugggaaaacgcgaaaagaaguugggcgaguuugguaaagcaaaggggucucgagccaucugguauauguggcugggagcucgguuccucgaguucgaagcccuuggcuuuaugaaugaggaucacugguucucaagagaaaacagucuguccggcguggagggggagggauuacauaaacuggguuacauuuugagggacaucagcaagauaccuggcgggaauauguaugcagaugacacggcuggaugggauacccgcaucacugaagacgaucuccagaacgaggccagaauuacagacaucauggaaccagagcacgcucugcuagccaaaucuauuuuuaaacuuaccuaccagaauaaaguaguucgggugcaaaggcccgcaaagaacggcacugucauggaugugaucucgcgucgagaccagcgcgguucaggacaggugggaacauauggccugaauaccuucacaaacauggaagcgcagcucauaagacaaauggagagcgagggcauauuuuccccuagugaacuggagacuccaaacuuggccgaacgggucuuagauuggcuggagaaguacgggguugaaaggcucaaacgcauggcuaucucuggagacgacugugugguaaagcccaucgaugacagauucgccaccgcacuuacggcucugaaugauauggguaaagugcggaaggacauuccgcagugggagccuagcaaaggcuggaacgauuggcagcagguccccuuuugcucccaucacuuccaccaacuaauaaugaaggacgggagggagaucgugguuccaugucgaaaucaggaugaacuggugggacgugccagagucucacagggcgcagguuggagucuccgcgagaccgccugcuuggggaagucuuaugcgcagauguggcaacugauguacuuucaucggagggaccuuagacuggcugccaacgcaauuuguagcgccgugccuguagauuggauccccacaucccgcacuaccuggucaauucacgcucaucaccaguggaugacaacugaagacaugcucagcguuuggaaucggguguggaucgaggaaaacccauggauggaggauaaaacccauauaucuuccuggggagacguccccuacuuaggcaagagggaggaccaguggugcggcagucugaucggguugacggcccgagcaacaugggcuaccaauauucaaguggccaucaaccagguuagacggcugauuggaaaugaaaacuaucucgauuacaugacuagcaugaaaagguucaagaaugagucggacccugaaggugcgcuuugguga

SEQ ID NO: 13797 - RNA, 9879 nt, Artificial Sequence
  derived and/or modified CDS sequence (opt3) from DENV-1__GQ868610__SS-prME
agcgugaccaugcugcucaugcuuaugcccaccgcacuggcuuuccacuugacuacgagaggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaaucacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacauuauguggaaacagaucucuaacgagcucaaucauauucuguuagaaaacgacaugaaguucaccguggugguaggcgaugucguggggauccuggcucagggcaagaagaugauacgcccucaacccauggagcacaaauacucguggaaaagcuggggcaaggccaaaaucauuggggcggacguucagaauacuaccuuuaucauugauggaccaaacacaccugaaugucccgacgaucagagagccuggaauaucugggagguggaggacuauggcuucgguauauuuacuaccaacauuuggcuuaaguugagggauuccuacacacaggucugcgaccaccgucucaugucagcugcaaucaaagauaguaaggccgugcaugcugacaugggguauuggauugaaucugagaaaaaugaaacguggaagcuggcccgggcauccuucaucgagguuaagaccuguauauggccaaaaucccacacucuauggucaaacggagugcuggaaagcgagaugaucauucccaagaucuacggcgguccuauuucucaacauaauuaucgaccaggcuacuucacacagaccgcggggccguggcaccucggaaaacuggagcuugauuuugacuugugcgaaggcacuacaguagucguggaugagcacugcgggaacagaggacccucccugaggaccacgacugugaccggcaagaucauacaugaaugguguugccgcaguuguacauuaccuccacuccgguucaaaggugaggacgggugcugguacggaauggagauuagacccgucaaggaaaaggaggaaaaucugguuaaaagcauggugucugccggcuccggugagguagacucauuuagucuuggccuguuguguaucagcaucaugauugaagaggugaugaggucgcgcuggucccgaaagaugcucaugaccgggacucuggcugucuuccuacugcucaucaugggacagcugacauggaacgaucuuauucgguugugcauaauggugggcgccaaugcaucugaccguauggggaugggaaccacauaucuggcuuuaaucgccacuuuuaaaaugagaccuauguucgcaguuggccuccuguuuaggcgccuuaccagccgggaggugcugcuacucacgauuggucugucauuggucgccaguguggaacugccaaacuccuuagaggaacucggggauggacuggcuaugggcaucaugauucuuaagcuguugacagacuuccaaucucaccagcucugggcgacccugcugagcuuuacuuucaucaaaaccacauuaucccuucauuacgccuggaagacuauggcaaugguucucucaauagugagccuguuucccuugugucugaguaccacgucucagaagacaaccugguuaccgguccuccugggcucccuugggugcaaaccucugacuauguucuugaucgcugagaauaagauuuggggaagaaaaagcuggccacucaacgaagguaucauggccguaggcgugguuucgauucugcuaucaucucugcuuaagaacgaugugccccucgccgggccucugaucgcuggaggcauguugauagcauguuaugucauuagugguuccagcgccgacuuaucucuggagaaagcggcugaggugagcugggaagaggaagccgagcacuccggggcaucacauaauauccucguagaagugcaggaugacggaacaaugaagaucaaagaugaggagagggacgauacccugacuauucuucugaaggccacauugcuagcugucaguggcguuuacccccugagcauaccagcaacccucuuugugugguauuucuggcaaaagaaaaagcagcgaucuggcgugcugugggacacgccuucacccccagaagucgagcgcgccgugcuugaugacgggaucuaccggauuaugcagagaggauuacuggguaggagccagguuggcguagggguguuccaagaaaacgucuuucacacuauguggcacgugacccguggagcgguucucauguaucagggcaaacgcuuggagccgaguugggcuagcgugaagaaagaccugaucuccuacggugggggauggcggcuccagggcucuuggaauacaggcgaggaaguccaggugauugccguagagccugggaagaaccccaagaauguccaaaccgcaccaggaacauucaaaacucccgaaggugaggugggcgccaucgcucuggauuuuaagccugggaccucgggaagcccaauaguuaacagagaaggcaaaaucgugggucuuuacgggaauggagucgugacgacaucaggcacuuauguuuccgccauugcacaggcuaaggccagucaggagggcccccugccugagaucgaagacgagguguucaggaaacgaaacuugaccauuauggaucuacauccggggucuggaaagacacggcgcuaccugccagcgaucgucagagaagccauaaagaggaaacuccggaccuuaauucuggcacccacucgagugguagcuagcgagauggccgaagcucuuaaggguaugccuaucagauaucaaaccacagcagugaaauccgagcacacgggcaaggagaucguugaccugaugugccaugccacuuuuaccaugcgccucuugucaccagucagggugcccaauuacaacaugauuaucauggaugaagcccacuucacagacccuucuagcauagcugcgcguggguauauuaguacccgggugggaaugggcgaggcagccgcuaucuuuaugacugccacaccgcccgguuccgucgaagcauucccacagagcaaugccguaauucaggaugaggaaagagacaucccugagaggucuuggaacucaggguacgaguggauaaccgauuuucccggaaaaacggugugguucguuccauccauuaagaguggcaaugacaucgcuaacugucugcgcaagaauggcaaacgagugauccagcucagcagaaagacuuuugauacagaauaucagaaaaccaagaacaacgacugggacuacgucgugaccacugauauuucggagaugggggcgaauuuccgggccgacaggguuaucgauccucgccguugccugaaacccgugauucuuaaggacggaccagaaagagucauacuagcagguccgaugccugugacaguagcuucugccgcacagcggaggggccgcaucgggcgaaaccauaauaaggagggagaucaguacauuuauaugggccagccccugaacaaugacgaggaucacgcccacuggaccgaagcuaaaauguuguuagacaacaucaauacaccagaggguaucauucccgcccuguucgaaccugagagagaaaaguccgcggcaauagauggggaguaccggcucaggggcgaggcccgcaaaacuuuuguggaacugaugagaaggggagaccuuccaguuuggcugagcuauaaggucgcuucagagggcuuccaauacagugaucggcguuggugcuuugacggggaacgcaacaaucaggugcucgaggaaaacauggauguggagaucuggacgaaagagggagaacgaaagaaauugagacccagguggcuggacgcccggaccuauucugacccucuagcucugcgcgaguucaaggaauuugcagccgguagaagguccgucagcggcgaucucauucuugagaucgggaagcugccgcagcauuuaacacagcgggcucaaaaugccuuggacaaccugguuaugcuccacaauucagaacagggaggccgagcauacagacaugcgauggaggagcugccagauacuauugaaacccuuaugcugcucgccuugaucgcugugcugacaggugggguaaccuuauucuuucuaaguggccgcggacugggcaaaacuagcauagggcuccuuugugugauggccuccucuguccuguuguggauggcaagcguggagccccacuggaucgcugccuccauuauccuggaguucuuucucaugguucugcuuauuccugagcccgacaggcagcggacgccacaggauaaccaacucgcauauguggucaucggacuguuguucaugauacugaccguagccgcuaaugagauggguuuacuagaaacaacuaagaaagaccugggcauugggcacguggcgguugagaaccaucaccaugccaccaugcucgauguggaccuucacccugcaucagcuuggacacuguacgccgucgccaccacuaucauuacacccaugaugcgucauacgaucgaaaacaccacugcaaauauaucuuugacagcuaucgccaaccaggcggcuauucugaugggacucgauaagggcuggccaaucaguaaaauggacauuggugugccucugcuugccuuagggugcuacucgcaggucaauccgcugacccucaccgcagccguguugaugcugguugcucacuaugcaaucauaggccccggacuacaagccaaggcgacaagagaggcucagaagaggacugccgcaggcauuaugaaaaacccaacgguggaugggaucguagccaucgaccuggauccuguggucuacgacgcuaaguuugaaaaacagcucggacagauuaugcuucugaucuuguguaccagccaaauacugcucaugcgcacaacuugggcccugugcgaguccauuaccuuagcaacaggcccccuuaccacucugugggaggguucuccagggaaguucuggaauacgacaaucgcuguuucaauggccaacauuuuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaguucaacaccuacaagcgcucagguaucauggagguggaccgguccgaagccaaagaggggcugaagagaggagagacaacucgucacgcagucaguaggggcaccgcuaaauugcggugguuuguggaacgcaaucugguaaagccugaggguaaggugauagaucucggcugugggcgaggaggcuggagcuauuacugcgccgggcuaaagaagguuacagaagugaaaggauauacgaagggcggucccgggcaugaggaaccgaucccaauggccaccuacggauggaaccuggucaaacuucacucuggcaaggacguguucuuuacuccucccgagaaaugugauacacugcuaugcgacauuggcgaguccucaccaaaucccaccaucgaagaggggagaacucucaggguccugaagaugguggaaccuugguugcggggaaaccaauucuguauuaagauccugaauccguacaugcccagcguuguagagacacucgagcagaugcagcgcaaacaugguggcaugcuugugagaaacccacugucgagaaauucuacccacgaaauguauugggucaguugcgggacgggaaacauuguguccgcgguuaauaugaccagccgaauguuacugaaccgguuuacaauggcucaccguaagccuacuuacgagagagauguggacuugggcgcagguacccgccaugucgccguggaacccgagguagcuaaccucgauaucauagggcagaggauugaaaauaucaaacacgagcauaagucaacauggcacuaugacgaggauaacccuuacaaaacuugggccuaucauggauccuacgaagugaagccaucuggcagcgcaaguuccaugguuaauggcgucgugaagcugcuaaccaaacccugggacgugaucccuauggucacacaaauugccaugaccgauacuacgccauucgggcagcagcggguuuuuaaggagaaaguggacacaagaacccccaaggcuaaacgcggaacugcgcaaauaauggaaguaaccgccaaguggcuuugggguuuccugagcaggaacaagaaaccgcgaaucuguacacgggaggaauuuacgagaaaggugaggucuaaugcagcuauuggcgccgucuucguggacgagaaccaguggaacucagcaaaagaggccguugaagaugagcgcuuuugggaccucgugcagaaggaacgugagcugcacaaacaggggaagugcgcuaccugcgucuauaacaugaugggaaagcgggagaaaaaguugggcgaguucgguaaagccaaggggaguagagcgaucugguacauguggcugggagcaagguuucucgaguucgaagcccuuggcuucaugaaugaggaucacugguuuucccgcgaaaacagccugucuggcguggagggggagggauuacauaaacuggguuacauuuugcgagacaucucgaagauaccuggcgggaauauguaugcugaugacacugccggaugggauacacggaucaccgaagacgaucuccaaaacgaggcaaaaauuacugacaucauggaaccagagcacgcucugcuagccacaucaauuuucaaacuuaccuaccagaauaagguaguuagagugcagaggcccgcuaaaaacggcacagucauggaugugaucagccgcagagaccagcgggguuccgggcaagugggaacuuauggccugaauaccuuuacgaacauggaagcccagcucauaaggcagauggagagugagggcauuuuccugccuucugaauuggagaccccaaacuuagcagaacguguccuggauuggcucgagaaguacgggguugaacgacuuaaacgcauggcgaucagcggagacgacugugugguaaagcccaucgaugacagauuugccacagcucugacugcccuaaaugauauggguaaagugcggaaggacauuccgcagugggagccuuccaagggcuggaacgauuggcaacagguccccuucugcucacaucacuuucaccagcugauaaugaaagacgggagggagaucgugguuccaugucgcaaucaggaugaacucgugggaagggcacgggucagucaaggcgcugguuggucuuugagggagaccgccugccugggaaagagcuaugcacagauguggcagcuuauguacuuccaucgacgugaccugagacucgccgcgaacgcuauuuguuccgccgugccuguagauuggguucccacaucacgcacuaccuggagcauccacgcacaucaccaauggaugacgacagaagacauguuaucuguguggaaucgggucuggauugaggaaaacccauggauggaggauaaaacccauguguccaguuggggagacguucccuaucugggcaagagggaggaccaguggugcggcagcuugaucgggcugacugccagagcuacaugggccucgaauauacagguggcaaucaaccagguccgccggcucauuggaaaugaaaacuaccuugauuacaugaccuccaugaaaagguuuaagaaugagggugacccugaaggcgcucugugguga

SEQ ID NO: 13798 - RNA, 9879 nt, Artificial Sequence
  derived and/or modified CDS sequence (opt3) from DENV-1__GQ868611__SS-prME
agcgugaccauguuccugaugcucaugcccacagcccuugcuuuucaccugacuacgcggggaggggaaccucauaugaucgucuccaagcaggaaaggggaaaaucuuuguuauucaagaccucagccgguguuaauaugugcacacugauugccauggaccuaggcgaacucugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuggcaccccaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcugcccuggacuuccggcgccucaacaagccaagagaccuggaaucggcaggaccuucugguaacauuuaaaacugcacacgcuaagaagcaggaaguuguggucuuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugugauguguaccgggucguucaaacucgagaaggaacuggccgagacgcagcacgguacaguccuugugcagauaaaguacgagggcaccgacgcuccuugcaaaaucccauuuucgacucaagaugaaaaggggguuacacagaacggacgcuugauuaccgcgaaucccaucgugacugacaaagagaagccuguaaacauagaagcagagccacccuucggcgagucuuauauugucaucggugccggggaaaaagcucugaagcucuccugguuuaagaaaggcucaaguaucggaaagauguucgaggccaccgcaagaggcgccaggcggauggcuauucugggggauacagccugggacuuuggaagcaucgguggcguguucacguccguugggaaacuugugcaucagauuuuuggaaccgcauacggcguccuguucucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuuugucaccaaugagguucacacguggacagaacaauauaaguuccaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguuuacugugguagucggcgauguggcagggauucuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcuuaaguugagggauuccuauacgcaggucugcgaccaccgucucaugucagcugcaauuaaagauaguaaggccgugcacgcugacaugggguacuggaucgaaucugagaaaaaugaaaccuggaagcuggcccgggcauccuucauugagguuaagacuuguaucuggccaaaaucccauacacuauggucaaacggagugcuggaaagcgagaugauaauccccaagauuuauggcgguccuaucucucaacacaauuaccgaccaggcuacuuuacccagacugcggggccguggcaucucggaaaacuggagcuugauuucgacuugugcgaaggcacaaccguagucguggaugagcacugcgggaacagaggacccucccugaggacgacuaccgugacaggcaagauuauccacgaaugguguugccgcaguuguaccuuaccuccacuccgguuuagaggugaggacgggugcugguauggaauggagauaaggcccgucaaagaaaaggaggaaaaucugguuaagagcauggugucugccggcuccggugagguagacucauucagucuuggccuguuguguauuagcaucaugaucgaagaggugaugcgcucgcgauggucccggaaaaugcucaugacugggacacuggcugucuuuuuccuacugauuaugggacagcucaccuggaacgaucugauccgucuuugcauuauggugggcgccaaugcaucugacagaauggggaugggaacaacuuacuuggcucugauggccaccuuuaagaugaggccuauguucgcaguuggcuuacucuuucgccggcugacgagcagagaggugcuucugcuaacaauaggucucucacuggucgccaguguggaauugccaaacucccuggaggaauuaggggauggacucgcuaugggcaucaugauucugaaacuucugaccgacuuccaaucucaucaguugugggcgacucuccugagccuaaccuuuaucaagacaacuuucucccugcacuaugccuggaaaaccauggcaaugguucuuucaauugugagccucuuuccccuguguuugaguacgacaucucagaagaccacuuggcugccggucuuacucggcucccuggggugcaagccucuuacaauguuccugaucgcugagaauaaaauauggggaaggcgaagcuggccauugaacgaagguaucauggccguaggcauugugucgauccuccugucaucucuacugaagaacgauguuccccuugccgggccucucauugcuggaggcaugcugaucgcauguuacgugauaagugguuccagcgccgacuugucuuuagagaaagcggcugaggucagcugggaagaggaagccgagcauuccggggcaucacacaauauucugguggaaguacaggaugacggaaccaugaagaucaaagaugaggagcgcgacgauacucucacaauccugcuuaaggccacccuguuggcugugaguggcgucuauccccuaagcauuccagcaacgcuguucguuugguacuuuuggcagaaaaagaagcagcggucuggcgugcucugggacacuccuucacccccagaaguggagagagccguccuggaugacgggauauauaggaucaugcagcguggacuuuuaggucgcagccaggugggcguugggguauuccaagaaaacguguuucauaccauguggcacgucacacggggagcggugcugauguaccagggcaaaagacucgagccgaguugggcuagcguuaagaaagacuugauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucucgauuuuaagccugggacgucgggaagcccaaucgugaaccgagaaggcaaaauaguuggucuguaugggaauggaguggucacaacuucaggcaccuacguguccgccaucgcacaggcucgggccagucaggagggcccccuuccugagauugaagacgagguuuuccgcaagagaaaccugacaaucauggauuugcacccggggucuggaaaaaccaggcgguaucuaccagcgauugugcgagaagccaucaagagaaaacugcgcacucucauauuagcacccaccagggucguggcuagcgagauggccgaagcucugaaggguaugccuauucguuaccaaacaacggcaguaaaguccgagcauacuggcaaagagaucguggaccuuaugugccacgccaccuuuacaaugcggcugcucucaccaguuagaguccccaauuauaacaugaucauuauggaugaagcccauuucaccgacccuucuagcaucgcugcgaggggguacauaaguacucgcgugggaaugggcgaggcagccgcuauuuuuaugacagccaccccgcccgguuccguggaagcauucccacagagcaaugccgucauccaggaugaggaacgagacauuccugagagaucuuggaacucaggguaugaguggaucacggauuuucccggaaagacuguaugguucgugccauccauaaaaaguggcaaugacauugcuaacuguuugcggaagaauggcaaaaggguuauccagcugagccgcaagacauucgauaccgaauaccaaaagaccaaaaacaacgacugggacuacguggucacuacagauaucucggagaugggggcgaauuuucgugccgacagagugauugauccucggaggugccucaagcccguuauccugaaagacggaccagaacgcgugauucuugcagguccgaugccugucaccguggcuucugccgcacagcgaagaggccggauagggaggaaccacaauaaggagggagaucaguauaucuacaugggccagccccuaaacaaugacgaggaucaugcccacuggacagaagcuaaaaugcuguuggacaacauuaauacuccagaggguaucauccccgccuuauucgaaccugagcgcgaaaaguccgcggcaauugauggggaguauagacugaggggcgaggcccggaagacguuuguagaacucaugcgucgcggagaccugccaguguggcuuagcuacaaaguugcuucagagggcuuccaauauagugaucgaagauggugcuuugacggggaaaggaacaaucagguccuggaggaaaacauggauguggagauauggaccaaggagggagaacggaaaaagcuccgccccagaugguuggacgccaggacauacucugacccucuggcucuacgggaguucaaagaauuugcagccggucgaagauccgugagcggcgaucugauccucgagauugggaaacuuccgcagcaccugacucagcgcgcucaaaaugccuuagacaacuuggucaugcugcauaauucagaacagggaggcagggcauaucggcacgcgauggaggagcucccagauaccaucgaaacacugaugcuucuggcccucauugcuguuuugaccgguggggugacucuguucuuuuuaaguggccguggacuaggcaaaacgagcaucgggcugcucuguguaauggccuccucugugcuucuguggauggcaagcgucgagccccauuggauagcugccuccaucauuuuggaguucuuucugauggugcuccugaucccugagcccgacagacagaggaccccacaggauaaccaacuugcauacguugugauuggacuccuguucaugaucuugacagucgccgcuaaugagaugggucuguuagaaacuaccaagaaggaccuaggcauagggcacguagcgguggagaaccaccaucacgccgcaaugcuggauguugaccuccauccugcuucagccuggacacuuuacgccguggcaaccacuauuaucacacccaugaugcgccacacgauugaaaacaccacugcuaauaucucucugacagccauagcgaaccaggcugccaucuugaugggacuggauaaaggcuggccaauuaguaagauggacaucggugucccucuccuggcacuugggugcuauagccaggugaauccguuaacccugaccgccgcuguccucauguugguggcacauuacgccauuaucggccccggacugcaagcgaaagcuacacgggaggcccagaagcgaacugcagccggcauaaugaaaaacccaacgguugaugggauuguggcuaucgaccuagauccuguaguguaugacgccaaguuugaaaagcagcugggacagaucaugcuccuuauucuguguaccagccaaaucuugcugaugagaacaacuugggcacucugcgaguccauaacccuggcuacaggccccuuaaccacucuuugggaggguucuccagggaaauucuggaauacgacaauugccgucucaauggcgaacaucuucaggggaagcuaccuggccggcgcaggucucgcuuuuucccuaaugaagagucugggcgggggacgccggggcaccggggcccagggagaaacuuugggcgagaaauggaagagacagcugaaucagcucucuaaaagcgaguucaacaccuauaagcguucagguauuauggagguugacagguccgaagcaaaggaggggcuuaaacggggagagacaacuaagcacgcugugagucgcggcaccgccaaacugcgaugguuugucgaaagaaauuuggugaagccugaggguaaaguaaucgaucugggcugugggaggggaggcuggagcuacuauugcgccgggcucaagaaggugacagaaguuaaaggauacacgaagggcggucccgggcacgaggaaccgauaccaauggcgaccuacggauggaacuuagugaaacugcauucuggcaaggacgucuucuuuaucccucccgagaaaugugauacucuucugugcgacauuggcgaguccucaccaaaucccacaaucgaagaggggcggacccuacgcgugcucaagauggucgaaccuuggcugagaggaaaccaauucuguauuaaaaucuugaauccguauaugcccagcgugguugagacucuggagcagaugcagaggaagcacgguggcaugcucguacgaaacccacuuucgagaaauucuacacaugaaauguacugggugaguugcgggaccggaaacauugucuccgcugugaauaugacgagccguaugcuguuaaacagauuuaccauggcacaccgcaagccuacauaugagagggauguugaccugggcgccgguacucggcacguggcugucgaacccgagguggccaacuuggauaucauagggcagagaauugaaaauaucaaacaugagcacaagucaaccuggcauuacgacgaggauaacccuuauaaaacaugggcauaccacggauccuaugaaguaaagccaucuggcagcgccaguuccauggugaauggcguugucaaacuccugacuaagcccugggacgugaucccuauggugacccaaauugcuaugacagauaccacuccauucgggcagcagcgcgucuuuaaggagaaaguugacacgaggacacccaaggcgaaacgaggaaccgcccaaauaauggaagugacugcaaaguggcuaugggguuuccuuagccggaacaaaaagccgagaaucuguaccagggaggaauuuacacgcaagguacguucuaaugcugccauuggcgcaguguucgucgacgagaaccaguggaacucagccaaagaggcuguggaagaugagcgguuuugggaccugguucauagagaaagggagcuccacaagcaggggaaaugcgccacgugcguguacaacaugaugggaaagcgcgagaaaaagcugggcgaguucgguaaggcgaaagggagucgagcaaucugguacaugugguugggagcccgguuccuggaguuugaagcucucggcuucaugaaugaggaucacugguuuuccagagaaaacagccuuucuggcgucgagggggagggacugcauaaguuagguuauauucugagggacaucucgaaaauaccuggcgggaauauguacgccgaugacaccgcaggaugggauacucgcaucacagaagacgauuugcagaacgaggcuagaauuaccgacaucauggaaccagagcacgcccuccuggcuaagucaauuuucaaacuaacuuaucaaaauaaggugguacggguucagaggcccgccaaaaacggcacagugauggaugucaucagccgucgagaccagcgcgguuccggacaggugggaaccuacggccuuaauacauuuacuaacauggaagcacaacugauaagacagauggagagugagggcauuuucucuccuagcgaacucgagaccccaaaccuggcggaacggguguuggauugguuagagaaguauggggucgaaaggcugaagcgcauggccaucuccggagacgacuguguugugaaacccaucgaugacagauuugcuacggcccucaccgcacuuaaugauauggguaagguacggaaagacauuccgcagugggagccuucaaagggcuggaacgauuggcagcaagugcccuucugcagucaucacuuucaccagcugauaaugaaagacgggagggagaucgucgugccaugucgaaaucaggaugagcuaguuggacgugcuagagugucucagggcgccgguuggagccugcgcgagacagcaugccucgggaaguccuacgcccaaauguggcaguugauguauuuccaucggagggaccugagacuugcggcuaacgccauuuguucagcagucccuguggauuggauccccacuagccgcaccacauggucuauucacgcccaucaccaguggaugacuaccgaagacaugcuguccguauggaaucggguuuggaucgaggaaaacccauggauggaggauaagacgcauauaaguagcuggggagacgugcccuaccucggcaaaagggaggaccaauggugcggcucguuaaucgggcugacagcucgagccaccugggcaacuaauauucaggucgcuaucaaccaggugagacgguugauuggaaaugaaaacuaccuggauuauaugacauccaugaagagguuuaaaaaugagucugacccugaaggugcccucugguga

SEQ ID NO: 13799 - RNA, 9879 nt, Artificial Sequence
  derived and/or modified CDS sequence (opt3) from DENV-1__FJ882555__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcgcuagucaagagaccuggaaucggcaggaccuucugguaacuuuuaaaacagcccacgcuaagaagcaggaaguuguggucuuggguucucaagagggggccaugcacaccgcacucacaggcgccacugaaauccagaccuccggaacgaccacaauuuucgcuggccaucugaaaugccguuuaaagauggauaaacugacucuaaaggggaugagcuaugugauguguaccggaucguucaaacucgagaaggaagucgcggagacacagcacgguacugugcugguucagauaaaguacgagggcaccgacgcaccuugcaaaaucccauuuucuacgcaagaugaaaagggggugacacagaacggacgccuuauuaccgccaaucccaucguaacugacaaagagaagccugucaacauagaagcugagccacccuucggcgaguccuauauugugaucggugccggggaaaaagcauugaagcugucaugguuuaagaaaggcaguagcaucggaaagauguucgaggccacagcuagaggcgccaggcggauggcaauucucggggauaccgcgugggacuuuggauccaucgguggcguuuucacuucuguggggaaacugguccaucagauuuuuggaaccgcuuacggcgugcuuuucagcgguguaucauggacaaugaagauagggaucggcgugcuguugacguggcucggacugaauagucgauccaccagcuuaucuaugacuuguauugccguuggccuggucacacuauaccucggggugauggugcaggcagauucaggaugcgucaucaacuggaaaggccgcgaacugaagugugguagugggaucuuuguuaccaaugaggugcacacauggacugaacaauauaaguuccaggccgacagcccgaaaagacuuuccgcugccauuggaaaggcaugggaggagggcgugugcgguauaaggucugcuacccgguuggaaaacaucauguggaaacagauuucgaacgagcugaaucauauccuccuggaaaacgacaugaaguuaacgguagucgugggcgauguugccgggauucuggcgcagggaaaaaagaugauccgcccucaacccauggaguacaaauauagcuggaaguccuggggcaaggccaaaauaaucggggcugacgugcagaauacaaccuuuauuaucgauggacagaacacuccagaauguccugacgaucagagagcauggaauauuugggaggucgaggacuacggcuucgguaucuuuaccacaaacauauggcuuaaguugagggauucauauacucaagugugcgaccaccgucucaugagugccgcuauuaaagauucuaaggccguucacgcagacaugggguacuggaucgaaagcgagaaaaaugaaaccuggaagcuggcgcgggccuccuucauugaggugaagacauguaucuggcccaaaucacauacgcuauggagcaacggaguacuggaaucugagaugauaaucccaaagauuuauggcggucccaucucccagcacaauuaccgaccuggcuacuucacccagacugcugggccauggcaucucggaaaacuggagcuugauuuugacuugugcgaaggcacaaccgucgugguggaugagcacugcgggaacagaggaccgagucugaggacuacaaccgucacgggcaagauuauccacgaaugguguugccgcagcuguacuuuacccccucuccgguucaaaggugaggacgggugcugguauggaauggagauaagaccaguuaaggaaaaggaggaaaaucuggugaaaucuaugguauccgccggcucaggugagguggacaguuuuagccuuggccuguuguguauuucgaucaugaucgaagaggucaugaggucccgcuggucucgaaagaugcucaugaccgggacacuggcaguguucuuucuacugauuaugggacaacucaccuggaacgaucugauccggcuuugcauuaugguuggcgcuaaugccagcgaccguauggggaugggaacuacauacuuggcacugauggccaccuucaaaaugagacccauguuugcugugggcuuacucuucaggcgccugacaucacgggagguccuucugcuaacuauaggucucagucugguggcguccguugaauugccuaacucucuggaggaauuaggggauggacucgccaugggcaucaugauucugaagcuucugaccgacuuucagagccaucaguugugggcaacgcuccuguccaugacauucaucagaaccacuuuuucacuacacuaugcuuggaaaaccauggccauggugcugagcauugucagucuuuucccacucugucugucuacaacuucccagaagaccacgugguugcccguacuguuaggcagccucgggugcaagccgcugacaauguuucuuaucgccgagaauaaaauauggggaaggaagucguggccucugaacgaagguaucauggcugugggcauuguuucaaucuugcucucuagucugcuaaaaaacgaugugccacuggcagggccccuuauugccggaggcaugcucaucgcguguuacgucauauccgguagcucugcugaccugagcuuggagaaggccgcagugguauccugggaggaagaggccgaacauucaggggcuagucacaauauuuuaguggagguccaagaugacggaaccaugaaaaucaaggaugaagagcgagacgauacucugacaauccuccugaaagcaacccuucuggccguuagcggcguguauccuuugucuauucccgcgacucuauucgugugguacuucuggcagaagaagaaacagcgcuccggcguccugugggacacaccaucaccucccgagguggaacgggcuguucucgaugacgggauauauagaaucaugcagaggggacugcuuggucguagucaaguaggcgugggggucuuucaggagaacguguuccauaccauguggcacguuacgcgcggagccguguuaauguaccagggcaagcggcuggaaccaagcugggcauccgucaaaaaggaccucauuucuuacggugggggauggagauugcagggcucguggaauacuggcgaggaggugcaaguaaucgccgucgaaccggggaaaaacccuaagaaugugcagaccgcucccggaacauuuaagaccagcgagggugaaguuggcgccauugcacuggauuucaaaccagggacaucaggaucccccaucgugaacagggagggcaaggucgugggucucuaugggaauggaguugugacuaccaguggcacguacgucucugcuauagcccaggcgaaagccagccaagaaggcccucugccagagaucgaggacgaaguguuucgaaagcggaaccuuacaauuauggaucugcaccccggguccggaaaaacucgcagauauuugccugcaaucguaagggaggcuauuaagcggaagcuacgaacccugauccucgccccgacaagagugguugcuucagaaauggcagaggccuuaaaagguaugccaauacgcuaccagaccacugccgucaagucugaacauaccggcaaagagauuguggaccugaugugccacgcuacauucacgaugaggcuucugagccccgugcgugucccuaauuauaacaugaucaucauggaugaggcgcauuuuacugacccaaguuccauugcagcccggggguacaucagcaccagaguaggaaugggcgaagcugccgcaauauucaugacagccacccccccugguucuguggaggcuuuuccgcagucaaaugcgguuauucaggaugaagagagggacauccccgaacgcuccuggaacaguggguaugaguggauuacugauuucccaggaaagacagugugguuugucccuagcaucaaaucgggcaaugacauagccaacugucuccgaaagaauggcaagagagugauucaauugucucggaaaaccuucgauacggaguaccagaagacuaaaaacaacgacugggacuacguugugacaaccgauaucuccgaaaugggggcaaauuucagggcugaccgcgucaucgauccccguagaugccugaagccagugauucucaaagacggaccugagcggguaauccuggccggucccaugccagugaccguugcaagcgccgcucagaggcgcggccgaauugggagaaaccacaauaaggaaggagaucaguauauauacaugggccaaccgcuuaacaaugacgaggaucaugcccacuggacugaggcgaagaugcuacuggacaacaucaauacaccugaagguauuauccccgcauuguuugagccagaacgggagaaaucagccgcuaucgauggggaauauagguuacgcggcgaggccagaaagaccuucgucgagcugaugaggcggggagaccuccccguguggcugaguuacaaaguggcuucugaaggcuuucaguauuccgaucgucgcuggugcuucgacggggagcgaaacaaucagguccuugaagagaacauggauguugaaauuuggacaaaggagggagagagaaaaaagcugaggccucgguggcucgacgcacgcacuuacagcgacccauuggcccugagagaauuuaaagaguucgcugccgguaggcggucagugaguggcgaucuaauacuggaaaucgggaagcucccccagcaccuuacgcaacgagcacagaaugcgcuggacaacuuaguaauguugcauaauagcgagcagggaggcagagccuaucgccacgcuauggaagagcugccugauaccauugagacacucaugcugcuugcccugaucgcagugcucacugguggggucaccuuguuuuuccuguccggcaggggauuaggcaagacaucuauugggcuacugugugugauggcuagcuccguucuccuuuggauggccucaguggaaccgcauuggaucgcagccucuauaauccuggaguuuuucuugaugguccugcucauuccagaacccgaccggcagcguaccccucaagauaaccagcuggcuuacguagugaucggacuucucuuuaugauucugacuguugcggccaaugagauggguuugcuggagacgaccaaaaaggacuuaggcaucgggcacguggcagucgaaaaccaccaucacgcugccaugcuagauguggaccugcaucccgccagugcauggacacucuacgcugucgccacuaccauaauuacaccaaugaugagacacaccaucgagaacacuacagcgaauauuucgcuuacggcuaucgccaaccaggcagccauacugaugggauuggauaaaggcuggccuaucagcaagauggacauuggugugccccugcucgcucuggggugcuauucccaaguuaauccacuuaccuuaacugcagccgugcugaugcucguagcgcauuacgcuaucauuggcccuggauugcaggccaaagcaacaagggaagcccagaagcgcaccgcugccggcaucaugaagaacccgaccguggaugggauagucgcaauugaccuggaucccguuguguaugacgcuaaauucgagaagcagcuaggacaaaucaugcugcucauccuuuguacaucucagauucuguugaugcggacuacgugggcccugugcgaaucaaucacccucgcgacaggcccacugacuaccuuaugggaggguagcccugggaaauuuuggaauacaaccauagccgucuccauggcaaacauuuuccgaggaaguuaccuugcuggcgccggucuggcauucucucucaugaagagccuaggcgggggaagaaggggcacuggggcucagggagagacgcugggcgaaaaauggaagcgccaguugaaucaacugucaaaguccgaguuuaacacauauaaacggagugguaucauggaaguggacagaagcgaggccaaggaagggcucaaacguggagagaccacuaagcacgccguaucuaggggcaccgcgaaacuucggugguucguggagcgcaaucugguuaagcccgaagguaaggugauugauuugggcugugggcgaggaggcugguccuacuauugcgcugggcugaaaaaggucacagaggugaaaggauacacuaagggcgguccagggcacgaagagccuauccccauggcaaccuacggauggaaccucgucaaauuacauucaggcaaggacguguuuuucauaccgccagaaaaaugugauacacugcuuugcgacaucggcgagagcucgccuaaucccacgauugaggaagggagaacccugaggguucuaaagaugguagagccauggcuccggggaaaccaguuuuguaucaagauucugaaucccuauaugccuucuguggucgaaacuuuggagcagaugcagcgcaaacacgguggcaugcuggugagaaacccgcucaguaggaauuccacacaugagauguacuggguuagcugcgggaccggaaacaucgugucagccgucaauaugacuucccgaaugcuucugaaccgguucacaauggcucaccguaagcccaccuaugaaagagauguggacuuaggcgccgguacgcgccacguagcaguggagccagaaguugccaaccuggauauuaucgggcaaaggauagagaauauuaaacaugaacacaagucuaccuggcauuacgacgaggauaacccuuauaaaacaugggcuuaccacggaagcuaugaggucaagcccaguggcuccgcgagcucuauggugaauggcguggucaaguugcucacuaaaccuugggacguuaucccaauggugacccagaucgccaugacagauacuacccccuuugggcagcaacggguauucaaggaaaaaguggacacaagaaccccuaaggcaaaacgcggaacugcucagauuauggaggucacggccaaguggcugugggguuuucuaucaaggaacaagaaaccacgaauauguacacgggaagaguucaccagaaaggugaggaguaaugcagccaucggcgcuguuuuuguggacgaaaaccaguggaauuccgccaaagaggcggucgaggaugaacgcuucugggaccuugugcaucgugagcgggaacugcacaagcaggggaaaugcgcaacuugcguauacaacaugaugggaaagagagagaagaaacucggcgaauuugguaaggccaaagggagcagggcuauuugguacauguggcugggagcccgcuucuuggaguucgaggcacugggcuuuaugaaugaagaucacugguucucucgagagaacucgcucucaggcguugaaggggagggacuucauaagcuggguuauaucuuacgggacauuagcaaaauccccggcgggaauauguacgcugaugacaccgccggaugggauacaagaauaacggaggacgaucugcaaaacgaagcuaagaucaccgacauuauggagccggaacacgccuugcucgcaaaauccaucuuuaagcugacuuaucagaauaagguggucagggugcagcgcccugcgaaaaacggcacagugauggaugucauuaguagacgggaccagagggguucugggcaaguuggaaccuacggccuaaauacuuucacaaacauggaggcccagcuuauccgucagauggaaagcgagggcauauuuuccccaucagagcuggaaacccccaaccucgcugggcgagcccuggauugguuggagaagcauggaguggaacgcuuaaaaagaauggcaauuaguggugacgacuguguagugaagccuaucgaugaccgguucgcuacagcccugacugcacucaaugauaugggcaaagucaggaaggacaucccacagugggagcccucuaagggguggaacgauuggcaacaggugccguuuugcagccaccacuuccaucagcuuauuaugaaagacggacgcgaaauaguugugccuuguagaaaucaggaugagcuggucggccgggccagggugucccaaggugcgggguggucacuacgagagaccgcuugccugggaaagagcuaugcccagauguggcagcucauguacuuucaccguagagacuugcgccuggcagccaacgcuaucuguucugccguacccguugauugggugccaacgucccggaccacauggaguauucaugcacaccaucaauggaugacuaccgaagacaugcuuagcgucuggaauaggguguggaucgaggaaaacccuuggauggaggauaaaacacacauuucguccuggggcgacguucccuaucugggcaagagagaagaccaguggugcgggucucucaucggauuaacugcucgcgccaccugggcgacgaauauacagguggcuaucaaccagguccggaggcuguuggguaaugagaacuaccuggauuacaugacaucaaugaaacgauucaagaaugagagcgacccagaaggcgcccucugguga

SEQ ID NO: 13800 - RNA, 9879 nt, Artificial Sequence
  derived and/or modified CDS sequence (opt3) from DENV-1__GQ199821__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucguugucggccuggugacacuauaccucggggugaugguccaggcugauucaggaugcguuauuaacuggaagggccgcgaacugaagugugguagugggaucuuugugacuaaugaggugcacaccuggacggaacaguauaaauuccaagccgacagcccgaagagacuuuccgcagccaucggaaaggcuugggaggagggcguaugcgguauuaggucugccacacgguuggaaaacauaauguggaagcagaucucgaacgagcugaaucauauucuccuggaaaacgacaugaaauuuaccgucgugguuggcgauguggcagggaucuuagcucagggaaagaaaaugauucgcccucagcccauggaguacaaguauagcuggaaguccuggggcaaagccaagaucauaggggcggacguccaaaauacuaccuucaucauugauggaccaaacacaccugaaugucccgacgaucagagagccuggaauaucugggagguggaggacuacggcuuugguauuuucacuaccaacaucuggcugaaacuuagggauucauauacacagguuugcgaccaccguuugaugagugcugcaauaaaggauucuaaagccgugcacgcugacaugggguacuggauugaaagcgagaagaaugaaacguggaagcucgcccgggcauccuucaucgagguaaaaaccuguauuuggccaaagucacauacucuguggagcaacggaguccuagaaucugagaugaucauacccaaaaucuauggcgguccuauuucccagcacaauuaccgaccaggcuacuuuacacaaaccgcggggccguggcaucugggaaagcucgagcuggauuucgaccuuugcgaaggcacuacagugguggucgaugagcacugcgggaacagaggacccaguuugaggaccacgacuguuaccggcaaaaucauucacgaaugguguugccgcagcuguacacugccuccauuacgguuuaagggugaggacgggugcugguauggaauggagaucagacccgugaaggaaaaagaggaaaaucucguaaagucuaugguguccgccggcucaggugaggucgacaguuucagccugggccuucuguguauaucgauuaugaucgaagaggugaugaggucccgcuggucucgaaaaauguugaugaccgggacucucgcuguauuuuuccugcuaaucaugggacagcugacauggaacgaucucauucggcugugcaucauggugggcgccaaugcaagcgaccguauggggaugggaaccacauaccuugcuuugauggccacuuuuaagaugagaccuauguucgcagucggccuguuauuuaggcgccucaccucacgggaggugcugcuucugacgauuggucuaagucucguugccuccguggaacugccaaacucuuuggaggaacugggggauggauuagcuaugggcauaaugauccucaaacugcuuacagacuuccagagccaucaacugugggcgaccuugcucucccugacuuuuauuaagaccacauucucacuacacuaugccuggaagacuauggcaaugguccugagcaucguaagucuuuuuccccucugucugucuaccacgucccagaaaacaaccugguugccggugcuguuaggcagccucgggugcaagccucugacuauguuccuuauugcugagaauaaaaucuggggaagaaagucguggccacugaacgaagguauaauggccguuggcaucgugucaauuuugcucucuagucugcucaagaaugaugucccccuggccgggccucuuaucgcuggaggcaugcucauugcauguuacgugaucuccgguagcucugccgaccugagcuuggagaaggcggcugagguauccugggaagaggaagccgagcauucaggggcaagucacaauauauuaguggaaguccaggaugacggaacaaugaaaauuaaggaugaggagagggacgauacccugacuauccuccugaaggccacacuucuggcuguuagcggcguguaucccuugucuaucccagcaacccuauucgugugguacuuuuggcagaaaaagaaacaacgauccggcguccugugggacacgccuucacccccagaaguggagcgcgccguucucgaugacgggauuuaucggauaaugcagagaggacugcuugguaggagucagguaggcgugggggucuuccaggaaaacguguuucauacuauguggcacguuacccguggagcgguguuaauguaccaaggcaagcgccuggagccgagcugggcuuccgucaaaaaggaccucaucucuuacggugggggauggcgguugcagggcucguggaauacaggcgaggaagugcagguaauugccgucgagccugggaagaaccccaaaaaugugcagaccgcaccaggaacauucaagacuagcgaaggugagguuggcgccaucgcucuggauuuuaaacccgggaccucaggauccccuauugugaacagagaaggcaagaucgucggucucuaugggaauggagugguuacgacaaguggcacuuacgugucugccauagcacaagcuaaagccagccaggagggcccacugcccgagaucgaagacgaggucuucaggaagcgaaaccuuaccauuauggaucugcacccuggguccggaaagacacggcgcuauuugccggcgaucgugagagaagccauuaaaaggaagcuacggacccugauccucgcaccaacucgaguaguggcuucagagauggccgaggcuuuaaaagguaugcccauaagauaccagaccacagcaguuaagucugagcauacgggcaaagagauugucgaccugaugugccacgccacuuuuaccaugcgccuucugagcccugugagggugccaaauuauaacaugaucaucauggaugaagcccauuucacagaccccaguuccauugcugcgcguggguacaucagcacccgggucggaaugggcgaggcagccgcuauauuuaugacugccacaccuccggguucuguagaagcauucccccaaucaaaugccgugauucaggaugaggaaagagacaucccagagagguccuggaacaguggguaugaguggauuaccgauuuuccuggaaagacgguuugguucgugcccagcaucaagucgggcaaugacauagcuaacugucuccgcaaaaauggcaagcgagucauucaguugucuagaaaaacuuucgauacagaauaccagaagaccaaaaacaacgacugggacuacgugguuaccacugauaucuccgagaugggggcgaauuuucgggccgacagggugaucgauccacgccguugccugaagccugucauucucaaggacggacccgaaagagugauccuggcagguccaaugccgguaacaguggcuagcgccgcacaacggaggggccgcauugggcgaaaccacaauaaagagggagaucaguauauauacaugggccagccucuuaacaaugacgaggaucaugcccacuggaccgaagcuaagaugcuacuggacaacaucaauacacccgaggguauuaucccagccuuguucgaacccgagagagaaaaaucagcggcaaucgauggggaguaucgguuaaggggcgaggcccgcaagacuuuuguugaacugaugagaaggggagaccucccugucuggcugaguuacaaaguggcuucugagggcuuccaguauuccgaucggcguuggugcuuugacggggaacgcaacaaucaagugcuugaggaaaacauggaugucgagauuuggacgaaggagggagaacgaaagaaacugagaccaagguggcucgacgcccggaccuacagcgaccccuuggcucugcgcgaguucaaagaauuugcagccgguagaaggucaguuaguggcgaucuaauacuggagaucgggaaacucccucagcaccuuacacagcgggcucagaaugcccuggacaacuuagugauguugcauaauagcgaacaaggaggccgagcauauagacacgcgauggaggagcugccggauacuauugaaacccucaugcugcuugcccugaucgcuguacucacagguggggugaccuuguucuuucuguccggccgcggauuaggcaagacuucuauugggcuacugugugucauggccagcuccgcacuccuuuggaucgcuucaguggagccacauuggauagccgcaucuaucauucuggaguucuuuuugaugguucugcucauccccgagccugacaggcagcggacgccccaggauaaccagcuggccuacguggucauuggacuucucuucaugauccugaccguagcugcgaaugagauggguuugcuggaaacaacuaaaaaggacuuaggcauagggcacguggccguugagaaccaccaucacgcagcuaugcuagauguggaccugcauccagccagugccuggacccucuacgcagucgcuacaaccauuaucacuccuaugaugcgucacacaauugaaaacacgaccgccaauaucucgcuuacugcgauagcuaaccaagccgcaauccugaugggauuggauaaaggcuggcccauuagcaagauggacaucggugugccacugcucgcccuggggugcuauucccaggucaauccucuuacauuaaccgcugcagugcugaugcucguugcccauuacgcgauuaucggcccgggauugcaggcuaaggccaccagagaggcacagaagaggacagccgcuggcauaaugaagaaccccacuguggaugggauuguagccaucgaccuggauccaguggucuaugacgcaaaauuugaaaagcagcuaggacagaucaugcugcucauucuuuguacgucucagauccuguugaugcgcaccacaugggcucugugcgagucaauaacucucgccaccggcccucugacaaccuuaugggaggguagccccgggaaauucuggaauacuacgauugcgguuuccauggccaacaucuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguauuauggagguggaccggagcgaagcuaaggaggggcucaaaagaggagagaccacaaagcacgccgucucucguggcacugccaaacuuaggugguuuguggaacggaaucugguaaaaccagaggguaaggugaucgauuugggcugugggcgcggaggcugguccuacuauugcgcggggcugaaaaagguuaccgaagugaaaggauacacaaagggcgguccugggcacgaggaacccauaccgauggcuacguacggauggaaccucgucaaauuacauucaggcaaggacguguucuuuaucccaccugagaagugugauacccugcuuugcgacauuggcgagagcucgcccaauccaacuaucgaagaggggcgaacacugagaguccuaaaaaugguggaacccuggcucaggggaaaccaguucuguauuaagauccugaauccuuauaugccgucuguuguagagaccuuggagcaaaugcagcggaaacacgguggcaugcuggugcgcaacccccucaguagaaauuccacucaugaaauguacugggucagcugcgggacaggaaacauugugucagcaguuaauaugaccuccaggaugcuucugaaccgauuuacgauggcccaccggaagccaaccuaugagcgugauguggacuuaggcgcugguacaagacacgucgccguggaaccugagguagcaaaccuggauaucauagggcagcgcauugaaaauaucaaacaugagcacaagucuacuuggcauuacgacgaggauaaccccuauaagaccugggccuaccacggaagcuaugaagugaaaccuaguggcuccgcuagcucuaugguuaauggcgucgugaaguugcucacaaaaccaugggacgugauccccauggucacucagauugcgaugaccgauacaaccccuuucgggcaacagaggguuuuuaaggagaaaguggacacucggacgccaaaggccaagagaggaacagcacagauaauggaaguaaccgcuaaauggcugugggguuuccuaucacgcaacaagaaacccaggaucuguacucgagaggaauuuacccggaaggugagaaguaaugccgcaauuggcgccgucuucguggacgagaaccaauggaacuccgcuaaagaggccguugaagaugagagguuuugggaccuugugcaucgcgaacgugagcugcacaagcaggggaagugcgcgacaugcgucuacaacaugaugggaaaacgggaaaagaaacucggcgaguucgguaaggcaaaagggagcagagccaucugguacauguggcugggagcuagguucuuggaguuugaagcccugggcuucaugaaugaggaucacugguuuucucgcgaaaacucgcucucaggcguggagggggagggacuucauaagcuggguuauauuuuacgagacaucagcaaaauaccgggcgggaauauguacgcagaugacacggcuggaugggauacccggaucacugaagacgaucugcagaacgaggccaagauuacagacaucauggaaccugagcacgcuuugcucgccaaguccauuuucaaacugaccuaucagaauaagguaguuagagugcaaaggccagccaaaaacggcacugucauggaugugaucagucgcagagaccagcgggguucuggacaggugggaacauacggccuaaauaccuuuacaaacauggaagcgcagcuuauaaggcaaauggagagcgagggcauuuucucccccucagaacuggagacuccuaaccucgccgggcguguccuggauugguuggaaaagcauggaguugagcgauuaaaacgcauggcuaucaguggugacgacugugugguaaagccaaucgaugacagauuugccaccgcacugacggcucucaaugauaugggcaaggugcggaaagacauuccccagugggaaccgucuaagggguggaacgauuggcagcaggucccuuucugcagccaccacuuucaucaacuuauaaugaaagacggaagggagaucgugguucccugucgcaaucaggaugagcuggugggcagagcccgggucucccagggugcaggguggucacuaagggaaaccgccugccugggaaagagcuaugcgcagauguggcaacucauguacuuccaccgacgugacuugagacuggcugccaacgcaauuuguucugccgugccaguagauuggguuccuacaucccgcacuaccuggaguauccaugcucaccaucaguggaugacaacugaggacaugcuuagcguguggaaucgggucuggauugaagagaaccccuggauggaagauaaaacccacaucucguccuggggcgacgugccauaucugggcaagagggaggaccaguggugcgggucucucauaggauuaacggccagagcaacaugggcuaccaauauccaaguugccauuaaccaggugcgccggcugaucgguaaugagaacuacuuggauuacaugacuucaaugaagagguuuaaaaaugaaagcgaccccgagggcgcgcugugguga

SEQ ID NO: 13801 - RNA, 9879 nt, Artificial Sequence
  derived and/or modified CDS sequence (opt3) from DENV-1__FJ882556__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugccccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagagcaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuaccccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggaagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaucugacaaagagaagccugucaacauagaagcagagccacccuuuggcgaguccuauauugugaucggugccggggaaaaagcucugaagcucucaugguucaagaaaggcaguagcaucggaaagauguuugaggccacugcaagaggcgccaggcggauggcuauucugggggauaccgccugggacuucggauccaucgguggcguuuuuacaucuguggggaaacuuguccaucagauuuucggaacggcauacggcgugcuguuuagcgguguaucauggaccaugaagauagggaucggcguguugcucacuuggcugggauuaaauagucgauccacaagccugucuaugaccuguauugcgguuggccuagucacacucuaccugggggugauggugcaggcugauucaggaugcgucaucaacuggaaaggccgcgaacuuaagugugguagugggaucuucguuacuaaugaggugcacaccuggacggaacaauauaaguuucaggccgacagcccgaaaagauuguccgcagccauuggaaaggcuugggaggagggcgugugcgguauaaggucugccacacggcuggaaaacaucauguggaaacagauuucgaacgagcucaaucauauccuguuagaaaacgacaugaaguucaccguagucgugggcgauguugcagggauucuggcucagggaaaaaagaugauccgcccucaacccauggaguacaaauauagcuggaaguccuggggcaaggccaaaauaaucggggcggacgugcagaauacuaccuuuauuaucgauggaccaaacacaccugaaugucccgacgaucagagagccuggaauauuugggaggucgaggacuacggcuucgguaucuuuacuaccaacauauggcuuaaguugagggauucauauacacaggugugcgaccaccgucucaugagugcugcaauuaaagauucuaaggccguucacgcugacaugggguacuggaucgaaagcgagaaaaaugaaacguggaagcuggcccgggcauccuucauugaggugaagaccuguaucuggccaaaaucacauacucuauggagcaacggaguacuggaaucugagaugauaauccccaagauuuauggcgguccuaucucccaacacaauuaccgaccaggcuacuucacacaggcggccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucagaggugaggacgggugcugguauggaauggagauaaggcccguuaaagaaaaggaggaaaaucuggugaagucuaugguauccgcuggcucaggugagguggacaguuuuagccuuggccuguuguguauuucgaucaugaucgaagaggucaugcgcucccgauggucucggcguaugcucaugacagggacccuggccguguucuuucuacugauuaugggacagcucacuuggaacgaucugaucagacuuugcauuaugguuggcgcaaaugcuagcgacaggauggggaugggaacaaccuacuuggcccugauggcaacauucaaaaugcgcccuauguuugccgugggcuuacucuuccggagacugacuucaagggagguccuucugcuaaccauaggucucagucugguggcuuccguugaauugccaaacucucuggaggaauuaggggauggacucgcgaugggcaucaugauucugaagcuucugacggacuuucaaagccaucaguugugggccacacuccugucccuaaccuucaucaaaacuaccuuuucacugcacuaugcauggaagacaauggcuauggugcuuagcauugucagucucuucccccuguguuugucuacuaccucccagaaaacgacauggcugccgguauuacucggcagccuggggugcaagccucuuaccauguuucugaucgccgagaauaagauauggggacgacgcucguggccauugaacgaagguaucauggccgugggcauuguuucaauccuccugucuagucuacugaaaaacgaugugccccuugcugggccucucauugcaggaggcaugcugaucgccuguuacgucauauccgguagcucugcggacuugagcuuagagaaggcugccgagguguccugggaagaggaagcagagcauucaggggccagucacaauauucugguagaagugcaggaugacggaacuaugaaaaucaaggaugaggagcgggacgauacacucaccauccugcuuaaagcuacucuguuggcagucagcggcguuuauccccuaucuauuccagccacacuguucgugugguacuucuggcaaaagaaaaagcagagauccggcgugcucugggacaccccuucacccccagaagucgagagggcggugcuggaugacgggauauaucguaucaugcagcgcggacuuuuaggucggagucagguuggcguagggguguuucaagaaaacgucuuccauacgauguggcacgugacuagaggagcuguucugauguaccagggcaagaggcucgagccgagcugggccuccgugaaaaaggacuugauuucuuacggugggggauggcgacugcagggcucguggaauaccggcgaggaaguccaggugaucgcaguagagccugggaaaaaccccaagaauguccaaacagccccaggaaccuuuaaaacacccgaaggugaggugggcgcuauugcccucgauuucaagccugggacuagcggaucaccaaucguuaaccgggaaggcaagauagugggucuguaugggaauggagucgugaccacguccggcacauacguuagugcaaucgcucaggccaaagcgucucaggagggcccccuuccugagauugaagacgagguguuucgcaagagaaaccugacuaucauggauuugcacccggggagcggaaaaaccaggcgguaucuaccagccauuguccgagaagcaaucaagagaaaacugcgcacacucauauuagcucccaccagggugguagccuccgagauggcugaagcacugaaggguaugccuauucguuaccaaacuaccgccgugaagucagagcauacaggcaaagagaucguugaccuuaugugccacgccacguucacuaugcggcugcucucuccagucagagugcccaauuauaacaugaucauuauggaugaagcucauuuuaccgacccuagcaguaucgcggcaaggggguacauauccacacgcgugggaaugggcgaggccgcugccauuuucaugaccgcaacuccgcccgguagcgucgaagccuuuccacagucuaaugcuguaauccaggaugaggaacgagacauuccugagagaucauggaacuccggguaugaguggaucacagauuuccccggaaagaccgugugguuuguuccaaguauaaaaagcggcaaugacauugcgaacuguuugcggaagaauggcaaaagggugauccagcugucgcgcaagacguucgauacugaauaccaaaagacaaaaaacaacgacugggacuacgucgugaccaccgauaucucugagaugggggccaauuuccgugcagacagaguuauugauccucggaggugccucaagcccgugauccugaaagacggaccagaacgcgucauucuugcugguccgaugccugugacuguagccuccgcagcccagcgaagaggccggauagggaggaaccacaauaaggagggagaucaguauaucuacaugggccagccccuaaacaaugacgaggaucaugcucacuggacagaagccaaaaugcuguuggacaacauuaauaccccagaggguaucauccccgcguuauuugaaccugagcgcgaaaagagcgcagccauugauggggaguauagacugaggggcgaggcucggaagacauucguggaacucaugcgucgcggagaccugccaguuuggcuuucauacaaagucgccagugagggcuuucaauauucugaucgaagauggugcuucgacggggaaaggaacaaucaggugcuggaggaaaacauggauguggagauauggacuaaggagggagaacggaaaaagcuccgccccagaugguuggacgcuaggacguacuccgacccucuggcacuacgggaguuuaaagaauucgccgcuggucgaagaagcgucucaggcgaucugauccucgagauugggaagcuuccgcagcaccugacccagcgcgcccaaaaugcauuagacaacuugguuaugcugcauaauagugaacagggaggcagggcguaucggcacgccauggaggagcucccagauacaaucgaaacucugaugcuucuggcucucauugccguguugaccggugggguaacacuguuuuucuuaagcggccguggacuaggcaaaaccuccaucgggcugcucugugugauggcaucuagcguccuucuguggauggcuuccguggagccccauuggauagccgcaucaaucauuuuggaauuuuuccugaugguucuccugaucccugagcccgacagacagaggacuccacaggauaaccaacuugccuacguggucauuggacuccuguuuaugaucuugacgguagcugcgaaugagaugggucuguuagaaaccacaaagaaggaccuaggcauagggcacguggccguugagaaccaccaucacgcagcuaugcuggauguggaccuccauccugccucugccuggacucuuuacgcagucgcuaccacaauuaucacccccaugaugcgccacacuauugaaaacacaacggccaauaucagucugaccgcgauagcuaaccaggccgcaaucuugaugggacuggauaaaggcuggccaauuucgaagauggacaucggugugccucuccuggcccuugggugcuauagccaggucaauccguuaacucugacagcugcagugcucauguugguugcccauuacgcgauuaucggccccggacugcaagcuaaagccacccgggaggcacagaagcgaaccgccgcuggcauaaugaaaaacccaacaguggaugggauuguagccaucgaccuagauccuguggucuaugacgcaaaguucgaaaagcagcugggacagaucaugcuccuuauucuguguacuucccaaaucuugcugaugagaacgaccugggcucucugcgagucuauaacacuggccacuggccccuuaaccacacuuugggaggguucaccagggaaauuuuggaauaccacuauugcgguuagcauggccaacaucuucaggggauccuaccuggcaggcgcuggucucgccuucagucuaaugaagucucugggcgggggacgccggggcacgggggcacagggagaaacauugggcgagaaauggaagagacagcugaaucagcucagcaaaucagaauuuaacaccuauaagcguuccgguauuauggagguggacaggagugaagcuaaggaggggcuuaaacggggagagacuaccaagcacgccgucagccgcggcacagccaaacugcgaugguucguggaaagaaauuugguaaagccugaggguaaagugaucgaucugggcugugggaggggaggcuggucuuacuauugcgcggggcucaagaagguuacugaagugaaaggauacaccaagggcggucccgggcacgaggaaccgauaccaauggcuacauacggauggaacuuagucaaacugcauuccggcaaggacguguuuuucaucccucccgagaaaugugauacgcuucugugcgacauuggcgagucaagcccaaaucccaccaucgaagaggggcggacucuacgcguccucaagaugguggaaccuuggcugagaggaaaccaauuuuguauuaaaaucuugaauccguauaugcccucgguuguagagacacuggagcagaugcagaggaagcacgguggcaugcucgugcgaaacccacuuucucggaauaguacccaugaaauguacugggucuccugcgggacuggaaacauugugagcgcaguuaauaugacaucacguaugcuguuaaacagauucaccauggcccaccgcaagccuacguaugagagggauguggaccugggcgcugguacccggcacgucgccguggaacccgagguagcaaacuuggauaucauagggcagagaauugaaaauaucaaacaugagcacaaguccacauggcauuacgacgaggauaacccuuauaaaacuugggccuaccacggaucuuaugaagugaagccaagcggcagugcuuccagcaugguuaauggcgucgugaaacuccugaccaagcccugggacgugaucccuauggucacacaaauugcgaugacugauaccacaccauuugggcagcagcgcguuuucaaggagaaaguggacaccaggacucccaaggccaaacgaggaacggcacaaauaauggaaguaacagcuaaguggcuaugggguuuucuuucucggaacaaaaagccgagaaucuguaccagggaggaauucacucgcaaggugcguucaaaugccgcaauuggcgccgucuuuguggacgagaaccaguggaauagugcuaaagaggccguugaagaugagcgguucugggaccuggugcauagagaaagggagcuccacaagcaggggaaaugcgcgaccugcgucuacaacaugaugggaaagcgcgaaaaaaagcugggcgaguuugguaaggcaaaagggucccgagccaucugguacaugugguugggagcucgguuccuggaguucgaagcccucggcuuuaugaaugaggaucacugguucagcagagaaaacucucuuucgggcguggagggggagggacugcauaaguuagguuauauucugagggacaucucaaaaauaccuggcgggaauauguacgcagaugacacagcuggaugggauacgcgcaucaccgaagacgauuugcagaacgaggccagaauuacugacaucauggaaccagagcacgcucuccuggccaagagcauuuuuaaacuaacauaucaaaauaagguaguucgggugcagaggcccgcaaaaaacggcaccgucauggaugugaucucccgucgagaccagcgcgguagugggcaggugggaacuuacggccuuaauacauucaccaacauggaagcgcaacugauaagacagauggagucugagggcauuuuuagcccuuccgaacucgagacaccaaaccuggccgaacgggucuuggauugguuagagaaguaugggguugaaaggcugaagcgcauggcuaucucaggagacgacugugugguaaaacccaucgaugacagauucgccacugcacucaccgcucuuaaugauauggguaaggugcggaaagacauuccgcagugggagccuaguaagggcuggaacgauuggcagcaaguccccuuuugcucucaucacuuccaccagcugauaaugaaagacgggagggagaucgugguuccaugucgaaaucaggaugaacuagugggacgugccagagucagccagggcgcagguuggucccugcgcgagacggccugccucgggaagucauacgcgcaaauguggcaguugauguauuuucaucggagggaccugagacuugcugccaacgcaauuuguagcgccgugccuguagauuggauccccaccucucgcacaacuugguccauucacgcucaucaccaguggaugaccacagaagacaugcugaguguuuggaaucggguguggaucgaggaaaacccauggauggaggauaagacucauauaagcucguggggagacguccccuaccucggcaaaagggaggaccaauggugcggcuccuuaaucgggcugaccgcccgagcaacgugggcuacaaauauucagguggccaucaaccagguuagacgguugauuggaaaugaaaacuaccuggauuauaugaccucuaugaagagguucaaaaaugagucagacccugaaggugcgcucugguga

SEQ ID NO: 13802 - RNA, 9879 nt, Artificial Sequence
  derived and/or modified CDS sequence (opt3) from DENV-1__GQ199822__SS-prME
agcgugaccaugcugcucaugcuuaugcccaccgcccuggcuuuccacuugacuacgagaggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaagaagaugauucgcccucaacccauggagcacaaauacucguggaaaagcuggggcagagccaagaucauaggggcggacguccagaauacuaccuuuaucauugauggaccaaacacaccugaaugucccgacgaucagagggccuggaauaucugggagguggaggacuauggcuucgguauuuuuacuaccaacaucuggcuuaaguugcgugauuccuacacacagguuugcgaccaccggcucaugucagcugcaauaaaggauaguaaagccgugcaugcugacaugggguauuggauugaaucugagaagaaugaaacguggaaacuggcccgagcauccuucaucgagguaaagaccuguauuuggccaaagucccacacucuauggucaaacggaguccuggaaagcgagaugaucauacccaaaaucuacggcgguccuauuucucaacauaauuauagaccaggcuacuucacacagaccgcggggccguggcaccucggaaagcuggagcuugauuuugacuugugcgaaggcacuacagugguggucgaugagcacugcgggaacaggggacccucccugcgcaccacgacuguuaccggcaaaaucauucaugaaugguguugccggaguuguacauuaccuccacucagauucaagggugaggacgggugcugguacggaauggagaucaggcccgugaaagaaaaggaggaaaaucugguaaagagcauggugucugccggcuccggugaggucgacucauuuagucuuggccuguuguguauaagcauuaugaucgaagaggugaugcgcucgcgauggucccggaaaaugcucaugaccgggacucuggcuguuuuccuacugcucaucaugggacagcugacauggaacgaucuuauucguuugugcaucauggugggcgccaaugcaucugacagaauggggaugggaaccacauaucuggcuuuaauggccacuuuuaagaugaggccuauguucgcagucggccuccuguuucgccggcuuaccagcagagaggugcugcuacucacgauuggucugucauugguugccaguguggaacugccaaacuccuuagaggaacucggggauggacuggcuaugggcauaaugauccuuaaacuguugacagacuuccaaucucaccagcucugggcgacccugcuaagccugacuuuuauuaagaccacacuuucccuccauuacgccuggaaaacuauggcaaugguccugucaaucgucagcuuguucccccuguguuuaaguaccacgucucagaagacaaccuggcucccggugcugcuuggcucccuggggugcaagccuuugacuauguuucucauuacagagaauaaaaucuggggaagaaagagcuggccacugaacgaagguauaauggcuguuggcguggucucgauccuacugucaucucuucucaaaaacgaugugccccuggccgggccuuugauugccggaggcauguuaaucgcuuguuauguaauuagugguuccagcgcagaccugucucucgagaaggccgcggaggugagcugggaagaggaagcugagcacuccggggccucacauaauauccuggucgaaguucaggaugacggaaccaugaaaauaaaggaugaggagcgagacgauacucuuacaauucuguugaaagcaacccuacuggccgugaguggcguguacccccucagcaucccagcuacgcuguucgucugguauuuuuggcaaaagaagaaacagcgcucuggcgugcuuugggacacuccuucacccccagaaguugagcgggcaguauuagaugacgggaucuacagaauuaugcagaggggacugcucggucguagccaggugggcgucgggguguuccaagaaaacguuuuccacaccauguggcacgugacacgcggagccgucuugauguaucagggcaagcggcuggagccgaguugggcgagcgugaaaaaggaccucauauccuacggugggggauggagacugcagggcucuuggaauaccggcgaggaaguacaggucaucgcuguggagccugggaaaaaccccaagaauguucaaacagccccaggaacuuuuaagacccccgaaggugaggugggcgcaauugcccuugauuucaaaccugggacgucgggaagcccaaucgucaacagggaaggcaagauugugggucuguacgggaauggaguugugacaacuucaggcaccuaugucuccgcuaucgcccaggcaaaagcuagucaggagggccccuugccugagauagaagacgagguguuucgaaagcggaaccuaacaaucauggaucugcauccggggucuggaaaaacccgcagauaccucccagccuuaguaagggaagcgauuaagcggaagcugcgaacucuuauccuggcccccaccagagugguugcaagcgagauggcugaagcccucaaagguaugccuauucgcuaucaaacaacggcugucaaguccgagcacacuggcaaagagaucguggacuugaugugccaugcaaccuucacaaugaggcugcucucaccagugcguguccccaauuacaacaugauaauuauggaugaagcccacuuuaccgacccuucuagcaucgccgcucggggguauaucaguacuagaguaggaaugggcgaggcggcagccauuuucaugacagcuaccccgcccgguuccguggaagccuuuccacagagcaaugcaguuauccaggaugaggaaagggacauaccugagcgcucuuggaacucaggguacgaguggauuacggauuuccccggaaagacugugugguuugucccauccaucaaaaguggcaaugacauugccaacugucugcgaaagaauggcaagagagugauccagcuuagccggaaaacauucgauaccgaauaucaaaagaccaaaaacaacgacugggacuacguugugacuacagauauaucggagaugggggcuaauuuuagggcggaccgcgucauugauccucguagaugccuaaagcccgugauccugaaagacggaccagaacggguaaucuuggccgguccgaugccugugaccguugcaucugcugcccagaggcgcggccgaauugggagaaaccauaauaaggagggagaucaguacaucuauaugggccagcccuuaaacaaugacgaggaucacgcacacuggacagaagccaagaugcugcucgacaacauuaauacuccagaggguauaauccccgcucuguucgaaccugagcgggaaaaauccgccgcgauugauggggaguacaggcuucgcggcgaggcaagaaagacguucgucgaacugaugaggcggggagaccucccagugugguugagcuauaaaguggccucagagggcuuucaauacagugaucgucgcuggugcuucgacggggaacgaaacaaucagguccuggaggaaaacauggauguugagaucuggaccaaggagggagaaaggaaaaagcuaaggccccgguggcuggacgcucgcacauauucugacccucucgcccuuagagaguuuaaagaguucgcugcagguaggcgguccgugagcggcgaucugaucuuagagauugggaaguugccgcagcaucugacucagcgagcccaaaaugcucucgacaaccugguaaugcuucacaauucagaacagggaggcagagccuaccgccaugcaauggaggagcugccagauaccauagaaacacucauguugcuggcguuaaucgccgugcuaaccgguggggucacucuguuuuuccucaguggcaggggacuuggcaagacgagcauugggcuguugugugugauggcuuccucuguucugcucuggauggccagcguggagccccacuggaucgcagcuuccauuauccuggaauuuuuccuuaugguccuccugauaccugagcccgaccggcagcguaccccacaggauaaccaauuggccuauguagugaucggacuguuauuuaugauucuaacaguugcagccaaugagaugggucugcucgaaacuaccaaaaaggaccuuggcaucgggcacguggcugucgagaaccaucaccaugcgacaaugcuggauguggacuugcacccugccucagcauggacccuguacgcugucgccacuacaauuaucacgcccaugaugagacauaccauagaaaacacuacagccaauauuucucucaccgcaaucgcuaaccaggccgcgauucugaugggacuugauaaaggcuggccaaucaguaagauggacauaggugugccuuuacuggcucucgggugcuacucgcagguuaauccguugacccugacagccgcagugcuaaugcugguagcccacuaugcuaucauuggccccggacuccaagcaaaagccacuagggaggcgcagaagcgcacggcugccggcaucaugaagaacccaaccguggaugggauugucgcaaucgaccuugauccuguuguguacgacgccaaauucgaaaagcagcugggacagauaauguugcugauucucuguacaagccaaauccuguuaaugcggacuaccugggcucuuugcgaguccaucacacuggccaccggcccccucacuacgcuaugggaggguucuccagggaaauuuuggaauacaaccauugcagucucaauggcuaacaucuuccgaggaagcuaucuggccggcgcggguuuggccuuuucccugaugaagagucucggcgggggaagaaggggcacuggggcacagggagaaacccuuggcgagaaauggaagcgccagcugaaucaguugucuaagagcgaguucaacauauacaaacggucagguauuauggagguggacagauccgaagcuaaggaggggcugaaacguggagagacaacuaggcacgccguaagucggggcaccgcaaagcuccgcugguucguggaacgaaauuuaguuaaaccugaggguaaggugaucgaucugggcugugggagaggaggcuggagcuauuacugcgcugggcuuaagaaagucacagaagugaagggauauacgaaaggcggucccgggcaugaggaaccgauuccaauggccaccuacggauggaaccuggucaagcuacacucuggcaaagacguguuuuucacuccucccgagaagugugauacacuccugugcgacaucggcgaguccucaccaaaucccaccauagaagaggggaggacuuugcggguucugaaaaugguagaaccuuggcuccgcggaaaccaauuuuguaucaagauucuuaauccguacaugcccagcguggucgagacacuggagcagaugcagagaaagcaugguggcauguuagugaggaacccacugucgcgaaauucuacccacgaaauguauuggguuaguugcgggacgggaaacaucguguccgccgucaauaugaccagccggauguugcucaaccguuucacaauggcgcacagaaaaccuacuuacgagcgcgauguggaccugggcgcugguaccaggcauguagcaguggaacccgagguugccaaccuagauauuaucgggcagcggauugaaaauaucaagcacgagcauaaaucaacauggcacuaugacgaggauaacccuuacaagacuugggcuuaucauggauccuacgaagucaaaccaucuggcagcgccaguuccauggugaauggcguggucaaacuucugaccaagcccugggacguuauaccuauggugacacaaauugcaaugaccgauacuacgccauuugggcagcagagaguauucaaagagaagguggacacacgcacccccaaagccaagaggggaacugcucaaaucauggaagucaccgcgcgauggcucugggguuuucugagccggaacaaaaagccgagaaucuguacaagggaggaguucacgcgcaaggugcguucuaaugccgcaauuggcgcuguuuuuguggacgagaaccaguggaacucagccaaagaggcagucgaagaugagcgguucugggacuuggugcagaaggaaagagagcugcacaaacaggggaagugcgcaaccugcguauauaacaugaugggaaaaagggaaaagaagcucggcgaguuugguaaagcuaaggggagucgcgccauaugguacauguggcuuggagcgcgauuccuggaguuugaagcauuaggcuucaugaaugaggaucacugguucucccgggaaaacagccugucuggcguugagggggagggauugcauaaacucgguuacauccugagagacauuucgaagaucccuggcgggaauauguaugccgaugacacugcuggaugggauacaaggauuaccgaagacgaucuacaaaacgaggccaaaaucacugacauaauggaaccagagcacgcacuucuggcuacaucaaucuuuaagcucaccuaccagaauaaagugguccgcgugcagagacccgccaagaacggcacagugauggaugucauuagccggagggaccagcgugguuccgggcaaguuggaacuuauggccugaauaccuucacgaacauggaagcucaguugauccgacagauggagagugagggcauauuuuuaccuucugaacuggagaccccaaaccucgccgaacgcgugcuugauuggcuggagaaguacgggguagaaagacuaaaacggauggcaaucagcggagacgacuguguggucaagcccauagaugacagguucgcgacagcccugacugcucucaaugauauggguaaagugcgcaaggacauuccgcagugggagccuuccaaaggcuggaacgauuggcaacagguucccuuuugcucacaucacuuccaccaguugaucaugaaggacgggagagagaucguggucccaugucggaaucaggaugaacuggugggaagggcccgaguaagucaaggcgcagguuggucucuucgugagaccgcuugccugggaaagagcuaugcccagauguggcagcucauguacuuucauagacgcgacuuacggcuggcagccaacgcgauuuguuccgcuguuccuguggauuggguccccacaucaaggacuaccuggagcauacacgcccaucaccaauggaugacgacagaagacauguugucuguguggaauagaguuuggaucgaggaaaacccauggauggaggauaaaacccauguguccaguuggggagacguccccuaucugggcaagcgcgaggaccaguggugcggcagccucauugggcuuacugcacgggccacaugggcuucgaauauccagguggccauuaaccagguaaggcgacugaucggaaaugaaaacuaccuagauuacaugaccuccaugaaaagauucaagaaugagggugacccugaaggcgcacugugguga

SEQ ID NO: 13803 - RNA, 9879 nt, Artificial Sequence
  derived and/or modified CDS sequence (opt3) from DENV-1__FJ882557__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaacaugugcacacuaauugccauggaccucggagaacugugugaagauacuaugaccuacaaaugcccacggauuacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaagaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguacuucacacagaccgccggaccguggcaucugggcaaacuugaguuggauuucgaccugugcgaagggacuacagugguagucgaugagcacugcggaaacagaggccccuccuuaaggaccacgacugugaccgguaagaucauacacgaaugguguugccgcaguuguacacucccuccacugcgguuuagaggggaggacggaugcugguauggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaccuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaucagcucugggccacccugcuaucucugacuuucauuaagaccacauuuagccuucacuaugcauggaaaacuauggcuauggugcucuccaucguuucacuguuccccuugugucugagcaccacgagucagaagacaaccugguuaccggugcuccuggggucucuuggaugcaagccucugacuauguuuuugauagccgagaauaaaaucugggguaggaaguccuggccacucaacgaaggcauuauggccgucgggaucguaagcauucugcuaucgucacugcuuaaaaacgaugugccccucgcuggaccucugaucgcaggcgguauguugauagccuguuacguuauuucugggaguuccgcggacuuaagccuggagaaggcugccgaggugucuugggaagaggaagcagagcauagcggagccucccacaauauccucgucgaagugcaggaugacggcacaaugaaaaucaaggaugaggagcgagacgauacccugacuauucuucugaaagcuacauugcuagcaguaucaggcguguauccccugaguauaccagccacccucuucgucugguacuucuggcaaaagaagaaacagcgcagcgggguucugugggacacgccuucucccccagaaguggagcgggcggugcuugaugacggaaucuauagaauuaugcagagggguuuacugggccguucccaggucggggugggaguuuuucaagaaaacguauuccauacuauguggcacgugacccgcggcgcuguccucauguaccaggguaagcgguuggagccgucaugggccagugugaaaaaggaccugaucagcuacgggggaggcuggagacucaggggcuccuggaauacaggggaggaaguucaggugauugcagucgagccuggcaaaaaucccaagaaugugcagaccgccccagguacauuuaagacucccgaaggcgagguaggggcuaucgcccuggauuucaaaccuggaaccucuggcucgccaauagucaaccgagaagguaagaucguggggcuuuauggaaauggcguugugacgacaagcggcacuuacgucucagcaauugcucaagccaaagcgucccaggaggggccccugccugagaucgaagacgagguguuucggaagcgcaacuugaccauuauggaucuacacccgggaagugguaaaacaagaagguaucugccagccaucguucgggaagcaauaaagcgaaagcucagaaccuuaauucuggcucccacucgcguggucgccucugagauggcugaagcacuuaaaggcaugccuaucagguaccagaccacagccguaaagagcgagcauacggggaaagagaucguagaccugaugugccacgccacuuucaccaugcgucucuuguccccagugcggguucccaauuauaacaugauuaucauggaugaagcucauuuuacagacccuucaucuauagcggcaagaggauacauuagcaccagggucggcaugggugaggccgcugccaucuucaugacugcaacaccgcccgggaguguggaagccuuuccacaauccaaugcugugauucaggaugaggaacgcgacaucccugagcgaagcuggaacucuggacacgaguggauaaccgauuuccccggcaagacggucugguuuguaccaucaauuaaauccggcaaugacaucgcgaacugucugagaaagaaugggaagcgggugauccagcucaguaggaaaacuuucgauacagaauaucagaagaccaaaaacaacgacugggacuacguugugaccacugauauuagcgagaugggagccaauuuccgcgcagaccgugucaucgauccuagacggugccugaagcccgugauucuuaaagacgguccagaaaggguuauacuagcuggcccgaugccugugacagucgccucggcagcccaacgccgagggagaaucggacggaaccauaauaaggagggcgaucaguacauuuauaugggucagccccugaacaaugacgaggaucacgcucacuggaccgaagccaagauguuguuagacaacaucaauacaccagaggggaucauucccgcgcuguuugaaccugagagggaaaaaucugcagccguggauggcgaguaccgccucagaggagaggcuaggaagacuuucguagaacugaugcggcguggcgaccuuccaguguggcuguccuauaaaguugccagcgagggguuucaguacucagaucgccgauggugcuucgacggagaaagaaacaaucaaguccucgaggaaaacauggauguggagauauggacgaaggagggugaaaggaaaaaguugcggccccgcuggcuggacgcuagaaccuauagugacccucuagcacugagggaguuuaaagaguucgccgcuggccggcgaucuguguccggggaucucauccuugagauuggaaagcugccgcagcauuuaacacagagagcccagaaugcauuggacaaccuggucaugcuccacaauagcgaacaaggcggucgcgcguacaggcaugccauggaggagcugccagauacuaucgaaacccuuaugcugcucgcuuugauugccguucugacagggggcgugaccuuauuuuuccuaucaggacggggccuggggaagacaaguaucggacuccuuuguguaauggcaagcuccgugcuguuguggauggcuucugucgagccccacuggauagccgcaagcaucauucuggaauuuuuccucauggugcugcuuaucccugagcccgaccgucagagaacgccacaggauaaccagcucgccuauguugugauuggucuguuguuuaugauccugaccgucgcugcgaaugagaugggcuuacuagaaacaacuaaaaaggaccuggggauaggacacguagccguggagaaccaucaccaugcagcuaugcucgauguugaccuucacccugccuccgccuggacccuguacgcaguggcuacaaccauuaucacucccaugaugaggcauacaauugaaaacacgaccgccaauaucucauugacugcgauagcuaaccaagccgcaauccugaugggccucgauaaagguuggccaauuucuaagauggacaucggggucccucugcuugccuuaggcugcuacagucaggugaauccgcugacaaugaccgcugcaguccucauguugguggcccacuaugcgauuaucggacccggccugcaggcuaaagccacccgcgaggcacaaaagcggacagccgcugggauaaugaagaacccaacuguugauggaauuguggccaucgaccuagauccuguaguguacgacgcaaaauucgaaaagcagcugggccagaucaugcuccuuauucuguguacgucgcagaucuugcugaugcgaaccacaugggcucucugcgagagcauaacucuggccaccggucccuuaacaacccuuugggagggguccccaggaaaauuuuggaauacuacgauugcggucucuauggccaacaucuucagaggcucauaucuggcaggagcuggccucgccuucagccuaaugaagucccuaggggguggcaggcgcgggacaggagcacaaggcgaaaccuugggugagaaauggaagcggcagcugaaucagcucaguaagucugaauuuaacacuuacaaaagaagcgggauuauggagguugaccguucagaagcuaaggagggacuuaaaaggggcgagaccacaaagcacgccgugucccgggguacugccaaacugcgcugguucgucgaacgaaauuuggugaagccugagggcaagguaaucgaucugggguguggaagaggcggguggaguuauuacugcgcgggacucaaaaaggugaccgaaguuaaaggcuauacaaagggugggcccggacaugaggaaccgauaccaauggcuacguacggcuggaacuuagugaaacugcacagcggcaaggacgucuuuuucaucccucccgagaaaugugauacccuucugugcgacauuggggagucuuccccaaaucccacuaucgaagagggaaggacacuacgggugcucaagauggucgaaccuuggcugcgcgguaaccaguuuuguauuaagaucuugaauccguacaugcccucagugguugagacccuggagcaaaugcagagaaaacauggcgggaugcucguaaggaacccacuuagccgaaauucgacucacgaaauguauugggugucuugcggaacaggcaacauugucagugcagugaauaugaccucccggaugcuguuaaaccguuucacgauggcccacagaaagccuaccuacgagcgcgauguugaccuggguacagggacuaggcauguggcugucgaacccgagguggccaacuuggauaucauaggacagcggauugaaaauaucaaacacgagcauaagagcaccuggcacuaugacgaggauaacccuuacaaaacaugggcauaucauggcucauacgaaguaaagccauccggcucugccagcaguauggugaaugggguugucaagcuccugacuaaacccugggacgugaucccuauggugacccagauugcuaugacagauaccacuccauuuggacaacagagagucuucaaggagaaaguugacacgcgcacacccaaggcgaaaagggguaccgcccagauaauggaagugacugcacgauggcuauggggcuuucuuucccggaacaagaagccgagaaucuguaccagggaggaguucacacgcaaaguacguagcaaugcugccauuggggcaguguuugucgacgagaaccaauggaacucugccaaggaggcuguggaagaugagcgguucugggaccugguucacagagaaagggagcuccacaaacagggaaagugcgccacgugcguguauaacaugaugggcaaacgcgaaaagaagcugggugaguuugggaaagcgaagggaucacgagcaaucugguacaugugguugggcgcccgguuccuggaguucgaagcucucggcuuuaugaaugaggaucauugguucaguagagaaaacucccuuagcggggucgagggagagggucugcacaaauuaggcuacauucugagggacaucucuaagauaccugggggaaauauguaugccgaugacaccgcaggcugggauacucgcaucacagaagacgauuugcagaacgaggcuaaaauuaccgacaucauggaaccagagcaugcccuccuggcuaaggccauuuuuaaacuaacuuaccagaauaaggugguaagaguucaacggcccgcaaagaacgguacagugauggaugucaucucgaggcgugaccagcgagggucaggacaggugggcaccuauggccuuaauacauucacuaacauggaagcgcagcugauacgccaaauggagagcgaggggauauuuuccccuagugaacucgagaccccaaaccuggccgaaagagcuuuggauugguuagagaaauacggaguggaacggcugaagaggauggccaucucuggugacgacugugucguuaaacccaucgaugaccgcuucgcaacggcucucaccgcccuuaaugauaugggcaaggugagaaaagacauuccgcagugggagccuagcaagggguggaacgauuggcagcagguacccuuuugcucccaccacuuccaucaacugauaaugaaggacggacgggagaucguggucccauguaggaaucaggaugagcuggugggccgagcacguguuucacagggugccggguggagucugagagagacagcgugccucggaaaaucuuaugcucagauguggcaauugauguacuuucaccgccgggaccugaggcuugccgcaaacgccauuuguagcgcugugccugucgauugggugcccacuuccagaaccacauggucaauccaugcccaccaucaguggaugacuaccgaagacaugcugagcguauggaaucgcguuuggauugaggaaaacccauggauggaggauaagacgcacaucucuuccugggaggacgugcccuaucucggcaaacgggaagaccaguggugcggcaguuuaauagggcugacagcaagggcuaccugggccacuaauauccaagucgcgauuaaccaggugcgaagauugaucggaaaugagaacuaccuggauuacaugacaagcaugaagcgguucaaaaaugaaucggacccugagggugcucucugguga

SEQ ID NO: 13804 - RNA, 9879 nt, Artificial Sequence
  derived and/or modified CDS sequence (opt3) from DENV-1__FJ882558__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucaccccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacuagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacaagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcuaaaaaacgaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucugaccgucagcggcguuuaucccuugucuaucccagcaacgcuauucgugugguacuuuuggcagaaaaagaaacaacgauccggcgugcugugggacacuccuucacccccaaaggucgaacgcgccgugcucgaugacgggauuuaucggauaaugcagagaggacugcuugguaggagucagguuggcguagggguguuccaggagaacgucuuucauaccauguggcacgugacacguggagcgguuuuaauguaccaaggcaaacgccuggaaccgagcugggcuuccgugaagaaggaccucaucucuuacggugggggauggcgguugcagggcucguggaauaccggcgaggagguccaggugauugccguagaaccugggaaaaaccccaagaauguccagacagcaccaggaacuuucaaaaccagcgagggugaagugggcgccaucgcucuggauuuuaagcccgggacgucaggauccccuauuguuaacagagagggcaaaaucgugggucucuaugggaauggagucgugacaacuaguggcaccuacguuucugccauagcacaagcuaaggccagccaggaaggcccacugcccgagaucgaggacgaaguguucaggaagcgaaaccuuacaauuauggaucugcacccuggguccggaaaaacccggcgcuauuugccggcgaucgucagagaggccauuaagaggaaacuacggacucugauccucgcaccaacccgagugguagcuucagaaauggccgaggcuuuaaaggguaugcccauaagauaccagacaacggcagugaaaucugaacauacuggcaaggagauuguugaccugaugugccacgccaccuuuacaaugcgccuucugagcccugucagggugccaaauuauaacaugaucaucauggaugaggcccauuucaccgaccccaguuccauugcugcgcguggguacaucagcacucgggugggaaugggcgaagcagccgcuauauuuaugacagccaccccuccggguucugucgaggcauucccccaaucaaaugccguaauucaggaugaagagagagacaucccagaaagguccuggaacaguggguaugaguggauuacggauuuuccuggaaagacugugugguucguucccagcaucaaaucgggcaaugacauagcuaacugucuccgcaagaauggcaaacgagugauucaguugucuagaaagacauucgauaccgaguaccagaaaaccaagaacaacgacugggacuacgucgugacuacagauaucuccgaaaugggggcgaauuuucgggccgacaggguuaucgauccacgccguugccugaagccugugauucucaaagacggacccgagagagucauccuggcagguccaaugccggugaccguagcuagcgccgcacaacggaggggccgcauugggcgaaaccacaauaaggaaggagaucaguauauauacaugggccagccucuuaacaaugacgaggaucaugcccacuggacagaggcuaaaaugcuacuggacaacaucaauacucccgaagguauuaucccagccuuguucgagcccgaaagagagaagucagcggcaaucgauggggaauaucgguuaaggggcgaggcccgcaaaacguuuguggagcugaugagaaggggagaccucccuguuuggcugaguuacaaggucgcuucugaaggcuuccaguauuccgaucggcguuggugcuuugacggggagcgcaacaaucaagugcuugaagagaacauggauguggaaauuuggaccaaagagggagagcgaaagaagcugagaccaagguggcucgacgcccggacauacagcgaccccuuggcucugcgcgaauucaaagaguuugcagccgguagaaggucagucaguggcgaucuaauacuggaaaucgggaagcucccucagcaccuuacucagcgggcucagaaugcccuggacaacuuaguuauguugcauaauagcgagcaaggaggccgagcauauagacacgcgauggaagagcugccggauaccauugagacaaugaugcuccuggcccuuaucgcugugcugaccggugggguaacucucuucuuuuuguccggccgcggacugggcaaaacgucuauuggguuacuaugugugauggccagcuccguccugcucuggauggcaucaguggaaccacauuggaucgcugccucuauaauccuugaguucuuucugaugguuuugcugauucccgaaccugacaggcagcggaccccccaggauaaccagcucgcauacguggucaucggacugcuuuucaugauucucacaguagccgcuaaugagaugggucuguuggagacuaccaagaaagaccugggcaucgggcacguggcgguugaaaaccaccaucacgccgcaauguuagauguggaccuacauccagcuagugccuggacacuguacgccgucgcaaccacuauaauuacaccuaugaugcgucacacgaucgagaacaccacugcuaauauuucgcucacagccaucgcgaaccaagcugccauacuuaugggacuggauaagggcuggcccaucagcaagauggacauuggugugccauugcuggcacucgggugcuauucccaggucaauccucugacccuuaccgccgcuguguuaaugcugguugcacauuacgccaucauuggcccgggacuccaggcgaaagcuacaagagaagcccaaaagaggacugcagccggcaucaugaaaaaccccacgguggaugggauaguagcuauugacuuggauccaguggucuaugacgccaaguuugagaaacagcugggacagaucaugcuacugauccucuguaccucucagauucuucugaugcgcacaacuugggcauugugcgaaucaaucacccuggcuacaggcccucucaccacucugugggaggguagccccgggaaguucuggaauacgacaauagccguuuccauggcgaacauuuuccggggaaguuacuuagccggcgcaggucuugcuuuuucucugaugaagagccucggcgggggacgaagaggcaccggggcccaaggagagacucuaggcgaaaaauggaagaggcagcugaaucaguugucaaaauccgaguucaacaccuauaagcgcagugguaucauggaaguggaccggagcgaggcaaaagaagggcugaagagaggagagacaacuaagcacgcugucucucguggcaccgccaaacucaggugguuuguggagcggaaucuuguaaagccagaagguaaagugauugaucugggcugugggcgcggaggcugguccuacuauugcgccggguugaagaaaguuacagaggugaagggauacacgaaaggcgguccugggcacgaagagcccaucccgauggcgaccuacggauggaaccuggucaagcuccauucaggcaaggacguguucuuuauaccaccugaaaaaugugauacuuuacugugcgacaucggcgagagcucgcccaauccaacaauugaggaagggcgaacccuuagaguccugaagaugguggagcccuggcuaaggggaaaccaguucuguaucaaaauucucaauccuuauaugccgucuguuguagaaacucuggagcaaaugcagcggaagcacgguggcauguuggugcgcaacccccugaguagaaauuccacacaugagauguacugggucagcugcgggaccggaaacaucgugucagcuguuaauaugacguccaggaugcuccuuaaccgauuuaccauggcacaccggaaaccaacauaugaacgugauguggaccugggcgccgguacuagacacgucgcuguggagccugaaguagccaacuuagauauuaucgggcagcgcauagagaauauuaagcaugaacacaagucuaccuggcauuacgacgaggauaaccccuauaaaacaugggcauaccacggaagcuaugaggugaagccuaguggcuccgccagcucuaugguuaauggcgucgugaaacuguugacuaagccaugggacgugauccccauggucacccagaucgcuaugacagauaccacuccuuucgggcaacagaggguuuuuaaagaaaagguggacacgcggacaccaaaggcgaaaagaggaaccgcccagauuauggagguaacugcaaaguggcucugggguuuccugucacgcaacaaaaagcccaggauauguacccgagaagaguuuacacggaaagugagaaguaaugcugccaucggcgcagucuucguggacgaaaaccaauggaauuccgccaaggaggcuguugaggaugaaagguuuugggaccuagugcaucgcgagcgugaacuucacaagcaggggaaaugcgccacgugcgucuacaacaugaugggaaagcgggagaaaaagcugggcgaauucgguaaagcgaaggggagcagagcaauuugguacauguggcucggagccagguuccuggaguuugaggcuuugggcuucaugaaugaagaucacugguuuucucgcgagaacucgcugucaggcguggaaggggagggacuccauaaacuugguuauauccugcgagacauuagcaagaucccgggcgggaauauguacgccgaugacaccgcaggaugggauacucggauaacagaggacgauuuacagaacgaagcuaagaucaccgacauuauggagccugaacacgcccuguuggcuaaauccaucuucaagcucacuuaucagaauaaaguaguuagagugcaaaggccagccaagaacggcacagucauggaugugauuagucgcagagaccagcgggguucugggcaggugggaaccuacggccugaauacauuuacuaacauggaggcacagcuaaucaggcaaauggaaagcgagggcauauucucccccucagagcuugaaaccccuaaccuggcgcgucgaguccucgauuggcuggagaaacaugggguugaacgcuugaagagaauggccauuaguggagacgacugugugguaaagccaaucgaugaccgguuugcuacggccuuaaccgcacugaaugauauggguaaagugaggaaggacaucccccagugggagccgucuaaaggcuggaacgauuggcagcaggucccuuucugcagccaccacuuucaucaacucauuaugaaggacgggcgcgaaauagugguucccuguagaaaucaggaugagcuugugggacgggcuagggucucccagggcgccgguuggucacugcgagagacagcaugccuagggaaaagcuaugcccagauguggcaacugauguacuuccaccguagagaccuccgcuuggcggcuaacgccaucuguucugcagugccaguagauuggguuccuacuucccggaccacauggaguauucaugcccaccaucaguggaugacuaccgaagacaugcugagcguguggaauagggucuggaucgaggaaaaccccuggauggaggauaagacgcacauuucguccuggggagacgugccauaucuuggcaagagagaagaccaguggugcggcucucugaucgggcucacagcucgcgccaccugggcaacuaauauacaaguugcuaucaaccaggugcggagguuaauuggaaaugagaacuaccuggauuacaugacaucaaugaaacgauuuaagaaugagagcgaccccgaaggugccuugugguga

SEQ ID NO: 13805 - RNA, 9879 nt, Artificial Sequence
  derived and/or modified CDS sequence (opt3) from DENV-1__GQ199824__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagauccugaacgagcucaaucauauucuguuagaaaacgacaugaaauuuaccguagucgugggcgauguugcugggauccuggcccagggaaagaaaaugauucgcccucagcccauggaguacaaguauucguggaaaagcuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcuuaaauugagggauuccuauacacaggugugcgaccaccgucucaugucagcagccauaaaggauaguaaagcuguucacgccgacaugggguacuggauugaaucugagaagaaugaaacguggaagcuggcacgggcgagcuucaucgaggugaaaaccuguauuuggccaaagucccauacucuauggucaaacggaguacuggaaagcgagaugaucauacccaaaaucuauggcgguccuauuucucagcacaauuaccgaccaggcuacuuuacacaaaccgccgggccguggcaucucggaaagcuggagcuugauuucgacuugugcgaaggcacuacagucgugguggaugagcacugcgggaacagaggacccucccugaggaccacgacugucaccggcaaaaucauucacgaaugguguugccgcaguuguacauuaccuccacuccgguuuaagggugaggacgggugcugguauggaauggagaucagacccguuaaggaaaaagaggaaaaucuggugaaguccaugguaucugcuggcuccggugagguggacucauucagucuuggccuguuguguauaagcauuaugaucgaagaggucaugaggucgcgcuggucccgaaaaaugcucaugaccgggacucuggccguguuuuuccuacugaucaugggacagcucacauggaacgaucugauucggcuuugcaucaugguuggcgcaaaugcuucugaccguauggggaugggaaccacauacuuggcccugauggcaacuuuuaagaugagaccuauguucgccgugggcuuacucuuuaggcgccugaccagccgggagguccuucugcuaacgauuggucucucacugguggcuaguguugaauugccaaacucccuggaggaauuaggggauggacucgcgaugggcauaaugauccugaaacuucugacagacuuccagucucaucaauugugggccacccuccugagccuaacuuuuauuaagaccacauucucccugcacuaugcauggaagacuauggcuauggugcuuucaaucgucagccucuuuccccuguguuugaguaccacgucucagaaaacaaccuggcugccgguauuacucggcucccuggggugcaagccucuuacuauguuccugauugccgagaauaaaaucuggggaagaaagagcuggccauugaacgaagguauaauggccgugggcaucguuucgauucuccugucaucucuacugaaaaacgaugugccccuugcugggccucucaucgcaggaggcaugcugauugccuguuacgucaucagugguuccagcgcggacuugucuuuagagaaggcugccgaggugagcugggaagaggaagcagagcauuccggggccucacacaauauacugguagaagugcaggaugacggaacaaugaaaauuaaggaugaggagagggacgauacccucacuauccugcuuaaggcuacacuguuggcagucaguggcguuuauccccuaagcaucccagccacccuguucgugugguacuuuuggcagaaaaagaaacaacgaucuggcgugcucugggacacgccuucacccccagaagucgagcgcgcggugcuggaugacgggauuuaucggauaaugcagagaggacuuuuagguaggagccagguuggcguagggguguuccaggaaaacgucuuucauacuauguggcacgugacccguggagcuguucugauguaccaaggcaagcgccucgagccgaguugggccagcgugaaaaaggacuugaucuccuacggugggggauggcggcugcagggcucuuggaauacaggcgaggaaguccaggugauugcaguagagccugggaagaaccccaaaaauguccagaccgccccaggaacauucaagacuucggaaggugaggugggcgcuaucgcccucgauuuuaaacccgggaccagcggaucaccuauuguuaacagagaaggcaagaucgugggucuguaugggaauggagucgugacgacauccggcacuuacguuagugcaauagcucaagccaaagcgucucaggagggcccacuucccgagaucgaagacgagguguucaggaagcgaaaccugaccauuauggauuugcacccugggagcggaaagacacggcgcuaucuaccggccaucgucagagaagcaauuaaaaggaagcugcggacccucaucuuagcuccaacucgagugguagccuccgagauggcugaagcacugaaagguaugcccauaagauaccagaccacagccgugaagucagagcauacgggcaaagagauuguugaccuuaugugccacgccacuuuuaccaugcgccugcucucuccugucagggugccaaauuauaacaugaucaucauggaugaagcucauuucacagaccccagcaguauugcggcacguggguacaucuccacccgggugggaaugggcgaggccgcugccauauuuaugacugcaacaccuccggguagcgucgaagccuucccccaaucuaaugcuguaauucaggaugaggaaagagacaucccagagaggucauggaacuccggguaugaguggauuaccgauuuuccuggaaagacggugugguucguucccaguaucaagagcggcaaugacauagcgaacuguuugcgcaaaaauggcaagcgagugauucagcugucgagaaaaacuuucgauacagaauaccagaagaccaaaaacaacgacugggacuacgucgugaccacugauaucucugagaugggggccaauuuucgggcagacaggguuaucgauccacgccguugccucaagccugugauucugaaggacggacccgaaagagucauccuugcugguccaaugccggugacaguagccuccgcagcccaacggaggggccgcauugggcgaaaccacaauaaagagggagaucaguauauauacaugggccagccucuaaacaaugacgaggaucaugcucacuggaccgaagccaagaugcuguuggacaacaucaauacacccgaggguauuaucccagcguuauucgaacccgagagagaaaagagcgcagccaucgauggggaguaucggcugaggggcgaggcucgcaagacuuuuguggaacucaugagaaggggagaccugccuguuuggcuuucauacaaagucgccagugagggcuuccaguauucugaucggcguuggugcuuugacggggaacgcaacaaucaagugcuggaggaaaacauggauguggagauuuggacgaaggagggagaacgaaagaaacucagaccaaggugguuggacgcucggaccuacuccgacccccuggcacuacgcgaguucaaggaauuugccgcugguagaaggagcgucucaggcgaucugauacucgagaucgggaaacuuccucagcaccugacacagcgggcccagaaugcauuagacaacuugguuaugcugcauaauagugaacaaggaggccgagcguauagacacgccauggaggagcucccggauacuauugaaacccugaugcuucuggcucucaucgccguguugacaggugggguaacccuguucuuuuuaagcggccgcggacuaggcaagacuuccauugggcugcucugugugauggcaucuagcguccuucuguggauggcuuccguggagccacauuggaucgccgcaucaauaaucuuggaguucuuucugaugguucuccugauucccgagccugacaggcagcggacgccccaggauaaccagcuugccuacguggucaucggacuccuguucaugauuuugaccguagcugcgaaugagaugggucuguuagaaacaacuaaaaaggaccuaggcaucgggcacguggccguugagaaccaccaucacgcagcuaugcuggauguggaccuccauccagccucugccuggacccuuuacgcagucgcuacaaccauaauuacuccuaugaugcgucacacaaucgaaaacacgaccgccaauauuagucugacugcgaucgcuaaccaagccgcaauauugaugggacuggauaaaggcuggcccaucucgaagauggacauuggugugccacuccuggcccuugggugcuauagccaggucaauccuuuaacacugaccgcugcagugcucauguugguugcccauuacgcgaucauuggcccgggacugcaggcuaaggccaccagagaggcacagaaaaggacagccgcuggcaucaugaagaaccccacuguggaugggauaguagccauugaccuagauccaguggucuaugacgcaaaauuugaaaagcagcugggacagaucaugcuccuuauccuguguacgucccagauuuugcugaugcgcaccacaugggcucucugcgagucuaucacucuggccaccggcccuuuaacaacccuuugggaggguucacccgggaaauucuggaauacuacgauagcgguuagcauggccaacauuuuccggggauccuaccuggcaggcgcuggucucgccuuuagucuaaugaagucucugggcgggggacgaagaggcacaggggcacaaggagaaaccuugggcgagaaguggaaaaggcagcugaaucagcucagcaagucagaguucaacacuuauaaacgcuccgguaucauggagguggaccggagugaagcuaaggaggggcuuaaaagaggagagaccacaaagcacgccgucagccguggcacugccaagcugaggugguuuguggaacggaauuugguaaaaccagaggguaaggugauugaucugggcugugggcgcggaggcuggucuuacuauugcgcggggcucaaaaagguuaccgaagugaaaggauacacaaagggcgguccugggcacgaggaacccaucccgauggcuacguacggauggaacuuagucaaacugcauuccggcaaggacguguucuuuauaccaccugagaagugugauacccuucugugcgacaucggcgagucaagccccaauccaacuauugaagaggggcgaacacuaagaguccucaaaaugguggaacccuggcugaggggaaaccaguucuguaucaagauuuugaauccuuauaugccgucgguuguagagacccuggagcaaaugcagcggaaacacgguggcaugcucgugcgcaacccccuuucuagaaauaguacucaugaaauguacugggucuccugcgggacaggaaacaucgugagcgcaguuaauaugaccucaaggaugcuguuaaaccgauuuacgauggcccaccggaagccaaccuaugagcgugauguggaccugggcgcugguacaagacacgucgccguggaaccugagguagcaaacuuggauauuaucgggcagcgcauagaaaauauuaaacaugagcacaaguccacuuggcauuacgacgaggauaaccccuauaagaccugggccuaccacggaucuuaugaagugaaaccuagcggcagugcuuccagcaugguuaauggcgucgugaagcuccugacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcuaugggguuuccuuucucgcaacaagaaacccaggauauguacucgagaggaauuuacccggaaggugagaucaaaugccgcaaucggcgccgucuucguggacgagaaccaauggaauagugcuaaagaggccguugaagaugagagguuuugggaccuggugcaucgcgaacgugagcuccacaagcaggggaagugcgcgacaugcgucuacaacaugaugggaaaacgggaaaagaaacugggcgaguucgguaaggcaaaaggguccagagccauuugguacaugugguugggagcuagguuccuggaguuugaagcccucggcuucaugaaugaggaucacugguuuagccgcgaaaacucucuuucgggcguggagggggagggacugcauaaguuagguuauauccugcgagacauuucaaaaaucccgggcgggaauauguacgcagaugacacggcuggaugggauacccggauaacugaagacgauuugcagaacgaggccaagaucacagacauuauggaaccugagcacgcucuccuggccaagagcaucuucaaacuaaccuaucagaauaagguaguuagagugcaaaggccagccaaaaacggcacugucauggaugugauuucccgcagagaccagcgggguaguggacaggugggaacauacggccuuaauaccuuuacaaacauggaagcgcagcugaucaggcaaauggagucugagggcauauucagccccuccgaacucgagacuccuaaccuggccgggcgugucuuggauugguuagaaaagcauggaguugagcgacugaaacgcauggcuauuucaggugacgacugugugguaaagccaaucgaugacagauuugccaccgcacucacggcucuuaaugauaugggcaaggugcggaaagacaucccccagugggaaccgaguaagggguggaacgauuggcagcaggucccuuucugcucucaccacuuucaucaacugauuaugaaagacggaagggagauagugguucccugucgcaaucaggaugagcuagugggcagagcccgggucagccagggugcaggguggucccugagggaaaccgccugccucggaaagucauaugcgcagauguggcaauugauguacuuccaccgacgugaccugagacuugcugccaacgcaaucuguagcgccgugccaguagauuggguuccuacaucucgcacuaccugguccauucaugcucaccaucaguggaugacaacugaggacaugcugaguguguggaaucgggucuggaucgaagagaaccccuggauggaagauaaaacccacauuagcucguggggcgacgugccauaucucggcaagagggaggaccaguggugcggguccuuaaucggacugacggccagagcaacaugggcuaccaauauacaaguugccaucaaccaggugcgccgguugauugguaaugagaacuaccuggauuacaugacuucuaugaagagguuuaaaaaugaaucagaccccgagggcgcgcucugguga

SEQ ID NO: 13806 - RNA, 9879 nt, Artificial Sequence
  derived and/or modified CDS sequence (opt3) from DENV-1__FJ882559__SS-prME
agcgugaccaugcugcucaugcuuaugcccacagcacuggcuuuccacuugacuacgcggggaggggaaccucauaugaucgucuccaagcaggaaagagggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuuacaguagucgugggcgauguugcugggauuuuagcccagggcaagaagaugauccgcccucaacccauggaguacaaauauagcuggaaguccuggggcaaggcgagaauaaucggggccgacgugcagaauaccacuuucauuaucgauggaccaaacaccccugaaugucccgacgaucagagggcuuggaauauuugggaggucgaggacuacggcuuugguaucuucacaacuaacauauggcugcgucuucgggauucauauacccaggugugcgaccaccgauugaugagugcagccauuaaagauucuaaggcuguucacgccgacaugggguacuggaucgaaagcgagaaaaaugaaacauggaagcucgcaagagcguccuucauugaggugaaaacguguaucuggccaaagucacauacccuguggagcaacggaguacuagaaucugagaugauaauccccaagauuuauggcgguccuaucucccaacacaauuacaggccaggcuacuuuacucagacagccgggccguggcaucugggaaaacucgagcuggauuucgaccuuugcgaaggcaccacugucgugguggaugagcacugcgggaaccgcggacccaguuugcggacaaccacggucacuggcaagauuguucacgaaugguguugcagaagcuguacccugccuccauuaagguuuaaaggugaggacgggugcugguauggaauggagauccgccccgugaaggaaaaagaggaaaaucucguaaagucuaugguguccgcuggcucaggugaggucgacaguuucagccugggccuucuguguauaucgauuaugaucgaagaggugaugcgaucccgguggucucguaagauguugaugacagggacccucgccguauuuuuccugcuaaucaugggacagcugacuuggaacgaucucauuagacugugcaucauggugggcgcaaaugcuagcgacaggauggggaugggaaugacauaccuugccuugauggcaaccuuuaaaaugcgcccuauguucgccgucggccuguuauuucggagacucacaucaagggaggugcugcuucugacuauuggucuaagucucguugcuuccgcggaacugccaaacucuuuggaggaacugggggauggauuagccaugggcauaaugauccucaagcugcuuaccgacuuccaaagccaucagcugugggcaacguugcucucccugacauuuauuaaaaccacuuucucacuacacuaugcuuggaagaccauggccauggugcugagcaucgucagucuuuuuccccucugucugucuacaacuucccagaaaaccacgugguugccgguacuguuaggcagccucgggugcaagccucugacaauguuccuuauugccgagaauaagaucuggggacgaaaaucguggccacugaacgaagguauaauggcugugggcaucguuucaauuuugcucucuagucugcuaaagaacgaugugccccuggcagggccucuuaucgccggaggcaugcucauugcguguuacgucaucuccgguagcucugcugaccugagcuuggagaaagccgcagagguguccugggaagaggaagccgagcauucaggggcuagucacaauauauuaguagaagugcaggaugacggaaccaugaagauuaaagaugaggagcgcgacgauacucugacaauccuccugaaggcaacccuucuggccgucagcggcguuuaucccuugucuaucccagcgacucuauucgugugguacuuuuggcagaaaaagaagcagcgguccggcgugcugugggacacaccuucacccccagaagucgagagagcugugcucgaugacgggauuuauaggauaaugcagcguggacugcuuggucgcagucagguuggcguagggguguuccaagaaaacgucuuucauaccauguggcacgugacgcggggagccguuuuaauguaccagggcaaaagacuggagccgagcugggcauccgugaagaaagaccucaucucuuacggugggggauggagguugcagggcucguggaauacuggcgaggaaguccaggugauugccguagagccugggaagaaccccaaaaauguccaaaccgcuccaggaacauucaagaccagcgaaggugaggugggcgccaucgcacuggauuuuaagcccgggacaucaggauccccuauuguuaaccgagaaggcaaaaucgugggucucuaugggaauggagucgugacuaccaguggcacguacguuucugcuauagcccaggcgaaggccagccaggagggcccacugcccgagaucgaagacgagguguuccggaaacgcaaccuuacaauuauggaucugcacccuggguccggaaagacuagaagguauuugccggcaaucguccgggaagcuauuaaacgaaagcuaagaacccugauccucgccccaacacgcgugguagcuucagagauggcagaagccuuaaaggguaugcccauaagguaccaaaccacugccgugaaaucugagcauaccggcaaggagauuguugaccugaugugccacgcuacauuuacgaugcgucuucugagcccuguccgggugccaaauuauaacaugaucaucauggaugaagcgcauuucacugaccccaguuccauugcagccagaggguacaucagcaccagggugggaaugggcgaggcugccgcaauauuuaugacagccaccccuccggguucugucgaggcuuucccccagucaaaugcgguaauucaggaugaggaacgcgacaucccagagcgauccuggaacaguggguaugaguggauuacugauuuuccuggaaaaacagugugguucguucccagcaucaagucgggcaaugacauagccaacugucucaggaaaaauggcaagcgggugauucaguugucuaggaagaccuucgauacggaauaccagaaaacuaagaacaacgacugggacuacgucgugacaaccgauaucuccgagaugggggcaaauuuucgcgcugaccguguuaucgauccaagacggugccugaaaccugugauucucaaggacggacccgaaagggucauccuggccgguccaaugccggugaccguagcaagcgccgcucagcgccgaggcagaauugggcggaaccacaauaaagagggagaucaguauauauacaugggccagccucuuaacaaugacgaggaucaugcccacuggacugaagcgaagaugcuacuggacaacaucaauacacccgaggguauuaucccagcauuguucgaacccgagagggaaaagucagccgcuaucgauggggaguaucgcuuaagaggcgaggccaggaaaaccuuuguggaacugaugcggcguggagaccucccuguuuggcugaguuacaaggucgcuucugagggcuuccaauauuccgaucgccgauggugcuuugacggggaaagaaacaaucaggugcuugaggaaaacauggauguggagauuuggacaaaagagggagaaaggaagaaacugcggccacgcuggcucgacgcaagaacuuacagcgaccccuuggcccugagggaguucaaggaauuugcugccggucggcgaucagucaguggcgaucuaauacuggagaucgggaaacucccucagcaccuuacgcagagagcacaaaaugcgcuggacaacuuaguuauguugcauaauagcgaacagggaggccgcgccuauaggcacgcuauggaggagcugccggauaccauugaaacacucaugcugcuugcccugaucgcagugcucacuggugggguaaccuuguucuuucuguccggccggggauuaggcaagacaucuauugggcuacugugugugauggcuagcuccguccuccuuuggauggccucaguggagccacauuggaucgcagccucuauaauccuggaguucuuuuugaugguucugcucauucccgagccugaccgucagagaacuccccaagauaaccaacuggcuuacguggucaucggacuucucuucaugauucugaccguagcggccaaugagauggguuugcuggaaacgaccaagaaagacuuaggcaucgggcacguggcaguugagaaccaccaucacgcugccaugcuagauguggaccugcauccagccagugcauggacacucuacgcugucgccacuaccauaauuacaccuaugaugaggcacaccaucgaaaacacuacagcgaauauuucgcuuacggcuaucgccaaccaggcagccauacugaugggauuggauaagggcuggcccaucagcaaaauggacauuggugugccacugcucgcucuggggugcuauucccaggucaauccucuuaccuuaacugcagccgugcugaugcucguugcgcauuacgcuaucauuggcccgggauugcaagccaaggcaacacgcgaggcccagaaacggaccgcugccggcaucaugaagaaccccaccguggaugggauaguagcaauugaccuggauccaguggucuaugacgcuaaguuugaaaaacagcuaggacagaucaugcugcucauccuuuguacaucucaaauucuguugaugcgaacuacgugggcccugugcgagucaaucacccucgcgacaggcccucugacuaccuuaugggaggguagccccgggaaguucuggaauacaaccauagccguuuccauggcaaacauuuucagaggaaguuaccuugcuggcgccggucuggcauuuucucucaugaaaagccuaggcgggggaaggcgcggcacuggggcucagggagaaacgcugggcgagaaguggaaacggcaguugaaucagcugucaaaguccgaguucaacacauauaagagaagugguaucauggagguggaccguagcgaagccaaagaggggcucaagaggggagagaccacuaaacacgccgucucucggggcaccgcgaaacuucgcugguuuguggaacgaaaucugguaaaaccagaggguaaggugauugauuugggcugugggagaggaggcugguccuacuauugcgcugggcugaagaaaguuacagaagugaagggauacacuaaaggcgguccugggcacgaggaacccaucccgauggcaaccuacggauggaaccucgucagguuacauucaggcaaggacguguucuuuacaccaccugagaaaugugauacgcugcuuugcgacauaggcgagagcucgcccaauccaaccaucgaagaggggcggacucugcgcguccuaaagaugguggaacccuggcucagaggaaaccaauucuguauuaaaauccugaauccuuauaugccgucuguuguagagacauuggagcagaugcagaggaagcacgguggcaugcuggugcgaaacccccucaguagaaauuccacccaugaaauguacugggucagcugcgggacuggaaacauugugucagccguuaauaugacaucccguaugcuucugaacagauuuaccauggcucaccgcaagccaacguaugagagggauguggacuuaggcgccgguacccggcacgucgcaguggaaccugagguagccaaccuggauaucauugggcagagaaucgaaaauauaaaacaugagcacaagucuacauggcauuacgacgaggauaaccccuauaaaacuugggcuuaccacggaagcuaugaagugaagccuaguggcuccgcgagcucuaugguuaauggcgucgugaaauugcucaccaagccaugggacgugauucccauggucacacaaaucgccaugacugauaccacaccuuucgggcagcagcgcguuuuuaaggagaaaguggacaccaggacuccaaaggcaaaacgaggaacgguacaaaucauggaagugacagcuaaguggcugugggguuuccuaucacggaacaaaaagcccagaauuuguaccagggaggaauuuacucgcaagguccguaguaaugccgcaauaggcgccguguucguugacgagaaccaguggaacuccgcuaaagaggccguggaagaugagcgguuuugggaccuuguccauagagaaagggagcugcacaagcaggggaaaugcgcgaccugcguguacaacaugaugggaaagcgcgagaaaaagcucggcgaguucgguaaggcaaaagggagccgagccaucugguacauguggcugggagcucgguucuuggaguuugaagcccugggcuucaugaaugaggaucacugguuuucuagagaaaacucgcucucaggcguagagggggagggacuucauaagcuggguuauauuuuaagggacaucagcaaaauuccgggcgggaauauguacgcagaugacacagcuggaugggauacgcgcaucaccgaagacgaucugcagaacgaggccaagauaacugacaucauggaaccugagcacgcuuugcucgccaaauccauuuucaagcugacauaucaaaauaaaguugugagaguccagcggccagcaaagaacggcaccgugauggaugugaucaguaggcgugaccagcgagguucugggcaggucggaacuuacggccuaaauacauuuaccaacauggaagcgcaacuuauucgccagauggagagcgagggcaucuucucccccucagaacuggagacaccuaaccucgccgaaagagcucuggauugguuggagaagcaugggguugaacgguuaaaaaggauggccauaaguggagacgacugugugguaaagccaauugaugaccgcuuugcaacugcucugaccgcccucaaugauauggguaaagugagaaaggacaucccccagugggagccgucuaaaggcuggaacgauuggcagcaagucccuuucugcagccaccacuuucaucagcuuaucaugaaggacgggcgggagauugugguucccuguaggaaucaggaugaacuggugggacgagcacgugucucccagggcgccgguuggucacuaagagagacggcgugccugggaaagagcuaugcucaaauguggcagcucauguacuuccaccgccgggacuugaggcuggccgcaaacgccauauguucugcugugccaguagauuggguuccuaccuccagaacaacuuggaguauccaugcccaccaucaguggaugaccacagaagacaugcuuagcguguggaaucgcgucuggauugaggaaaaccccuggauggaggauaaaacucacaucucguccuggggagacgugccauaucugggcaagcgggaggaccaauggugcggcucucucauuggguuaaccgcaagggcuacgugggccacaaauauccagguugcgauaaaccaggugcgaagacugaucggaaaugaaaacuacuuggauuacaugaccucaaugaaacgguuuaagaaugagagcgaccccgaaggugcucugugguga

SEQ ID NO: 13807 - RNA, 9879 nt, Artificial Sequence
  derived and/or modified CDS sequence (opt3) from DENV-1__GQ199828__SS-prME
agcgugacaaugcugcucaugcuuaugcccacagcacuggcuuuccacuugacuacgaggggaggggagccucauaugaucgucuccaagcaggaaaggggaaaaucuuuacuguuuaagacaucagccgguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaagauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguguguggccaaaaucccauacucuguggucaaacggcguacgagaaagcgagaugaucauacccaagaucuaugguggcccuauuucucaacacaauuacagaccaggguacuucacacagaccgccggaccguggcaucucggcaaacuggagcuugauuucgacuugugcgaagggacuacagucgugguggaugagcacugcggaaacaggggccccucccugcgcaccacgacugucaccgguaagaucauucacgaaugguguugccggaguuguacauuaccuccacucagauuuagaggggaagacggaugcugguauggcauggagauccgccccguuaaagaaaaggaggaaaaucuggugaaguccaugguaucugcugguuccggcgagguggacucauucagucuugggcuguuguguauaagcauuaugaucgaagaggucaugcgaucgcgguggucccguaaaaugcucaugaucggaacccuggccguguuuuuccuacugauuaugggccagcucacuuggaacgaucugaucagacuuugcauuaugguuggggcaaaugcuucugacaggaugggaaugggcacaaccuacuuggcccugauggcaacauuuaagaugcgcccuauguucgccguggguuuacucuuucggagacugacuagcagggagguccuucugcuaaccauagggcucucacugguggcuaguguugaauugccaaacucccuggaggaauuaggagauggccucgcgaugggcaucaugauucugaaacuucugacggacuuccaaucucaucaguugugggccacacuccugagccuaaccuuuaucaagacuaccuucucccugcacuaugcauggaaaacaauggcuauggugcuuucaauugucagccucuuuccccuguguuugaguacuaccucucagaagacgacauggcugccgguauuacucgggucccugggaugcaagccucuuaccauguuccugaucgccgagaauaaaauauggggucgaaagagcuggccauugaacgaaggcaucauggccguggggauuguuucgauccuccugucaucucuacugaaaaacgaugugccccuugcuggaccucucauugcaggcgguaugcugaucgccuguuacgucauaaguggguccagcgcggacuugucuuuagagaaggcugccgaggugagcugggaagaggaagcagagcauuccggagccucacacaauauucugguagaagugcaggaugacggcacuaugaaaaucaagaacgaggagcgcgaugacacacucaccauccugcuuaaagcuacucuguuggcagucaguggcguuuauccccuaagcauuccagccacacuguuugugugguacuucuggcaaaagaagaaacagcggucuggggugcucugggauaccccuucacccccagaagucgagagagcggugcuggacgauggaauauauaggaucaugcagcguggucuuuuaggccgcagccagguugggguaggaguguuccaagaaaaugucuuucauacgauguggcacgugacucggggcgcuguucugauguaccaggguaagagacucgagccgaguugggccagcgugaaaaaggacuugauuuccuacgggggaggcuggaggcugcgaggcucuuggaacaccggggaggaaguccaggugaucgcaguagagccuggcaagaaucccaagaacguccagacagccccagguaccuucaagacacccgaaggcgaggugggggcuauugcccucgacuuuaaaccuggaacuucgggcagcccaaucguuaaucgggaagguaagauaguggggcuguauggaaacggcgucgugaccacgucaggcacauacguuuccgcaaucgcucaagccaaagcgagucaggaggggccccuuccugagauugaagaugagguguuccgcaagagaaaucugacuaucauggacuugcacccgggaucugguaaaaccaggcgguaucuaccagccauuguccgagaagcaaucaagagaaagcugcgcacacucauauuagcucccaccagggugguagccagcgagauggcugaagcacugaaaggcaugccuauucguuaccagacuaccgccgugaaguccgagcauacagggaaagagaucguugaucuuaugugccacgccacguuuacuaugcggcugcucucaccagucagagugcccaacuauaauaugaucauuauggacgaagcucauuucaccgauccuucuagcaucgcggcaaggggauacauaaguacacgcgugggcaugggugaggccgcugccauuuuuaugaccgcaacuccgcccggguccgucgaagccuucccacaaagcaacgcuguaauccaggacgaggaacgagauauuccugagagaucuuggaacucaggauaugaguggaucacagacuuucccggcaagaccgugugguucguuccauccauaaaaaguggcaacgauauugcgaauuguuugcggaagaacgggaagagggugauccagcugagccgcaaaacguuugacacugaauaccagaagaccaaaaauaaugauugggacuacgucgugaccaccgacaucucggagaugggagccaacuuccgugcagauagaguuauugacccucggaggugccucaagcccgugauccugaaagaugguccagaacgcgucauucuugcuggcccgaugccugugacuguagccucugcagcccaacgaagagggcggauaggaaggaaucacaacaaggagggcgaccaguauaucuacaugggucagccccuaaauaacgaugaggaccaugcucacuggacagaagccaagaugcuguuggauaauauuaacaccccagaggggaucauccccgcguuauucgaaccugagcgcgaaaaauccgcagccguggacggcgaguauagacugaggggagaggcucggaagacauuuguugaacucaugcgucgcggcgaucugccagucuggcuuagcuacaaaguggccucagagggguuccaguauagugaccgaagauggugcuuugauggagaaaggaauaaccaagugcuggaggaaaauauggacgucgagauuuggacuaaggagggugaacggaaaaagcuccgccccagaugguuggaugcuaggacguacucugacccucuggcacuacgggaguucaaagaauuugccgcuggccgaagauccguuagcggggaccugauacucgagaucggaaaacuuccgcagcaccugacccagcgcgcccagaacgcauuagauaauuuggugaugcugcauaacucagaacaaggcgguagggcguaucggcacgccauggaggagcucccagacacaauugaaacucugaugcuucuggcucucaucgccguauugaccgggggcgugacacuguucuuuuuaaguggacguggccuagggaagaccagcauuggacugcucugugucauggcauccucugugcuucuguggauggcuagcguugagccccauuggaucgccgcauccauaaucuuggaguucuuucugauggugcuccugauuccugagcccgauagacagaggacuccacaggacaaucagcuugccuacgucguaaucggucuccuguucaugauuuugacgguggcugcgaacgagaugggccuguuagaaaccaccaaaaaggaucuagggaucggacacguugccguggagaaccaccaucacgcagcuaugcuggacgucgaucuccauccugccucagccuggacucuuuacgcaguggcuaccacaauaauuacccccaugaugcgccacacuaucgaaaauacaacggccaacauuucucugaccgcgaucgcuaaucaagccgcaauauugaugggccuggacaaagguuggccaaucaguaagauggauauuggggucccucuccuggcccuuggcugcuauagccaggugaacccguuaacucugacagcugcaguucucauguugguggcccauuacgcgaucauuggacccggccugcaggcuaaagccacccgggaggcacaaaagcgaaccgccgcugggaucaugaagaauccaacaguagacggaauaguggccauugaucuagacccugucguuuaugaugcaaaauuugaaaagcagcugggccagaucaugcuccuuauccuguguacuagccagauuuugcugaugagaacgaccugggcucucugcgaguccaucacacuggccacuggucccuuaaccacacuuugggaggggucuccaggaaaauucuggaacaccacuauagcggugucaauggccaauauuuuuaggggcagcuaccuggcaggagcuggccucgccuucucccuaaugaagagucuagggggaggccgccgggggacgggagcacaaggcgaaacauugggugagaaauggaagagacagcugaaccagcucucuaagagcgaguucaauaccuauaaacguucagggaucauggaggucgacagguccgaagcuaaggagggacuuaaacggggcgagacuaccaagcacgccgugagucgcgguacagccaaacugcgaugguuuguagaaagaaacuuggugaagccugagggcaagguuauugaccugggguguggaaggggcggguggagcuacuauugcgcgggacucaaaaaggugacugaagucaaaggcuacaccaagggugggcccggacacgaggaaccgaucccaauggcuacauacggcuggaauuuagugaaacugcauucuggcaaggaugucuucuuuauaccucccgagaaaugugacacgcuucugugcgauaucggggaguccucaccaaaccccaccauugaagagggacggacucuacgcgugcucaagaugguugaaccuuggcugagagguaaucaguucuguaucaagauuuugaacccguauaugcccagcguaguggagacacuggagcaaaugcagaggaaacacggcgggaugcucguccgaaauccacuuucgcggaacucuacccaugaaauguacugggugaguugcggaacuggcaauaucguuuccgcagugaacaugacaagccguaugcuguuaaacagauuuaccauggcccaccgcaagccuacguaugagagggacgucgaucuggguaccgggacacggcacguggcuguagaacccgagguggccaauuuggacauuaucggacagagaauagaaaacauuaaacaugagcacaagucaacuuggcauuacgaugaggacaauccuuauaaaaccugggcauaccacggcuccuaugaaguuaagccaucuggcagcgccaguuccauggucaacgggguggugaagcuccugacaaaacccugggaugucaucccuaugguuacucagaucgcuaugaccgacacaaccccauucggacaacagcgcguguuuaaggagaaaguagauacuaggacgcccaaggcgaaacgagguacagcccagauuauggaagugaccgcacgguggcuauggggcuuccuuagcagaaauaagaagccgaggauauguacucgcgaggaauuuacccguaaaguccggucuaacgcugccaucggggcaguguucguugacgagaaucaauggaacucagccaaggaggcuguggaagacgagagauuuugggaucugguccauagggaacgcgagcuccacaaacagggaaagugcgccacaugcguguacaauaugaugggcaaacgagaaaagaagcugggugaguucgggaaagcgaagggaagucgggcaauuugguacaugugguugggcgccagauuucuggaguucgaagcucucggcuucaugaacgaggaccacugguuuuccagggaaaauagccuuucugggguagagggagagggucugcauaaauuaggcuauauccugcgcgauauuucgaagaucccugggggaaacauguacgccgacgauacggcaggcugggacaccagaauaacugaagaugacuugcagaaugaggcuaaaaucacagauauuauggaaccagagcacgcccuccuggcuaaggccaucuucaaacuaaccuaucagaacaagguugugcggguccaaaggcccgcaaagaaugguacugugauggacgugauuucacgucgagaucagcgcgggagcggacaggucggcacauacggccuuaacaccuuuacaaacauggaagcgcagcugaucagacaaauggaguccgaggaaauauucaguccuucugagcucgaaacuccaaaucuggccgagcgggcuuuggacugguuagaaaaauaugggguugagaggcugaagcgcauggccauuagcggagaugacugugugguaaaacccaucgacgauagauuugcaaccgcucucacggcccuuaacgacauggguaaggugcggaaagauaucccgcagugggagccuuccaagggcuggaaugacuggcagcagguccccuucugcucacaucacuuucaccaacugauuaugaaggaugggagggaaauagugguuccaugucgaaaccaggacgagcuagugggacgugcaagagucagucagggcgccgguuggucucugcgcgaaaccgcgugccucgggaaaagcuacgcucagauguggcaauugauguauuuccaucggagggaucugagacuugccgacaaggcaaucggauccgccgugccuguagauuggguucccacaucacgcacuaccuggagcauucacgcucaucaccaguggaugacaacugaggacaugcugucuguguggaaucgggucuggaucgaagagaacccauggauggaggauaaaacccauauuuccaguugggaagacgugcccuaccucggcaagagggaggaccagugguguggcagcuuaaucgggcugacggcccgagcaacaugggcuaccaauauacaaguugccaucaaccaggugagacgguugauuggaaaugaaaacuaccuggauuauaugacuucgaugaaaagguuuaagaaugaguccgacccugagggugcgcucugguga

SEQ ID NO: 13808 - RNA, 9879 nt, Artificial Sequence
  derived and/or modified CDS sequence (opt3) from DENV-1__GQ199829__SS-prME
agcgugaccaugcugcucaugcuuaugcccacggcccuggcuuuccacuugacuacgagaggaggggaaccucauaugaucgucuccaagcaggaaaggggaaaaucuuuacuguuuaagaccucagccgguguuaauaugugcacauuaauugccauggaccucggagagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuugguggauagaggcugggguaauggguguggacucuuuggcaaaggcucccugauaaccugcgcaaaguucaagugcguaacaaaauuagaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccagcucacugacuacggggcgcuuacacuggauuguagcccaaggacgggauuggacuuuaacgaaaugguccuacugaccaugaaggagaaaucuuggcucgugcauaagcagugguuccuggaucuuccgcugcccuggacuuccggcgccucaacaagccaagagaccuggaaucggcaggacuugcucguaacauuuaaaacugcacacgcuaagaagcaggaaguugugguccuggguagucaagagggggccaugcacaccgcuuuaacgggcgccaccgaaauccagacaucuggaacuaccacaauuuucgcaggccaucugaaaugccgucuaaagauggauaaacucacucugaaggggauguccuaugugauguguaccgggagcuuuaaacuugagaaggaagucgccgagacgcagcacgguacaguguugguucagauaaaguacgagggcaccgacgcuccuugcaaaaucccauucucgacucaagaugaaaagggggugacacagaacggacgccugauuaccgcgaaucccaucguaacugacaaagagaagccugucaacauagaagcagagccacccuucggcgagucuuauauugugaucggugccggggaaaaagcucucaagcuguccugguuuaagaaaggcucaaguaucggaaagauguucgaggccaccgcaagaggcgccaggcggauggcuauucuuggggauacagccugggacuuuggaagcaucgguggcguuuucacguccguggggaaacugguccaucagauuuuuggaaccgcauacggcguguuguucucugguguaagcuggacuaugaagauagggaucggcgugcuccugacaugguuaggacuaaauucacgaaguaccucccuaagcaugacauguauugcgguuggccucgucacucuguaccuuggggugauggugcaggcugauucuggaugcgucaucaacuggaaaggccgcgaauugaagugugguucagggaucuuuguuaccaaugaggugcacacguggacagaacaauauaaguuccaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguuuacuguagucgugggcgauguugcagggauucuugcucagggcaagaagaugauccgcccucaacccauggaguacaaauauucguggaaaagcuggggcaaggccaagauaaucggggcggacgugcagaauaccacauucauuaucgauggaccaaacacuccugaaugucccgacgaucagagagccuggaauauuugggaggucgaggacuacggcuuugguaucuucaccacaaacauaugguugaagcucagggauuccuauacacaggugugcgaccaccgucugaugucagcugcaauuaaagauaguaaggccguucacgcugacaugggguacuggaucgaaucugagaaaaaugaaaccuggaagcuagcccgggcauccuuuauugaggugaagacuuguaucuggccacgaucccauacacuguggucaaacggaguacucgaaagcgagaugauaauccccaaaauuuauggcgguccuaucucucaacacaauuacagaccaggcuacuucacccaggcggccgggccguggcaucugggaaaacuugaguuggauuucgaccugugcgaaggcacuacagucgugguggaugagcacugcgggaacaggggacccuccuuacgcaccacgacugucaccggcaaaauuauccacgaaugguguugccggaguuguacacucccuccacugagauuuaggggugaggacgggugcugguauggaauggagauacgccccguuaaggaaaaagaggaaaaucuuguaaagagcaugguaucugcuggcuccggugagguggacucauucagucugggcuugcucuguauuagcaucaugaucgaagaggucaugcgaucgcgguggucccguagaaugcugaugaccgggacucuagccguguuuuuccugcucauuaugggacagcugacauggaacgaucuuaucagguugugcauuaugguuggcgcaaaugcuucugaccgcauggggaugggaaccacauaccuggccuuaauggcaacuuuuaagaugcggccuauguucgccgugggccuccuguuuagaaggcuuaccagccgagagguccugcuacucacgauaggucugucauugguggcuaguguugaacugccaaacuccuuagaggaacucggggauggacuggcgaugggcaucaugauucuuaaacuguugacagacuuccaaucucaucagcucugggccacccugcuaagccugacuuuuaucaagaccacauucucccuucacuaugcauggaaaacuauggcuauggugcucucaauugucagccuguuucccuugugucugaguaccacgucucagaagacaaccugguuaccgguacuccugggcucccuugggugcaaaccucugacuauguucuugaucgccgagaauaagauauggggacgccggagcuggccacucaacgaagguaucauggccgugggcauuguuucgauccugcuaucaucucugcuuaagaacgaugugccccucgcugggccucugauugcaggaggcauguugaucgccuguuacgucauaagugguuccagcgcggacuuaucucuggagaaagcugccgaggugagcugggaagaggaagcagagcauuccggggccucacacaauauucucguagaagugcaggaugacggaacaaugaagaucaaagaugaggagagagacgauacccugacuauccuucugaaggcuacauugcuagcagucaguggcguuuauccccugagcauuccagccacccucuuugugugguacuucuggcagaagaagaaacagaggucuggcgugcugugggacacgccuucacccccagaagucgagcgugcggugcuugaugacgggauauaucgcaucaugcagcggggauuacuggguagaagccagguuggcguagggguguuccaagaaaacgucuuucauacuauguggcacgugaccaggggagcuguucucauguaccagggcaagcgauuggagccgaguugggccagcgugaagaaagaccugauuuccuacggugggggauggcggcuccagggcucuuggaauacaggcgaggaaguccaggugaucgcaguagagccugggaagaaccccaaaaauguccaaaccgccccaggaacauucaagacucccgaaggugaggugggcgcuauugcccuggauuuuaaaccugggaccucgggaagcccaaucguuaaccgcgaaggcaagauagugggucuuuaugggaauggagucgugacgacaucaggcacuuacguuuccgcaaucgcucaggccaaggcgagucaggagggcccccugccugagauugaagacgagguguucagaaaaaggaacuugaccaucauggaucuacacccggggucuggaaagacacggcgauaucugccagccauugucagagaagcaaucaaacgcaagcucaggaccuuaauacuggcucccacucgugugguagccagcgagauggcugaagcacuuaaagguaugccuauucgguaccaaaccacagccgugaaguccgagcauacgggcaaggagaucguugaccugaugugccacgccacuuuuaccaugagacucuugucaccagucagggugcccaauuauaacaugaucauuauggaugaagcucauuucacagacccuucuagcaucgcggcacgcggguacauaaguacccgagugggaaugggcgaggccgcugccauuuuuaugacugcaacaccgcccgguuccgucgaagccuucccacagagcaaugcuguaauccaggaugaggaaagagacauuccugagcggucuuggaacucaggguaugaguggaucaccgauuuucccggaaaaacggugugguucguuccauccauaaagaguggcaaugacauugcgaacugucugaggaaaaauggcaagcgcgugauccagcucagccguaaaacuuuugauacagaauaccaaaagaccaagaacaacgacugggacuacgucgugaccacugauaucucggagaugggggccaauuucagagcagaccggguuauugauccuaggcgcugccugaaacccgugauccuuaaggacggaccagaacgagucauucuagcugguccgaugccugugacaguagccucugcagcccagagacggggcaggauagggcgcaaccacaauaaagagggagaucaguauaucuacaugggccagccccugaacaaugacgaggaucaugcucacuggaccgaagccaagauguuguuagacaacauuaauacaccagaggguaucauccccgcgcuguucgaaccugagagagaaaaauccgcagccauugauggggaguauaggcuccggggcgaggcucguaagacuuuuguggaacugaugcgccgaggagaccuuccaguuuggcugagcuacaaggucgccucagagggcuuccaauauagugauagaagguggugcuuugacggggaacggaacaaucaggugcucgaggaaaacauggauguggagauauggacgaaagagggagaacgcaagaaauugagacccagguggcuggacgcucggaccuacucugacccucuagcacugcgagaguucaaggaauuugccgcugguagacgcuccgucagcggcgaucucauccuugagauugggaaacugccgcagcacuuaacacagagggcccaaaaugcauuggacaaccugguuaugcuccauaauucagaacagggaggccgggcguaucgucacgccauggaggagcugccagauacuaucgaaacccuuaugcugcucgcuuugauugccgugcugacaggugggguaaccuuauucuuucuaaguggcagaggacugggcaagacuagcaucgggcuccuuugugugauggcauccucuguccuguuguggauggcuagcguggagccccauuggauagccgcauccaucauucuggaguucuuucucaugguucugcuuaucccugagcccgacaggcagcgcacgccacaggauaaccaacucgccuacguggucauuggacuguuguucaugauccugaccguagcugcgaaugagauggguuuacuagaaacaacuaaaaaggaccugggcauagggcacguggccguugagaaccaccaucacgcagcuaugcucgauguggaccuucauccugccucagccuggacccuguacgcagucgcuacaaccauuaucacucccaugaugcggcacacaauugaaaacacgaccgccaauaucucuuugacugcgauagcuaaccaggccgcaauccugaugggacucgauaagggcuggccaauuaguaaaauggacaucggugugccucugcuugccuuagggugcuauucgcaggucaauccgcugacacucaccgcugcaguguugaugcugguugcccauuacgcgauuaucggccccggacuacaagcuaaggccacccgagaggcacagaaaagaacagccgcuggcauaaugaagaacccaacuguggaugggauuguagccaucgaccuggauccuguggucuaugacgcaaaauuugaaaagcagcucggacagaucaugcuucugauuuuguguacgagccaaauccugcucaugaggaccacaugggcucugugcgaguccauaacuuuagccaccggcccccuuacaacccugugggaggguucuccagggaaguucuggaauacuacgauugcgguuucaauggccaacaucuuucgcggaagcuaccucgcaggcgcuggucuagccuucucccugaugaaaaguuugggcgggggacggagaggcacaggggcacagggagaaacccugggcgagaaguggaaacgucagcucaaucagcuuucuaagagcgaguucaacacuuauaaaaggucagguauuauggagguggaccgguccgaagcuaaggaggggcugaagcgcggagagaccacaaaacacgccgucagucgaggcacugccaaguugagaugguuuguggaaaggaaucugguaaaaccugaggguaaggugaucgaucucggcugugggcggggaggcuggagcuacuauugcgcggggcuaaagaagguuaccgaagugaagggauacacaaaaggcggucccgggcacgaggaaccgauaccaauggcuacguacggauggaaccuggucaaacuucauucuggcaaagacguguucuuuaucccucccgagaagugugauacccugcuaugcgacauuggcgaguccucaccaaaucccacuaucgaagaggggcgcacacucagaguccugaaaaugguggaaccuugguugaggggaaaccaauucuguauuaagauccugaauccguauaugcccagcguuguagagacccucgagcagaugcagcgaaaacacgguggcaugcuugugcggaacccacugucgcguaauucuacucaugaaauguacugggucaguugcgggacaggaaacauuguguccgcaguuaauaugaccagcagaauguuacugaaccgcuuuacgauggcccacaggaagccuaccuaugagcgggauguggacuugggcgcugguacaagacacgucgccguggaacccgagguagcaaaccucgauaucauagggcagcgcauugaaaauaucaagcaugagcacaaaucaacuuggcauuacgacgaggauaacccuuauaagaccugggccuaccacggauccuaugaagugaaaccaucuggcagcgcuaguuccaugguuaauggcgucgugaagcugcuaacaaaacccugggacgugaucccuauggucacucaaauugcgaugaccgauacaaccccauucgggcagcagaggguuuuuaaggagaagguggacacucgaacgcccaaagccaagcggggaacagcacaaauaauggaaguaaccgcuaaauggcuuugggguuuccugagcagaaacaagaaaccgaggaucuguacucgcgaggaauuuacccguaaggugcggucuaaugccgcaauuggcgccgucuucguggacgagaaccaguggaacucagcuaaggaggccguugaagaugagagauuuugggaccucgugcauagggaacgcgagcugcacaaacaggggaagugcgcgacaugcgucuacaacaugaugggaaaacgagaaaagaaauugggcgaguucgguaaggcaaaggggagucgggccaucugguacauguggcugggagcuagauuucucgaguucgaagcccuuggcuucaugaaugaggaucacugguuuuccagggaaaacagccugucuggcguggagggggagggauuacauaaacuggguuauauuuugcgcgacaucucgaagauaccuggcgggaauauguacgcagaugacacggcuggaugggauaccagaaucacugaagacgaucuccagaacgaggcccggauuacagacaucauggaaccagagcacgcucugcuagccaaaucaauuuucaaacuuaccuaucaaaauaaaguaguuagggugcagcgucccgcaaagaacggcacugucauggaugugaucagccgacgcgaccagagagguuccggacaggugggaacauacggccugaauaccuuuacaaacauggaagcgcaacucauacggcagauggagagugagggcauuuucucuccuagcgaacuggagacuccaaacuuggccgaaagggucuuagauuggcuggagaaauaugggguugaacgccucaagagaauggcuaucuccggagacgacugugugguaaagcccaucgaugaccgguuugccaccgcacuuacggcucugaaugauauggguaaagugaggaaggacauuccgcagugggagccuucaaaaggcuggaacgauuggcagcaaguccccuucugcagucaucacuuucaccagcuaauaaugaaggacgggcgagagaucgugguuccaugucguaaucaggaugaacuggugggcagagcccgcgucucucagggcgcagguuggagccuccgggagaccgccugcuuggggaaauccuacgcgcaaauguggcagcugauguauuuccauaggagagaccuucgccuggcugccaacgcaauuuguucagccgugccuguagauuggauccccacaagccggacuaccuggucuauucacgcucaucaccaguggaugacaacugaagacaugcucuccguuuggaauaggguguggaucgaggaaaacccauggauggaggauaagacccauauaaguagcuggggagacguccccuacuuaggcaagcgagaggaccaauggugcggcucgcugaucggguugacggccagagcaacaugggcuaccaauauucagguggccaucaaccagguucggaggcugauuggaaaugaaaacuaccucgauuauaugacuuccaugaaacgcuuuaagaaugagucugacccugaaggugcgcuuugguga

SEQ ID NO: 13809 - RNA, 9879 nt, Artificial Sequence
  derived and/or modified CDS sequence (opt3) from DENV-1__FJ882562__SS-prME
agcgugaccaugcugcucaugcuuaugcccacagcccuggcuuuccacuugacuacgaggggaggggaaccucauaugaucgucuccaagcaggaaaggggaaaaucuuuacuguuuaagaccucagccgguguuaauaugugcacacugauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacggaacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggccuuuuuacauccguugggaaacuggugcaucagauuuucggaacggcguacggcgucuuguuuucuggugugagcuggaccaugaagauagggaucggcguacuccugacuugguuaggacuaaauucacgaaguacaucccuaagcaugaccuguauugcugugggccucguuacacuguaccuuggggucauggugcaggccgauucuggaugcgugaucaacuggaaaggccgcgaauugaagugugguucagggaucuucgucacuaaugagguucacaccuggacggaacaauauaaguuucaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacgacaugaaacuuaccgugguagucggcgauguggcugggauuuuggcccagggcaagaagaugauccgcccucaacccauggaguacaaauauucguggaaaagcuggggcaaggcgaagauaaucggggccgacgcucagaauacuaccuucauuaucgauggaccaaacacaccugaaugucccgacgaucagagagcauggaauauuugggagguugaggacuacggcuuugguaucuucacuaccaacauauggcucaagcugagggauuccuauacacaggugugcgaccaccgucuaaugucagccgcuauuaaagauaguaaggccguccacgcagacaugggguacuggaucgaaucugagaaaaaugaaacguggaagcuggcgcgggccagcuuuauugaggugaagaccuguaucuggccaaaaucccauacucucuggucaaacggaguucuggaaagcgagaugauaauccccaagauuuauggcgguccuaucucucaacacaauuaccgaccaggcuacuucacacagaccgcugggccguggcaucuuggaaaauuggagcuggauuucgacuuaugcgaaggcacuacagugguagucgaugagcacugcgggaacagaggacccucccucaggaccacgacugugaccggcaagauuauccacgaaugguguugccgcaguuguacacugccuccacuucgguuuagaggugaggacgggugcugguauggaauggagauaaggcccgugaaagaaaaggaggaaaaucuggucaagagcaugguuucugccggcuccggugagguggacucauucaguuugggccuccuguguauuagcaucaugaucgaagagguaaugcgcucgcgauggucccggaaaaugcuaaugaccgggacucuggcaguguuuuuccuccugauuaugggacagcuuacauggaacgauuugauccgucugugcauuauggucggcgcuaaugccucugacagaauggggaugggaaccacauacuuagcacucauggccacuuuuaagaugaggccuauguucgcugugggccugcuuuuucgccggcugaccagcagagagguucuacuccugacgauagguuugucacugguggcgagugucgaauuaccaaacucccucgaggaacugggggauggacuugccaugggcaucaugauucugaaauugcucacagacuuccaaucucaucagcugugggcaacccuacugagccuuacuuuuaucaagaccacauucucccuccacuaugcuuggaaaacuauggccauggugcugucaauuguuagcuuguuuccccuguguuuaaguaccacgucucagaagacaaccuggcucccggugcugcuuggcucccuggggugcaagccuuugacuauguuccucaucgccgagaauaaaauauggggaagaaaguccuggccacugaacgaagguaucauggcugucggcauuguaucgauccuacugucaucucuucucaaaaacgaugugccccuggcagggccuuugauugccggaggcauguuaaucgcguguuacguuauaagugguuccagcgcugaccugucucucgagaaggccgcagaggugagcugggaagaggaagccgagcauuccggggcuucacacaauauucuggucgaagugcaggaugacggaacaaugaaaaucaaggaugaggagcgagacgauacccuuacuauccuguugaaagcaacacuacuggccguaaguggcguguauccccucagcauuccagcgacccuguuugucugguacuucuggcaaaagaagaaacagcgcucuggcguucuuugggacacgccuucacccccagaaguggagcgggcuguguuagaugacgggauauauagaaucaugcagaggggacugcucggucguagccaggucggcguggggguuuuccaagaaaacguauuucauacuauguggcacgugacccgcggagccgucuugauguaccagggcaagcggcuggagccgaguugggcaagcgugaaaaaggaccucauuuccuacggugggggauggagacugcagggcucuuggaauacaggcgaggaaguucaggugaucgccgucgagccugggaaaaaccccaagaaugugcaaaccgcuccaggaacauucaagacucccgaaggugagguaggcgccauugcacuugauuuuaaaccugggaccucgggaagcccaaucgucaacagggaaggcaagauagugggucuguaugggaauggaguugugacgacaucaggcacuuacgucuccgcuaucgcccaggcgaaagccagucaggagggccccuugccugagauugaagacgagguguuccgaaagcggaaccuaaccaucauggaucugcacccggggucuggaaaaacacgcagauaucucccagcaauuguuagggaagcuaucaagcggaaguuacgaacccugauacuugcccccacuagaguggucgcuagcgagauggcagaagcccugaaagguaugccuauucgcuaccaaaccacagccgugaaguccgagcauacgggcaaagagaucguagaccucaugugccacgcuacuuuuaccaugagguugcugucaccagugcguguucccaauuauaacaugaucauuauggaugaagcgcauuucacagacccuucuagcaucgcagcccggggguacauaaguaccagagucggaaugggcgaggcugccgcaauuuuuaugacugccacaccgcccgguuccguggaggcuuucccacagagcaaugcggugauccaggaugaggaaagggacauuccugagcgcucuuggaacucaggguaugaguggaucaccgauuuucccggaaagacggucugguucguaccauccauaaaaaguggcaaugacauugccaacugucuccgaaagaauggcaagagagugauccagcugagccggaaaacuuuugauacagaauaccaaaagaccaaaaacaacgacugggacuacguugugaccacugauaucucggagaugggggcaaauuucagggcugaccgcgucauugauccucguagaugccuuaagcccgugauccuaaaagacggaccagaacggguuauucuggccgguccgaugccugugacagucgcaucugccgcucagaggcgcggccgaauagggagaaaccacaauaaggagggagaucaguauaucuacaugggccagcccuugaacaaugacgaggaucaugcccacuggaccgaagcgaagauguuacuggacaacauuaauacaccagaggguaucauccccgcacucuucgaaccugagcgggaaaaauccgccgcuauugauggggaguauaggcugcgcggcgaggccagaaagacuuuuguggaacuuaugaggcggggagaccugccaguauggcucagcuacaaaguggcuucagagggcuuccaauauagugaucgucgcuggugcuuugacggggaacgaaacaaucagguuuuggaggaaaacauggaugucgagauauggacgaaggagggagaaaggaaaaagcugaggccccgguggcuagacgcacgcaccuacucugacccucuggcccucagagaguucaaagaauuugcugccgguaggcgguccgugagcggcgaucuuauccuggagauugggaaguuaccgcagcacuugacacagcgagcacaaaaugcgcuggacaaccucgugaugcugcauaauucagaacagggaggcagagccuaucgccacgcuauggaggagcuuccagauacuaucgaaacccugaugcucuuggcccugauugcagucuuaacaggugggguuacccuauucuuucugaguggcaggggacucggcaagacuagcaucgggcuucugugugugaugacguccucuguauugcuguggauggcuagcguggagccccauuggauagccgcauccaucauucucgaguucuuucugaugguccuucucaucccugagcccgaccggcagcguaccccacaggauaaccaacuggccuacgugguuauuggauugcuguucaugaucuuaacaguggcugcgaaugagaugggucuacuggaaacuaccaaaaaggaccucggcauagggcacgucgccguagagaaccaccaucacgcagcuaugcuugauguggaccugcauccugccucagccuggacauuguacgcaguugcuaccacuauuaucacacccaugaugagacacacgauugaaaacaccacugccaauaucucucugacagcgauagcuaaccaggccgcaauccucaugggacuggauaaaggcuggccaauuaguaagauggacaucggugugccucuuuuagcccuggggugcuauucgcaggucaauccgcucaccuugaccgcugcagugcugaugcuagucgcccauuacgcgauuaucggccccggacugcaagcuaaagccacaagggaggcacagaagcgcacugccgcuggcauaaugaagaacccaacgguggaugggauuguugccaucgaccucgauccugugguauaugacgcaaaauuugaaaagcagcuuggacagaucaugcuguugauucuguguaccagccaaauccuccugaugcggacaacuugggcuuuaugcgaguccauaacccuugccacaggcccccugaccacucucugggaggguucuccagggaaauucuggaauacgacaauugcggugucaauggccaacaucuuucgaggaagcuaccuagcaggcgcuggucuggccuucuccuugaugaagagucugggcgggggaagaaggggcaccggggcacagggagaaacucucggcgagaaauggaagcgccagcuuaaucagcugucuaagagcgaguucaacaccuauaaacggucagguauuauggaggucgacagauccgaagcuaaggagggguugaaacguggagagacaacuaagcacgccguuaguaggggcaccgccaaacugcggugguuuguggaacgcaaucucgucaagccugaggguaaggugaucgauuuaggcugugggcgaggaggcuggagcuacuauugcgcggggcugaaaaagguaacagaagugaaaggauacacgaagggcggucccgggcacgaggaaccgauaccaauggcuaccuacggauggaaccuuguuaaacugcauucuggcaaggacguguucuuuaucccucccgagaaaugugauacucuacucugcgacauuggcgaguccucaccaaaucccacaaucgaagaggggagaacccugagggucuugaagaugguggaaccuuggcugcggggaaaccaauucuguauuaagauccucaauccguauaugcccagcgucguggagacucuugagcagaugcagcgcaaacacgguggcaugcugguuagaaacccauuaucgagaaauucuacacaugaaauguacuggguaaguugcgggaccggaaacauuguguccgcagucaauaugacgagccgaaugcuguugaaccgguuuaccauggcccaccguaagccuacauaugagagagauguggaccucggcacugguacccgccacguugcuguggaacccgaggucgccaaccuggauaucauagggcagaggauugaaaauaucaaacaugagcacaagucaacauggcauuacgacgaggauaacccuuauaaaacuugggcauaccacggauccuaugaagugaagccaucuggcagcgccaguuccaugguaaauggcgugguuaagcuacuuaccaaacccugggacgucaucccuauggugacacaaauugcuaugaccgauacuacgccauucgggcagcagcggguguuuaaggagaaagucgacacaagaacccccaaggcgaaacgcggaacugcccaaauaauggaaguuaccgcaagguggcugugggguuuccucagccgaaacaagaagccgcggaucuguacaagagaggaauuuacgaggaaagugcgcucuaaugcugccauuggcgcaguauucguggacgagaaccaguggaacucagccaaggaggcugucgaagaugagcguuuuugggaccuggugcaucgggaaagagaguugcacaaacaggggaagugcgcaaccugcguuuacaacaugaugggaaaaagggaaaagaagcugggcgaguucgguaaagcgaaggggagucgcgcaaucugguacauguggcucggagcccgauuucuugaguucgaagcucugggcuucaugaaugaggaucacugguuuucccgggaaaacagcuuaucuggcguggagggggagggacugcauaaauuggguuauauucucagagacaucucgaagauaccuggcgggaauauguacgccgaugacacugcaggaugggauacaaggaucaccgaagacgaucugcagaacgaggcuaaaauuacugacaucauggaaccagagcacgcccuacuugcuaaggccauuuucaaacugacauaucaaaauaaggucgugcgcguacagagacccgcaaagaacggcaccguuauggaugugaucucacggagggaccagcgugguagcgggcaggucggaacauacggccucaauacuuuuaccaacauggaagcgcaacugauacgacagauggaguccgagggcauuuucaguccuucugaauuggagacgccaaacuuagccgaacgcgcucuggauuggcucgagaaauaugggguggaaagacuuaagcggauggccaucagcggagacgacuguguggucaaacccaucgaugacagguuugcaaccgcucugacagcccuaaaugauauggguaagguucgcaaagacauuccgcagugggagccuuccaagggcuggaacgauuggcagcaagugcccuucugcucacaucacuuucaccagcugauaaugaaggacgggagagagaucguagugccaugucggaaucaggaugaacucgucggaagggcacgagugagucagggcgccgguuggucuuugcgugagacugcgugccuggggaaaagcuacgcucaaauguggcagcuuauguauuuccauagacgcgaccugcggcucgccgcaaacgccauuuguuccgcuguuccuguggauuggguccccaccucaaggacaacuuggagcauccacgcccaucaccaguggaugaccacggaagacauguuaucuguguggaauagaguauggauugaggaaaacccauggauggaggauaagacacauaucuccaguugggaggacguucccuaccugggaaaacgcgaagaccaauggugcggcagcuugauaggccugaccgcacgggcuacuugggccacaaauauccagguggcgauuaaccaggucaggcgacucaucgggaaugagaacuaccuugauuauaugaccucgaugaagagauuuaaaaaugaauccgacccugagggagcucugugguga

SEQ ID NO: 13810 - RNA, 9879 nt, Artificial Sequence
  derived and/or modified CDS sequence (opt3) from DENV-1__FJ882564__SS-prME
agcgugaccaugcugcucaugcuuaugcccaccgcacuggcuuuccacuugacuacgaggggaggggagccucauaugaucguaaccaagcaggaaaggggaaaauccuuacuguuuaagacaucugccgguguuaauaugugcacucugauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuaugguggcagucggucuccuguucaggcgccuuacgagccgggaggugcugcuacucacaauugggcugucauugguugccaguguggaacugccaaacuccuuagaggaacucggagacggccuggcuaugggcauaaugauccuuaagcuguugaccgauuuucaaucucaccagcucugggcgacucugcuaagccugaccuucauuaaaacaacucuuucccuccauuacgccuggaagaccauggcaaugguccugucaaucgucagcuuguuuccccuguguuuaaguacgacaucucagaagaccacuuggcucccggugcugcuugggucccugggaugcaaaccuuugacaauguuccucauugcugagaauaagaucugggguagaaaaagcuggccacugaacgaaggcauaauggccguugggguggucucgauccuacugucaucucuucucaagaacgacgugccccuggccggaccuuugauugcuggcgguauguuaaucgcauguuauguaauuaguggguccagcgccgaucugucucucgagaaagcggcugaggugagcugggaagaggaagccgagcacuccggagcaucacauaauauccuggucgaaguucaggacgauggcaccaugaagauaaaagacgaggagagggaugacacucuuacaauucuguugaaggccacccuacuggcugugaguggcguguacccccucagcaucccagcaacgcuguuugucugguauuucuggcaaaagaaaaagcagcgaucuggggugcuuugggauacuccuucacccccagaaguugagcgcgccguauuagacgauggaaucuaccggauuaugcagagaggucugcucggcaggagccaggugggggucggaguguuucaagaaaacguuuuccacaccauguggcacgugacacguggcgcggucuugauguaucaggguaaacgccuggagccgaguugggcuagcgugaagaaagaccucauauccuacgggggaggcuggcggcugcagggcucuuggaauaccggggaggaaguacaggucaucgccguggagccuggaaagaaccccaagaauguucaaacagcaccagguacuuucaaaacccccgaaggcgaggugggggccauugcucuugacuuuaagccuggaacgucgggcagcccaaucgucaacagagaagguaaaauuguggggcuguacggaaauggcguugugacaacuucaggcaccuaugucuccgccaucgcacaggcuaaggccagucaggaggggcccuugccugagauagaagaugagguguucaggaaacgaaaccuaacaaucauggaccugcauccgggaucugguaagacccggcgcuaccucccagcgauuguaagagaagccaucaagaggaaauuacggacucugauucuugcacccacccgagugguugcuagcgagauggccgaagcucugaagggcaugccuaucagauaucaaacaacggcagucaaauccgagcacacugggaaggagauaguggaucucaugugccaugccaccuuuacaaugcgcuugcugucaccagugaggguccccaauuacaacaugauuaucauggacgaagcccacuucaccgauccuucuagcaucgcugcgcguggauauauuaguacucggguaggcaugggugaggcagccgcuaucuuuaugacagccaccccgcccggguccguggaagcauucccacagagcaaugccguuauacaggacgaggaaagagauauuccugagaggucuuggaacucaggauacgaguggaucacggacuuucccggcaaaacugugugguucgucccauccauuaagaguggcaaugauaucgcuaacugucuccgcaagaaugggaaacgagugauacagcugagcagaaagacauuugacaccgaauaucagaaaaccaagaacaacgauugggacuacguugugacuacagacauuucggagaugggagcgaauuuccgggccgauagggucaucgacccucgccguugccuuaaacccgugauccuaaaggaugguccagaaagaguaauucuggcaggcccgaugccugugaccguugcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuuugaaccugagagagaaaaguccgcggcaaucgacggcgaguaccggcugaggggagaggcccgcaaaacguucgucgaacuuaugagaaggggcgaucugccaguguggcucagcuauaagguggcuucagagggguuccaauacagugaccggcguuggugcuuugauggagaacgcaacaaucaggucuuggaggaaaacauggacguugagaucuggaccaaagagggugaacgaaagaaacugagacccagguggcuagaugcccggacauauucugacccucuggcucuccgcgaguucaaggaauuugcagccggcagaagguccgugagcggggaccuuauucuggagauaggaaaguuaccgcagcauuugacucagcgggcucaaaaugcccuggauaaccucguaaugcugcacaauucagaacagggcggucgagcauacagacaugcgauggaggagcuuccagacaccaucgaaacacugaugcucuuggcccugauugcuguguuaaccgggggcgucacucuauucuuucugaguggacgcggccucgggaaaacgagcaucggacuucugugugugauggccuccucuguuuugcuguggauggcaagcguggagccccacuggauugcugccuccaucauacucgaguucuuucugaugguccuucucaucccugagcccgauaggcagcggaccccacaggacaaccaacuggcauauguagugauugguuugcuguucaugaucuuaacaguugccgcuaaugagaugggccuacuggaaacuaccaagaaagaucucgggauuggacacguggcggucgagaaccaucaccaugccacaaugcuugacguggaucugcacccugcaucagcuuggaccuuguacgccgucgccacuacaaucauaacgcccaugaugcgucauaccauugaaaacacuacagcaaauaucucucugaccgcuauugccaaccaggcggcuauccucaugggccuggacaaggguuggccaauaaguaaaauggauaucggggugccucuuuuagcccugggcugcuacucgcagguuaauccgcucaccuugacagcagccgugcugaugcuaguagcucacuaugcaauuaucggacccggccugcaagccaaggcgacuagagaggcucagaagaggacggccgcagggauuaugaaaaacccaaccguggacggaaucgucgccauagaucucgacccuguuguguacgaugcuaaguuugaaaaacagcuuggccagauuaugcuguugauccuguguacaagccaaauccuccugaugcgcacuaccugggccuuaugcgaguccauuacacuugcaaccgguccccugacuacgcucugggaggggucuccaggaaaguucuggaauacaaccaucgcugucucaauggccaacauauuucggggcagcuaucuagcgggugccggccuggcauucuccuugaugaaaagucuagggggaggccgaagagggacuggagcucagggcgaaacccucggugagaaguggaagaggcagcuuaaucagcugucuaaaagcgaauuuaacauuuacaagcgcucagggaucauggagguggaccgguccgaagccaaagagggauugaagagaggcgagacaacucgucacgcaguaaguagggguaccgcuaaacugcggugguucguggaacgcaaucucguuaagccugagggcaaggugauugacuuaggguguggacgaggcggguggagcuauuacugcgccggacugaaaaaggucacagaagugaaaggcuauacgaagggugggcccggacaugaggaaccgaucccaauggccaccuacggcuggaaccuugucaaacugcacucuggcaaggauguguucuuuacuccucccgagaaaugugacacacuacucugcgauauaggggaguccucaccaaaucccaccaucgaagagggaagaacucugaggguuuugaagaugguagaaccuuggcugcgggguaaccaauucuguauuaagauccucaauccguacaugcccagcguggucgagacacuugagcagaugcagcgcaaacauggcgggaugcuggugagaaacccauuaucgagaaauucuacccacgaaauguauuggguuaguugcggaacgggcaacauuguguccgcggucaauaugaccagccgaaugcuguugaaccgguuuacaauggcucaccguaagccuacuuacgagagagacguggaucucggugcagggacccgccauguagccguggaacccgagguugcuaaccuggacaucauuggacagaggaucgaaaauauaaaacacgagcauaagucaacauggcacuaugaugaggacaacccuuacaaaacuugggccuaucauggcuccuacgaagucaagccaucuggcagcgcaaguuccauggugaaugggguggucaagcuacuuaccaaacccugggauguuauuccuauggugacacaaaucgccaugaccgacacuacgccauucggacagcagcggguauuuaaggagaaaguggauacaagaacccccaaggcuaaacgcgguacugcgcaaaucauggaagucaccgccagguggcuguggggcuuccucagccgaaacaagaagccgcggauuuguacaagagaggaauuuacgaggaaagugcgcucuaaugcagcuauaggggccguuuucguggacgagaaccaguggaacucagcaaaggaggccgucgaagacgagcguuuuugggaucuggugcagaaagaacgggaguugcacaagcagggaaaaugcgcuaccugcguauauaacaugaugggcaagagagaaaagaaacugggugaguucgggaaggccaaaggaaguagggcgaucugguacauguggcucggcgcacgcuuucuugaguucgaagcccugggcuuuaugaaugaggaccacugguucucccgagaaaacagcuuaucugggguugagggagagggucugcauaaguugggcuacauucuccgggauaucucgaaaauuccugggggaaauauguaugcugacgauacugccggcugggacacaagaaucaccgaagaugaccugcaaaacgaggcaaagauaacugauaucauggaaccagagcacgcucuacuugccacaucaauuuucaaacugaccuaccagaauaagguggucagggugcagcgccccgcuaagaacgguacagugauggacgucaucagcagacgggaucagaggggguccggacaaguuggcacuuauggccucaauaccuuuacgaacauggaagcccagcugauucgucagauggagagugaggggaucuucuugccuucugaauuagagaccccaaaccuggcagaacgagugcucgacuggcuugagaaauacggaguagaacgccugaagagaauggcgauaagcggugaugacuguguggucaaacccauugacgaucgguuugccacagcucuaacugcccugaaugacaugggcaaggugaggaaagauaucccgcagugggagccuuccaagggguggaacgacuggcaacagguucccuucugcucacaucacuuucaccagcucaucaugaaggauggacgcgagauuguggucccauguagaaaucaggacgaauuggugggccgggcaaggguaagucaaggugcuggguggucucugcgagagaccgccugccuuggaaaaagcuaugcacagauguggcagcugauguacuuccaucguagagaucuccgcuuagccgcgaacgcuauauguuccgccguuccuguggacuggguccccacaucacggacuaccuggagcauccacgcacaucaccaauggaugacgacagaagauaugcugucuguguggaauaggguuuggauugaggaaaacccauggauggaggacaagacccauguguccaguuggggcgauguccccuauuugggcaaaagagaggaccaguggugcgggagccugaucggacucacugcccgcgcuacaugggccucgaauauucagguggcaaucaaccagguacggaggcuuauagguaaugaaaacuaccuggacuacaugaccuccaugaagcgauuuaaaaaugagggcgauccugaaggggcucuaugguga

SEQ ID NO: 13811 - RNA, 9879 nt, Artificial Sequence
  derived and/or modified CDS sequence (opt3) from DENV-1__FJ882565__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugaggggguccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguauuagcaucaugaucgaagaggucaugaggucgcgcuggucccgaaagaugcucaugaccggaacucuggcuguguuccuacugcucauuaugggccagcugacauggaacgaccuuauccgguugugcauuaugguuggggccaaugcaucugaucguaugggaaugggcaccacauaucuggcuuuaauggccacuuuuaaaaugagaccuauguucgcagugggucuccuguuuaggcgccuuaccagccgggagguccugcuacucacgauagggcugucauugguggccaguguugaacugccaaacuccuuagaggaacucggagacggccuggcuaugggcaucaugauucuuaagcuguugacagauuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuugggucccugggaugcaaaccuuugacuauguuucucaucgcugagaauaagauaugggguagaaaaagcuggccacugaacgaaggcaucauggccguggggguugugucgauucuacugucaucucuucucaagaacgacgucccccuggccggaccuuugaucgcuggcgguauguuaauugcauguuaugugaucaguggguccagcgccgaucugucucucgagaaagcggcugagguaagcugggaagaggaagccgagcacuccggagcaucacauaauauacugguggaaguccaggacgauggcacaaugaagauuaaagacgaggagagggaugacacccuuacuauccuguugaaggccacacuacuggcuguuaguggcguguacccccucagcaucccagcaacccuguucgugugguauuuuuggcaaaagaaaaagcagcgaucugggguccuuugggauacgccuucacccccagaaguggagcgcgccguuuuagacgauggaauuuaccggauaaugcagagaggucugcucggcaggagccagguaggggugggagucuuccaagaaaacguguuccacacuauguggcacguuacccguggcgcgguguugauguaucaggguaaacgccuggagccgaguugggcuagcgucaagaaagaccucaucuccuacgggggaggcuggcggcugcagggcucuuggaauacaggggaggaagugcagguaauugccgucgagccuggaaagaaccccaagaaugugcaaaccgcaccagguacauuuaaaacucccgaaggcgagguuggggccaucgcucuugacuucaagccuggaaccucgggcagcccaauugugaacagagaagguaaaaucgucgggcuguacggaaauggcgugguuacgacaucaggcacuuauguguccgccauagcacaggcuaaggccagucaggaggggcccuugccugagaucgaagaugaggucuuuaggaaacgaaaccuaaccauuauggaccugcauccgggaucugguaagacacggcgcuaccucccagcgaucgugagagaagccauuaagaggaaauuacggacccugauccuugcacccacucgaguaguggcuagcgagauggccgaagcucugaagggcaugccuauaagauaucaaaccacagcaguuaaauccgagcacacggggaaggagauugucgaucucaugugccaugccacuuucaccaugcgcuugcugucaccagugagggugcccaauuacaacaugaucaucauggacgaagcccacuuuacagauccuucuagcauugcugcgcguggauauaucaguacccgggucggcaugggugaggcagccgcuauauucaugacugccacaccgcccggguccguagaagcauuuccacagagcaaugccgugauucaggacgaggaaagagauaucccugagaggucuuggaacucaggauacgaguggauuaccgacuuccccggcaaaacgguuugguuugugccauccaucaagaguggcaaugauauagcuaacugucuccgcaagaaugggaaacgagucauucagcugagcagaaagacuuucgacacagaauaucagaaaaccaagaacaacgauugggacuacgugguuaccacugacaucucggagaugggagcgaauuuucgggccgauagggugaucgacccucgccguugccuuaaacccgucauucuaaaggaugguccagaaagagugauccuggcaggcccgaugccuguaacaguggcuucugccgcacagcggagggggcgcauuggacgaaaccauaauaaggagggcgaccaguacauauauaugggucagcccuugaacaaugaugaggaccacgcccacuggaccgaagcuaaaauguuacuggauaacaucaauacaccagaggggauuauccccgcccucuucgaaccugagagagaaaaguccgcggcaaucgacggcgaguaccggcugaggggagaggcccgcaaaacuuucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagauuuggacgaaagagggugaacgaaagaaacugagacccagguggcuagaugcccggaccuauucugacccucuggcucuccgcgaguuuaaggaguucgcagccggcagaagguccguuagcggggaccuuauacuggagaucggaaaguuaccgcagcauuugacacagcgggcucaaaaugcccuggauaaccucgugaugcugcacaauucagaacagggcggucgagcauacagacaugcgauggaggagcuuccagacacuauugaaacccugaugcucuuggcccugaucgcuguauuaacagggggcgugacccuauuuuuccugaguggacgcggccucgggaaaacuagcauuggacuucugugugucauggccuccucuguguugcuguggauggcaagcguugagccccacuggaucgcugccuccauaauccucgaauuuuuccugauggugcuucucauuccugagcccgauaggcagcggacgccacaggacaaccaacuggcauaugucguaaucgguuugcuguuuaugauuuuaaccguggccgcuaaugagaugggccuacuggaaacaacuaagaaagaucucgggaucggacacguugcgguggagaaccaucaccaugccaccaugcuugacgucgaucugcacccugcaucagcuuggacauuguacgccguggccaccacuauaauuacacccaugaugcgucauacgaucgaaaacaccacugcaaauauuucucugacagcuaucgccaaccaggcggcuauacucaugggccuggacaaggguuggccaaucaguaaaauggauauuggggucccucuuuuagcccugggcugcuacagccaggugaauccgcucaccuugaccgcagccguucugaugcuaguggcucacuaugcaaucauuggacccggccugcaagccaaggcgacaagagaggcucagaagaggacugccgcagggaucaugaaaaacccaacgguagacggaauaguggccauugaucucgacccugucguuuacgaugcuaaguucgaaaaacagcuuggccagaucaugcuguugauccuguguaccagccaaauucuccugaugcgcacaacuugggccuuaugcgaguccaucacccuugcaacagguccccugaccacucucugggaggggucuccaggaaaguuuuggaauacgacaauagcugugucaauggccaacauuuuccggggcagcuaucuagcgggugccggccuggcauuuuccuugaugaaaagucuagggggaggccgaagagggaccggagcucagggcgaaacucucggugagaaguggaagaggcagcuuaaucagcugucuaaaagcgaguucaacaucuacaagcgcucagggauuauggaggucgaccgguccgaagccaaagagggauugaagagaggcgagaccacacgucacgcagugaguagggguacugcuaaacugcggugguucguagaacgcaaucucgugaagccugagggcaagguuaucgacuuaggguguggacgaggcggguggagcuauuacugcgccggacugaaaaaggugaccgaagucaaaggcuauacaaagggugggcccggacaugaggaaccgauaccaauggccacguacggcuggaaccuugugaaacugcacucuggcaaggaugucuuuuucaccccucccgagaaaugugacacucuacucugcgauaucggggaguccucaccaaaucccacaauugaagagggaagaacccugaggguguugaagaugguugaaccuuggcugcgggguaaccaauuuuguaucaagauucucaauccguacaugcccagcguaguggagacucuugagcagaugcagcgcaaacauggcgggaugcuggucagaaacccauuaucgagaaauucuacacacgaaauguauugggugaguugcggaaccggcaacaucguuuccgcggugaauaugacgagccgaaugcuguugaaccgguucaccauggcucaccguaagccuacauacgagagagacgucgaucucggugcagggacucgccauguggccguagaacccgagguggcuaaccuggacauuaucggacagaggauagaaaauauuaaacacgagcauaagucaaccuggcacuaugaugaggacaacccuuacaaaacaugggccuaucauggcuccuacgaaguuaagccaucuggcagcgcaaguuccauggucaaugggguggugaagcuacuuacuaaacccugggaugucaucccuaugguuacccaaaucgccaugacagacaccacuccauuuggacagcagcggguguucaaggagaaaguagauacgagaacacccaaggcuaaacgcgguaccgcgcaaauuauggaagugacugccagguggcuguggggcuuucucagccgaaacaagaagccgcggauauguaccagagaggaguucacaaggaaaguccgcucuaaugcagcuaucggggccguguuuguugacgagaaccaguggaacucagcaaaggaggccguggaagacgagcguuucugggaucugguccagaaagaacgggaguugcacaagcagggaaaaugcgcuacgugcguguauaacaugaugggcaagagagaaaagaaacugggugaguuugggaaggccaaaggaaguagggcgauuugguacauguggcucggcgcacgcuuccuugaguuugaagcccugggcuucaugaaugaggaccacugguucucccgagaaaacagcuuaucugggguagagggagagggucugcauaaguugggcuacauccuccgggauauuucgaaaaucccugggggaaauauguaugcugacgauaccgccggcugggacacuagaauaacagaagaugaccugcaaaacgaggcaaagaucaccgauauuauggaaccagagcacgcucuacuugccacuucaaucuuuaaacugacauaccagaauaagguugugaggguccagcgccccgcuaagaacgguaccgugauggacgugauuagcagacgggaucagaggggguccggacaagucggcacauauggccucaauacuuucaccaacauggaagcccagcugauccgucagauggagagugaggggauauuuuugccuucugaauuagagacgccaaaccuggcagaacgaguucucgacuggcuugagaaauacggaguggaacgccugaagagaauggcgauuagcggugaugacuguguagugaaacccaucgacgaucgguucgccaccgcucuaacagcccugaaugacaugggcaaggucaggaaagauaucccgcagugggagccuuccaagggguggaacgacuggcaacaggugcccuuuugcucacaucacuuccaccagcucauuaugaaggauggacgcgagauaguugugccauguagaaaucaggacgaauuggucggccgggcaagggugagucaaggugcuggguggucucugcgagagacugccugccuuggaaaaagcuaugcacagauguggcagcugauguacuuucaucguagagaucuccgcuuagccgcgaacgcuaucuguuccgccguaccuguugacugggugcccaccucacggacaacuuggagcauucacgcacaucaccaauggaugaccacggaagauaugcugucugucuggaauaggguguggaucgaggaaaacccauggauggaggacaagacacauguuuccaguuggggcgaugugcccuauuugggcaaaagagaggaccaguggugcgggagccugauuggacucaccgcccgcgcuacuugggccucgaauauccaggucgcaauaaaccaggugcggaggcuuaucgguaaugaaaacuaccuggacuacaugacauccaugaagcgauucaaaaaugagggcgauccugaaggggcucuaugguga

SEQ ID NO: 13812 - RNA, 9879 nt, Artificial Sequence
  derived and/or modified CDS sequence (opt3) from DENV-1__FJ882567__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaaaagcuggccacugaacgaaggcauaauggccguggggguugugucgauccuacugucaucucuucucaagaacgacgucccccuggccggaccuuugauugcuggcgguauguuaaucgcauguuaugugauuaguggguccagcgccgaucugucucucgagaaagcggcugagguaagcugggaagaggaagccgagcacuccggagcaucacauaauauccugguggaaguccaggacgauggcaccaugaagauaaaagacgaggagagggaugacacucuuacaauucuguugaaggccacccuacuggcuguuaguggcguguacccccucagcaucccagcaacgcuguucgugugguauuuuuggcaaaagaaaaagcagcgaucugggguccuuugggauacuccuucacccccagaaguggagcgcgccguuuuagacgauggaaucuaccggauuaugcagagaggucugcucggcaggagccagguaggggugggagucuuccaagaaaacguguuccacaccauguggcacguuacacguggcgcgguguugauguaucaggguaaacgccuggagccgaguugggcuagcgucaagaaagaccucauauccuacgggggaggcuggcggcugcagggcucuuggaauaccggggaggaagugcagguaaucgccgucgagccuggaaagaaccccaagaaugugcaaacagcaccagguacuuuuaaaacccccgaaggcgagguuggggccauugcucuugacuucaagccuggaacgucgggcagcccaaucgugaacagagaagguaaaauugucgggcuguacggaaauggcgugguuacaacuucaggcaccuauguguccgccaucgcacaggcuaaggccagucaggaggggcccuugccugagauagaagaugaggucuuuaggaaacgaaaccuaacaaucauggaccugcauccgggaucugguaagacccggcgcuaccucccagcgauugugagagaagccaucaagaggaaauuacggacucugauucuugcacccacccgaguaguggcuagcgagauggccgaagcucugaagggcaugccuaucagauaucaaacaacggcaguuaaauccgagcacacugggaaggagauagucgaucucaugugccaugccaccuucacaaugcgcuugcugucaccagugagggugcccaauuacaacaugauuaucauggacgaagcccacuuuaccgauccuucuagcaucgcugcgcguggauauauuaguacucgggucggcaugggugaggcagccgcuaucuucaugacagccaccccgcccggguccguagaagcauuuccacagagcaaugccgugauacaggacgaggaaagagauauuccugagaggucuuggaacucaggauacgaguggaucacggacuuccccggcaaaacuguuugguuugugccauccauuaagaguggcaaugauaucgcuaacugucuccgcaagaaugggaaacgagucauacagcugagcagaaagacauucgacaccgaauaucagaaaaccaagaacaacgauugggacuacgugguuacuacagacauuucggagaugggagcgaauuuucgggccgauagggugaucgacccucgccguugccuuaaacccgucauccuaaaggaugguccagaaagagugauucuggcaggcccgaugccuguaaccguggcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuucgaaccugagagagaaaaguccgcggcaaucgacggcgaguaccggcugaggggagaggcccgcaaaacguucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagaucuggaccaaagagggugaacgaaagaaacugagacccagguggcuagaugcccggacauauucugacccucuggcucuccgcgaguuuaaggaguucgcagccggcagaagguccguuagcggggaccuuauucuggagauaggaaaguuaccgcagcauuugacucagcgggcucaaaaugcccuggauaaccucgugaugcugcacaauucagaacagggcggucgagcauacagacaugcgauggaggagcuuccagacaccaucgaaacacugaugcucuuggcccugauugcuguauuaaccgggggcgugacucuauuuuuccugaguggacgcggccucgggaaaacgagcaucggacuucugugugucauggccuccucuguguugcuguggauggcaagcguugagccccacuggauugcugccuccaucauacucgaauuuuuccugauggugcuucucaucccugagcccgauaggcagcggaccccacaggacaaccaacuggcauaugucguaauugguuugcuguuuaugaucuuaacaguggccgcuaaugagaugggccuacuggaaacuaccaagaaagaucucgggauuggacacguugcgguggagaaccaucaccaugccacaaugcuugacgucgaucugcacccugcaucagcuuggaccuuguacgccguggccacuacaaucauaacgcccaugaugcgucauaccauugaaaacacuacagcaaauaucucucugaccgcuauugccaaccaggcggcuauccucaugggccuggacaaggguuggccaauaaguaaaauggauaucggggucccucuuuuagcccugggcugcuacagccaggugaauccgcucaccuugacagcagccguucugaugcuaguggcucacuaugcaauuaucggacccggccugcaagccaaggcgacuagagaggcucagaagaggacggccgcagggauuaugaaaaacccaaccguagacggaaucguggccauagaucucgacccugucguuuacgaugcuaaguucgaaaaacagcuuggccagauuaugcuguugauccuguguacaagccaaauccuccugaugcgcacuaccugggccuuaugcgaguccauuacacuugcaaccgguccccugacuacgcucugggaggggucuccaggaaaguuuuggaauacaaccaucgcugugucaauggccaacauauuccggggcagcuaucuagcgggugccggccuggcauuuuccuugaugaaaagucuagggggaggccgaagagggacuggagcucagggcgaaacccucggugagaaguggaagaggcagcuuaaucagcugucuaaaagcgaguucaacauuuacaagcgcucagggaucauggaggucgaccgguccgaagccaaagagggauugaagagaggcgagacaacucgucacgcagugaguagggguaccgcuaaacugcggugguucguagaacgcaaucucgugaagccugagggcaagguuauugacuuaggguguggacgaggcggguggagcuauuacugcgccggacugaaaaaggugacagaagucaaaggcuauacgaagggugggcccggacaugaggaaccgaucccaauggccaccuacggcuggaaccuugugaaacugcacucuggcaaggaugucuuuuucacuccucccgagaaaugugacacacuacucugcgauauaggggaguccucaccaaaucccaccaucgaagagggaagaacucugaggguguugaagaugguugaaccuuggcugcgggguaaccaauuuuguauuaagauccucaauccguacaugcccagcguaguggagacacuugagcagaugcagcgcaaacauggcgggaugcuggucagaaacccauuaucgagaaauucuacccacgaaauguauugggugaguugcggaacgggcaacauuguuuccgcggugaauaugaccagccgaaugcuguugaaccgguucacaauggcucaccguaagccuacuuacgagagagacgucgaucucggugcagggacccgccauguggccguagaacccgagguggcuaaccuggacaucauuggacagaggaucgaaaauauaaaacacgagcauaagucaacauggcacuaugaugaggacaacccuuacaaaacuugggccuaucauggcuccuacgaaguuaagccaucuggcagcgcaaguuccauggucaaugggguggugaagcuacuuaccaaacccugggaugucauuccuaugguuacacaaaucgccaugaccgacacuacgccauuuggacagcagcggguguucaaggagaaaguagauacaagaacccccaaggcuaaacgcgguacugcgcaaaucauggaagugaccgccagguggcuguggggcuuucucagccgaaacaagaagccgcggauuuguacaagagaggaguucacgaggaaaguccgcucuaaugcagcuauaggggccguguuuguugacgagaaccaguggaacucagcaaaggaggccguggaagacgagcguuucugggaucugguccagaaagaacgggaguugcacaagcagggaaaaugcgcuaccugcguguauaacaugaugggcaagagagaaaagaaacugggugaguuugggaaggccaaaggaaguagggcgaucugguacauguggcucggcgcacgcuuccuugaguuugaagcccugggcuucaugaaugaggaccacugguucucccgagaaaacagcuuaucugggguagagggagagggucugcauaaguugggcuacauucuccgggauaucucgaaaauuccugggggaaauauguaugcugacgauacugccggcugggacacaagaaucaccgaagaugaccugcaaaacgaggcaaagauaacugauaucauggaaccagagcacgcucuacuugccacaucaauuuuuaaacugaccuaccagaauaagguugugaggguccagcgccccgcuaagaacgguacagugauggacgugaucagcagacgggaucagaggggguccggacaagucggcacuuauggccucaauaccuucacgaacauggaagcccagcugauucgucagauggagagugaggggaucuuuuugccuucugaauuagagaccccaaaccuggcagaacgaguucucgacuggcuugagaaacauggaguggaacgccugaagagaauggcgauaagcggugaugacuguguagugaaacccauugacgaucgguucgccacagcucuaacugcccugaaugacaugggcaaggucaggaaagauaucccgcagugggagccuuccaagggguggaacgacuggcaacaggugcccuuuugcucacaccacuuccaucagcucaucaugaaggauggacgcgagauuguugugccauguagaaaucaggacgaauuggucggccgggcaagggugagucaaggugcuggguggucucugcgagagaccgccugccuuggaaaaagcuacgcacagauguggcagcugauguauuuucaccguagagaucuccgcuuagccgcgaacgcuauauguuccgccguaccuguugacugggugcccacaucacggacuaccuggagcauccaugcacaccaucaauggaugacgacagaagauaugcugucugucuggaauaggguguggauugaggaaaacccauggauggaggacaagacccacguuuccaguuggggcgaugugcccuacuugggcaaaagagaggaccaguggugcgggagccugaucggacucacugcccgcgcuacaugggccucgaauauucaggucgcaaucaaccaggugcggaggcuuauagguaaugaaaacuaucuggacuacaugaccuccaugaagcgauucaaaaaugagggcgauccugaaggggcucuaugguga

SEQ ID NO: 13813 - RNA, 9879 nt, Artificial Sequence
  derived and/or modified CDS sequence (opt3) from DENV-1__GQ199831__SS-prME
uccgugaccaugcugcucaugcuuaugcccacggcccuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgagacugaaccggacgauguggacuguuggugcaaugcgacagauaccuggguaacguaugggacuuguucacaaaccggagagcaccgccgagacaagcguaguguggcucuugcaccccaugucggccuggguuuggagacaagaacugaaaccuggaugagcuccgagggggcauggaaacagauccagaggguggaaacaugggcccuccggcacccuggauucaccguuauugcucuguuucuggcccaugccaucggcacgucuauuacucagaagggcaucauauucauccucuuaaugcuggugacaccaucgauggcuaugcgcugcgucgggauuggaucaagagauuuuguggagggucuuagcggcgccaccuggguagacguuguguuggagcacgggaguugugucacuacaauggcgaaggauaaacccacccuggacaucgaacuacucaagacggaggugaccaacccugcagugcugaggaaacuuugcauugaagccaagaucuccaauacaacuaccgauucucgguguccaacacaaggagaggcuacucugauggaagaacaagacgccaacuucgucugccgccgaaccuuuguugauagaggcugggguaauggguguggauuguucggcaaaggcagccucauaacaugcgcaaaguuuaagugcgugaccaaacuggaggggaagauuguacaguacgaaaacuuaaaauauuccgugaucgucacugugcacacgggagaccagcaucaaguugguaaugagucaacagaacacggcaccacugcuaccauuacaccccaggccccuaccagugagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugucauguguaccggaucguucaaacuggagaaggaaguggccgagacgcagcacgguacaguccuugugcagauaaaguacgagggcaccgacgcuccuugcaaaaucccauucucgacucaagaugaaaaggggguuacacagaacggacgcuugauuaccgcgaaucccaucgugacugacaaagagaagccuguaaacauagaagcagagccacccuuuggcgagucuuauauugucaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguguuuacguccguugggaaacuugugcaucagauuuucggaaccgcauacggcguccuguuuucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuucgucaccaaugagguucacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacugugguagucggcgaugugguugggauucuggcacagggcaaaaagaugauccgcccucaacccauggagcacaaauacucguggaaaagcuggggcaaggcuaagauaaucggggccgacgugcagaauaccacauuuauuaucgauggaccaaacacuccugaaugucccgacgaucagagagcguggaauauuugggaggucgaggacuauggcuucgguaucuuuaccacaaacauauggcuuaaguugagggauuccuacacacaggugugcgaccaccgucucaugucagccgcuauuaaagauaguaaggcaguucaugccgacaugggguauuggaucgaaucugagaaaaaugaaaccuggaagcuggcucgggccagcuucauugaggugaagacuuguaucuggccaaaaucccacacacuauggucaaacggaguacuggaaagcgagaugauaauccccaagauuuacggcgguccuaucucucaacauaauuaucgaccaggcuacuucacccagacugcagggccguggcaccucggaaaacuggagcuugauuuugacuugugcgaaggcacaaccgucgugguggaugagcacugcgggaacagaggacccucccugaggacgacuaccgucacaggcaagauuauccaugaaugguguugccgcaguuguaccuuaccuccacuccgguucaaaggugaggacgggugcugguacggaauggagauaagacccguuaaggaaaaggaggaaaaucuggugaaaagcaugguaucugcgggcuccggugagguggacucauuuagucuuggccuguuguguauuagcaucaugaucgaagaggucaugaggucgcgcuggucccgaaagaugcucaugacugggacacuggccguguuccuacugcucauuaugggacagcugaccuggaacgaucuuauccgguugugcauuaugguuggcgcuaaugccucugaccguauggggaugggaacaacuuaucuggcauuaauggcuaccuuuaaaaugagaccuauguucgccgugggccuccuguuuaggcgccuuacgagccgggagguccugcuacucacaauaggucugucauugguggcaaguguugaacugccaaacuccuuagaggaacucggggauggacuggccaugggcaucaugauucuuaagcuguugaccgacuuccaaucucaccagcucugggcuacucugcuaagccugaccuuuaucaaaacaacucuuucccuccauuacgcguggaagaccauggccauggugcugucaauugucagcuuguucccccuguguuuaaguacgacaucucagaagaccacuuggcucccgguacugcuuggcucccuggggugcaaaccuuugacaauguuucucaucgcagagaauaagauauggggaagaaaaagcuggccacugaacgaagguaucauggcugugggcguugugucgauucuacugucaucucuucucaagaacgaugucccccuggccgggccuuugaucgccggaggcauguuaauugcuuguuaugugaucagugguuccagcgcagaccugucucucgagaaagccgcggagguaagcugggaagaggaagcugagcacuccggggccucacauaauauacugguggaaguccaggaugacggaaccaugaagauuaaagaugaggagagggacgauacucuuacaauccuguugaaggcaacccuacuggccguuaguggcguguacccccucagcaucccagcuacgcuguucgugugguauuuuuggcaaaagaaaaagcagcgaucuggcguccuuugggacacuccuucacccccagaaguggagcgcgcaguuuuagaugacgggauuuaccggauaaugcagagaggacugcucgguaggagccagguaggcgugggggucuuccaagaaaacguguuccacaccauguggcacguuacacguggagccguguugauguaucagggcaaacgccuggagccgaguugggcgagcgucaagaaagaccucaucuccuacggugggggauggcggcugcagggcucuuggaauaccggcgaggaagugcagguaauugcugucgagccugggaagaaccccaagaaugugcaaacagccccaggaacuuuuaaaacccccgaaggugagguuggcgcaaucgcccuugauuucaagccugggacgucgggaagcccaauugugaacagagaaggcaaaaucgucggucuguacgggaauggagugguuacaacuucaggcaccuauguguccgcuauagcccaggcaaaggcuagucaggagggccccuugccugagaucgaagacgaggucuuuaggaaacgaaaccuaacaauuauggaucugcauccggggucuggaaagacccggcgcuaccucccagccaucgugagagaagcgauuaagaggaaauuacggacucugauccuugcccccacccgaguaguggcaagcgagauggcugaagcccugaaggguaugccuauaagauaucaaacaacggcuguuaaauccgagcacacuggcaaggagauugucgaccucaugugccaugcaaccuucacaaugcgcuugcugucaccagugagggugcccaauuacaacaugaucaucauggaugaagcccacuuuaccgacccuucuagcauugccgcucguggguauaucaguacucgggucggaaugggcgaggcggcagccauauucaugacagcuaccccgcccgguuccguagaagccuuuccacagagcaaugcagugauucaggaugaggaaagagacaucccugagaggucuuggaacucaggguacgaguggauuacggauuuccccggaaaaacuguuugguuugugccauccaucaagaguggcaaugacauagccaacugucuccgcaagaauggcaaacgagucauucagcugagcagaaagacauucgauaccgaauaucagaaaaccaagaacaacgacugggacuacgugguuacuacagauaucucggagaugggggcuaauuuucgggcggacagggugaucgauccucgccguugccuuaaacccgucauucuaaaggacggaccagaaagagugauccuggccgguccgaugccuguaaccguggcaucugcugcccagcggaggggccgcauugggcgaaaccauaauaaggagggagaucaguacauauauaugggccagcccuugaacaaugacgaggaucacgcacacuggacagaagccaaaauguuacuggacaacaucaauacuccagaggguauuauccccgcucucuucgaaccugagagagaaaaguccgccgcgaucgauggggaguaccggcugaggggcgaggcacgcaaaacguucguugaacuuaugagaaggggagaccugccagucuggcucagcuauaagguggccucagagggcuuucaauacagugaucggcguuggugcuucgacggggaacgcaacaaucagguguuggaggaaaacauggaugucgagauuuggaccaaagagggagaacgaaagaaacugagacccagguggcuagacgcucggacauauucugacccucuggcccuccgcgaguuuaaggaguucgcugcagguagaagguccguuagcggcgaucuuauacuggagaucgggaaguuaccgcagcauuugacucagcgggcccaaaaugcucuggacaaccucgugaugcugcacaauucagaacagggaggccgagccuacagacaugcaauggaggagcuuccagauaccauugaaacacugaugcucuuggcgcugaucgccguauuaaccgguggggugacucuauuuuuccugaguggccgcggacucggcaaaacgagcauugggcuucugugugucauggcuuccucuguguugcuguggauggccagcguugagccccacuggaucgcagcuuccauaauccucgaauuuuuccugauggugcuucucauuccugagcccgacaggcagcggaccccacaggauaaccaacuggccuaugucguaaucggauugcuguuuaugauuuuaacaguggcagccaaugagaugggucuacuggaaacuaccaagaaagaccucggcaucgggcacguugcuguggagaaccaucaccaugcgacaaugcuugaugucgaccugcacccugccucagcauggaccuuguacgcuguggccacuacaauaauuacgcccaugaugcgucauaccaucgaaaacacuacagccaauauuucucugaccgcaaucgcuaaccaggccgcgauacucaugggacuggauaagggcuggccaaucaguaaaauggacauuggugucccucuuuuagcucuggggugcuacagccaggugaauccgcucaccuugacagccgcaguucugaugcuaguggcccacuaugcuaucauuggccccggacugcaagcaaaggccacuagagaggcgcagaagaggacggcugccggcaucaugaaaaacccaaccguagaugggauaguggcaauugaccucgauccugucguuuacgacgccaaguucgaaaaacagcuuggacagaucaugcuguugauccuguguacaagccaaauucuccugaugcgcacuaccugggcuuuaugcgaguccaucacacuugccaccggcccccugacuacgcucugggaggguucuccagggaaguuuuggaauacaaccauagcagugucaauggcuaacauuuuccggggaagcuaucuagccggcgcgggucuggccuuuuccuugaugaaaagucugggcgggggacgaagaggcacuggggcacagggagaaacccucggcgagaaguggaagaggcagcuuaaucagcugucuaaaagcgaguucaacaucuacaagcgcucagguauuauggaggucgaccgguccgaagcuaaagagggguugaagagaggagagacaacucgucacgccgugaguaggggcaccgcaaaacugcggugguucguagaacgcaaucucgugaagccugaggguaagguuaucgauuuaggcugugggcgaggaggcuggagcuauuacugcgcugggcugaaaaaggugacagaagucaaaggauauacgaagggcggucccgggcaugaggaaccgauaccaauggccaccuacggauggaaccuugugaaacugcacucuggcaaggacgucuuuuucacuccucccgagaaaugugauacacuacucugcgacaucggcgaguccucaccaaaucccaccauugaagaggggagaacucugaggguguugaagaugguugaaccuuggcugcggggaaaccaauuuuguaucaagauucucaauccguacaugcccagcguaguggagacacuugagcagaugcagcgcaaauaugguggcaugcuggucagaaacccauuaucgagaaauucuacccaugaaauguacugggugaguugcgggacgggaaacaucguuuccgccgugaauaugaccagccgaaugcuguugaaccgguucacaauggcgcaccguaagccuacuuaugagagagaugucgaccucggcgcugguacccgccacguggcaguagaacccgagguggccaaccuggauauuaucgggcagaggauagaaaauauuaaacaugagcacaagucaacauggcauuacgacgaggauaacccuuauaaaacuugggcuuaccacggauccuaugaaguuaagccaucuggcagcgccaguuccauggucaauggcguggugaagcuacuuaccaaacccugggacgucaucccuaugguuacacaaaucgcaaugaccgauacuacgccauuugggcagcagcggguguucaaggagaaaguagacacaagaacccccaaggccaaacgcggaacugcucaaauuauggaagugaccgcgagguggcugugggguuuucucagccgaaacaagaagccgcggauauguacaagagaggaguucacgaggaaaguccgcucuaaugccgcaaucggcgcuguguuuguugacgagaaccaguggaacucagccaaggaggcaguggaagaugagcguuucugggaccugguccagaaagaacgggaguugcauaagcaggggaaaugcgcaaccugcguguacaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguagagggggagggacugcacaaguuggguuauauccuccgggacauuucgaaaaucccuggcgggaauauguacgccgaugacacugcuggaugggauacaagaauaaccgaagacgaucugcaaaacgaggccaagaucacugacauuauggaaccagagcaugcacuacuugcuacaucaaucuuuaaacugaccuaucagaauaagguugugaggguccagcgccccgccaagaacggcacagugauggaugugauuagcagacgggaccagagggguuccgggcaagucggaacuuacggccucaauaccuucacgaacauggaagcucagcugauccgucagauggagagugagggcauauuuuugccuucugaauuagagaccccaaaccuggccgaacgaguucucgauuggcuugagaaauaugggguggaacgccugaagagaauggcaauuagcggagacgacuguguagugaaacccaucgaugaccgguucgcgacagcccuaacugcucugaaugauauggguaaggucaggaaagacaucccgcagugggagccuuccaagggcuggaacgauuggcaacaggugcccuuuugcucacaccauuuccaccagcucauuaugaaggacgggcgcgagauaguugugccauguagaaaucaggaugaauuggucggacgggccagggugagucaaggcgcagguuggucucugcgagagaccgcuugccuugggaaaagcuacgcccagauguggcagcugauguauuuucaccguagagaccuccgcuuagcagccaacgcgaucuguuccgcugauccuguagacuggguucccacaucacggacuaccuggagcauucaugcccaccaucaauggaugacgacagaagauaugcugucuguguggaauagggucuggaucgaggaaaacccauggauggaggacaagacccacguguccaguuggggagacguucccuacuugggcaaaagagaggaucaguggugcggcagccugauugggcucacugcacgcgccacaugggcuucgaauauccagguggccauaaaccagguccggaggcuuaucggaaaugaaaacuaccuggacuauaugaccuccaugaagcgauucaaaaaugagggugauccugaaggcgcacuaugguga

SEQ ID NO: 13814 - RNA, 9879 nt, Artificial Sequence
  derived and/or modified CDS sequence (opt3) from DENV-1__GQ199832__SS-prME
agcgugaccaugcugcucaugcuuaugcccaccgcacuggcuuuccacuugacuacgagaggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaaaagcuggccacugaacgaaggcauaauggccguggggguugugucgauccuacugucaucucuucucaagaacgacgucccccuggccggaccuuugauugcuggcgguauguuaaucgcauguuaugugauuaguggguccagcgccgaucugucucucgagaaagcggcugagguaagcugggaagaggaagccgagcacuccggagcaucacauaauauccugguggaaguccaggacgauggcaccaugaagauaaaagacgaggagagggaugacacucuuacaauucuguugaaggccacccuacuggcuguuaguggcguguacccccucagcaucccagcaacgcuguucgugugguauuuuuggcaaaagaaaaagcagcgaucugggguccuuugggauacuccuucacccccagaaguggagcgcgccguuuuagacgauggaaucuaccggauuaugcagagaggucugcucggcaggagccagguaggggugggagucuuccaagaaaacguguuccacaccauguggcacguuacacguggcgcgguguugauguaucaggguaaacgccuggagccgaguugggcuagcgucaagaaagaccucauauccuacgggggaggcuggcggcugcagggcucuuggaauaccggggaggaagugcagguaaucgccgucgagccuggaaagaaccccaagaaugugcaaacagcaccagguacuuuuaaaacccccgaaggcgagguuggggccauugcucuugacuucaagccuggaacgucgggcagcccaaucgugaacagagaagguaaaauugucgggcuguacggaaauggcgugguuacaacuucaggcaccuauguguccgccaucgcacaggcuaaggccagucaggaggggcccuugccugagauagaagaugaggucuuuaggaaacgaaaccuaacaaucauggaccugcauccgggaucugguaagacccggcgcuaccucccagcgauugugagagaagccaucaagaggaaauuacggacucugauucuugcacccacccgaguaguggcuagcgagauggccgaagcucugaagggcaugccuaucagauaucaaacaacggcaguuaaauccgagcacacugggaaggagauagucgaucucaugugccaugccaccuucacaaugcgcuugcugucaccagugagggugcccaauuacaacaugauuaucauggacgaagcccacuuuaccgauccuucuagcaucgcugcgcguggauauauuaguacucgggucggcaugggugaggcagccgcuaucuucaugacagccaccccgcccggguccguagaagcauuuccacagagcaaugccgugauacaggacgaggaaagagauauuccugagaggucuuggaacucaggauacgaguggaucacggacuuccccggcaaaacuguuugguuugugccauccauuaagaguggcaaugauaucgcuaacugucuccgcaagaaugggaaacgagucauacagcugagcagaaagacauucgacaccgaauaucagaaaaccaagaacaacgauugggacuacgugguuacuacagacauuucggagaugggagcgaauuuucgggccgauagggugaucgacccucgccguugccuuaaacccgucauccuaaaggaugguccagaaagagugauucuggcaggcccgaugccuguaaccguggcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuucgaaccugagagagaaaaguccgcggcaaucgacggcgaguaccggcugaggggagaggcccgcaaaacguucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagaucuggaccaaagagggugaacgaaagaaacugagacccagguggcuagaugcccggacauauucugacccucuggcucuccgcgaguuuaaggaguucgcagccggcagaagguccguuagcggggaccuuauucuggagauaggaaaguuaccgcagcauuugacucagcgggcucaaaaugcccuggauaaccucgugaugcugcacaauucagaacagggcggucgagcauacaaacaugcgauggaggagcuuccagacaccaucgaaacacugaugcucuuggcccugauugcuguauuaaccgggggcgugacucuauuuuuccugaguggaagaggccucgggaagacgagcaucggacuucugugugucauggccuccucuguguugcuguggauggcaagcguugagccccacuggauugcugccuccaucauacucgaauuuuuccugauggugcuucucaucccugagcccgaucgccagaggaccccacaggacaaccaacuggcauaugucguaauugguuugcuguuuaucauuuuaacaguggccgcuaaugagaugggccuacuggaaacuaccaaaaaggaucucgggaucggacacguugcgguggagaaccaucaccaugccacaaugcuugacgucgaucugcacccugcaucagcuuggaccuuguacgccguggccacuacaauaauuacgcccaugaugcggcauaccaucgaaaacacuacagcaaauauuucucugaccgcuaucgccaaccaggcggcuauacucaugggccuggacaaagguuggccaaucaguaagauggauauuggggucccucuuuuagcccugggcugcuacagccaggugaauccgcucaccuugacagcagccguucugaugcuaguggcucacuaugcaaucauuggacccggccugcaagccaaggcgacucgugaggcucagaaaagaacggccgcagggaucaugaagaacccaaccguagacggaauaguggccauugaucucgacccugucguuuacgaugcuaaauucgaaaagcagcuuggccagaucaugcuguugauccuguguacaagccaaauucuccugaugaggacuaccugggccuuaugcgaguccaucacacuugcaaccgguccccugacuacgcucugggaggggucuccaggaaaauuuuggaauacaaccauagcugugucaauggccaacauuuuccgcggcagcuaucuagcgggugccggccuggcauuuuccuugaugaagagucuagggggaggccggcgagggacuggagcucagggcgaaacccucggugagaaguggaaaagacagcuuaaucagcugucuaagagcgaguucaacaucuacaaaaggucagggauuauggaggucgaccgcuccgaagccaaggagggauugaaacggggcgagacaacuagacacgcagugagucgugguaccgcuaagcugaggugguucguagaacggaaucucgugaagccugagggcaaaguuaucgacuuaggguguggacgcggcggguggagcuauuacugcgccggacugaagaaagugacagaagucaagggcuauacgaaaggugggcccggacaugaggaaccgauaccaauggccaccuacggcuggaaccuugugaagcugcacucuggcaaagaugucuuuuucaucccucccgagaagugugacacucuacucugcgauauuggggaguccucaccaaaucccacaaucgaagagggacgaacccugagaguguugaagaugguugaaccuuggcugagggguaaccaauuuuguauuaaaauccucaauccguacaugcccagcguaguggagacucuugagcagaugcagcggaagcauggcgggaugcugguccgcaacccauuaucgagaaauucuacacacgaaauguauugggugaguugcggaaccggcaacauuguuuccgcggugaauaugacgagcaggaugcuguugaaccgauucaccauggcucaccggaaaccuacauacgagcgugacgucgaucucggugcagggacuagacauguggccguagaacccgagguggcuaaccuggacaucauaggacagcgcauugaaaauaucaagcacgagcauaaaucaaccuggcacuaugaugaggacaacccuuacaagacaugggccuaucauggcuccuacgaaguuaagccaucuggcagcgcaaguuccauggucaaugggguggugaaacuacuuacuaagcccugggaugucaucccuaugguuacccaaauugccaugacagacaccacuccauuuggacagcagaggguguucaaagagaagguagauacgcggacacccaaagcuaagagagguaccgcgcaaauaauggaagugacugcccgcuggcuguggggcuuucucagcaggaacaagaaaccgcgaaucuguacccgggaggaguucacaagaaaggucaggucuaaugcagcuauuggggccguguuuguugacgagaaccaguggaacucagcaaaagaggccguggaagacgagcgcuucugggaucugguccagaaggaacgugaguugcacaaacagggaaagugcgcuacgugcguguauaacaugaugggcaagcgggagaaaaagcugggugaguuugggaaagccaagggaaguagagcgaucugguacauguggcucggcgcaagguuccuugaguuugaagcccugggcuucaugaaugaggaccacugguucucccgcgaaaacagcuuaucugggguagagggagagggucugcauaaauugggcuacauucuccgagauaucucgaagauaccugggggaaauauguaugcugacgauaccgccggcugggacacucggaucacagaagaugaccugcaaaacgaggcaaaaauuaccgauaucauggaaccagagcacgcucuacuugccacuucaauuuuuaagcugacauaccagaauaagguugugagaguccagaggcccgcuaaaaacgguaccgugauggacgugaucagccgcagagaucagcggggguccggacaagucggcacauauggccucaauacuuucaccaacauggaagcccagcugauaaggcagauggagagugaggggauauuuuugccuucugaauuagagacgccaaaccuggcagaacguguucucgacuggcuugagaaguacggaguggaacgacugaaacgcauggcgaucagcggugaugacuguguagugaagcccaucgacgauagauucgccaccgcucuaacagcccugaaugacaugggcaaaguccggaaggauauuccgcagugggagccuuccaagggguggaacgacuggcaacaggugcccuuuugcucacaucacuuccaccagcucauaaugaaagauggaagggagaucguugugccaugucgcaaucaggacgaauuggucggcagagcacgggugagucaaggugcuggguggucucugagggagacugccugccuuggaaagagcuaugcacagauguggcagcugauguacuuucaucgacgugaucucagauuagccgcgaacgcuauuuguuccgccguaccuguugacugggugcccaccucacgcacaacuuggagcauccacgcacaucaccaauggaugaccacggaagauaugcugucugucuggaaucggguguggauugaggaaaacccauggauggaggacaaaacacauguuuccaguuggggcgaugugcccuauuugggcaagagggaggaccaguggugcgggagccugaucggacucaccgccagagcuacuugggccucgaauauacaggucgcaaucaaccaggugcgccggcuuauugguaaugaaaacuaccuggacuacaugacauccaugaaaagguucaagaaugagggcgauccugaaggggcucuaugguga

SEQ ID NO: 13815 - RNA, 9879 nt, Artificial Sequence
  derived and/or modified CDS sequence (opt3) from DENV-1__FJ882568__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuguuguggauagaggcugggguaauggguguggauuguuuggcaaaggcagccucauaaccugcgcuaaguucaagugcguaacaaaacuggaggggaagauugugcaguacgaaaacuuaaaauauuccgucaucgugaccguucacacuggagaccagcaucaaguggguaaugagucaacggaacacggcacaaccgccacuauuaccccccaggcgccuacaagugagauccagcugaccgacuacggggcccucacucuugauuguagcccaaggacaggacuggacuuuaacgaaauggucuugcuaacgaugaaggagaaaucuuggcuggugcauaagcagugguuccucgaucugccgcuucccuggaccuccggcgcaucaacuagccaagagacauggaaucggcaggaccuguugguaaccuuuaaaacagcucacgccaagaagcaggaaguugugguccucgguagucaagagggggcuaugcacacugcccugaccggcgcaacggaaauccagaccucuggaacaacuaccauuuucgccggccauuuaaaaugccgucugaagauggauaaacuaacacucaaggggauguccuaugugauguguacuggaagcuuuaaacuggagaaggaagucgcugagacccagcacgguacggugcuuguucagauaaaguacgagggcacagacgcgccuugcaaaaucccauucuugacccaagaugaaaagggggugacucagaacggacgccugauuacagcaaaucccaucguaaccgacaaagagaagccugucaacauagaagccgagccacccuucggcgagucguauauugugaucggugcuggggaaaaagcccucaagcugucuugguuuaagaaaggcuccucaaucggaaagauguucgaggcaacugccagaggcgcuaggcggauggccauucuuggggauaccgcaugggacuuuggaaguaucgguggcguuuucacaagcguggggaaacugguccaucagauuuuuggaacggcguacggcguguuguucuccgguguaucuuggaccaugaagauagggaucggcgugcuccugacuugguuaggacugaauagccgaucaacaagucuauccaugaccuguauugcuguuggccucgucacacuguaccuuggggugauggugcaggccgauagcggaugcgucaucaacuggaaaggccgcgaauugaagugugguucugggaucuuuguuacuaaugaggugcacaccuggacggaacaauauaaguuccaggcagacucaccgaaaagacugagugccgcuauuggaaaggccugggaggagggcgugugcgguauaaggagcgcaacacggcucgaaaacaucauguggaaacagauuuccaacgagcugaaucauaucuuacuggaaaacggcaugaaguuuaccguagucgugggggacguugugggaauucuugcucagggcaaaaagaugauccgcccucaacccauggagcacaaauacucuuggaagucgugggggaaggccaaaauaaucggagcggauguccagaauacuaccuucauuaucgacggcccaaacacaccugaaugucccgaugaccagagagccuggaauauuugggagguggaggauuaugguuuugggaucuucacuaccaacauaugguugaagcucagggacagcuacacacagguuugcgaucaccgucugauguccgcugcaauuaaagacucaaaggccgugcaugcugauaugggauauuggaucgaaagugagaaaaaugaaacguggaagcuagcccgggcaucuuuuauugagguaaagaccuguaucuggccaaaaagccacacucugugguccaacggcguccucgaaucagagaugauaauccccaagauuuacgguggcccuaucagccaacauaauuaucgaccaggguacuucacacagaccgcgggaccguggcaccugggcaaacuugaguuggacuucgaucugugcgaagggacuacagugguggucgacgagcacugcggaaacagaggccccucuuuaaggaccacgacuguuaccgguaagauuauccaugaaugguguugccgcuccuguacacucccuccacugcgguuuaaaggggaggauggaugcugguacggcauggagauaagacccgugaaggaaaaggaggaaaaucuuguaaaaaguauggugagcgccgguucuggcgaggucgacuccuucucacugggguugcucuguaccaguauuaugaucgaagaggugaugaggagccgcuggucgcgaaagaugcugaugacuggaacacuagcuguuuuucugcuccugaucaugggccagcuuaccuggaacgacuugauucggcugugcaucauggugggggccaaugcauccgaucguaugggaaugggcacaacuuauuuagcucucauggccaccuucaaaaugagaccuauguuugcagucggucugcuuuucaggcgccugacgucucgggaggugcuacuccugacaauuggguugagccugguugccucaguggaauuaccaaacagucucgaggaacugggagacggccuugcuaugggcauaaugauccugaaguugcucaccgauuuucaaucccaccagcugugggcgacucuacugucucuuaccuucauuaaaacaacucucagccugcauuacgccuggaagaccauggcaauggucuuguccaucguaucacuguuucccuuaugucucagcacgacaagucagaagaccacuuggcugccggugcuucuggggucuuugggaugcaaaccucucacaauguuccugauugcugagaauaagaucugggguagaaaauccuggccacuaaacgaaggcauaauggccguugggguggucagcauccugcuuucgucacuccugaagaacgacgugcccuuggccggaccuuuaauugcuggcgguaugcugaucgcauguuauguaauuucugggaguuccgccgaucucagccuggagaaagcggcugaggugucuugggaagaggaagccgagcacagcggagcaucccauaauauccuugucgaaguucaggacgauggcaccaugaagauaaaagacgaggagagggaugacacucugacaauuuugcuaaaggccacccugcucgcugugucaggcguguacccccugaguaucccagcaacgcuuuuugucugguauuucuggcaaaagaaaaagcagcgaagcgggguguuaugggauacuccuucucccccagaaguugagcgcgccguacuggacgauggaaucuaccggauuaugcagagaggucucuugggcaggucccaggugggggucggaguguuucaagaaaacguuuuccacaccauguggcacgugacacguggcgcgguccugauguaucaggguaaacgccucgagccgucaugggcuagugugaagaaagaccugauaagcuacgggggaggcuggcggcuucagggcuccuggaauaccggggaggaaguacaggucaucgccguggagccuggaaagaaccccaagaauguucaaacagcaccagguacuuucaaaacccccgaaggcgaggugggggccauugcucuggacuuuaagccuggaacgucuggcucgccaaucgucaacagagaagguaaaauugugggguuguacggaaauggcguugugacaacuagcggcaccuaugucucagccaucgcacaggcuaaggccucccaggaggggccccuaccugagauagaagaugagguguucaggaaacgaaaccugacaaucauggaccuccauccgggaagugguaagacccggcgcuacuuaccagcgauuguaagagaagccaucaagaggaaacugcggacucuuauucuggcacccacccgagugguugcuucugagauggccgaagcucucaagggcaugccuaucagauaucaaacaacggcagucaaaagcgagcacacugggaaggagauaguggauuugaugugccaugccaccuuuacaaugcgccugcucuccccagugaggguccccaauuacaacaugauuaucauggacgaagcccacuucaccgauccuucaucuaucgcugcgcguggauauauuagcacucggguaggcaugggugaggcagccgcuaucuuuaugacagccaccccgcccgggaguguggaagcauucccacaguccaaugccguuauacaggacgaggaaagagauauuccugagaggagcuggaacucuggauacgaguggaucacggacuuucccggcaaaacugugugguucgucccaucaauuaaguccggcaaugauaucgcuaacugucugcgcaagaaugggaaacgagugauacagcuuaguagaaagacauuugacaccgaauaucaaaaaaccaagaacaacgauugggacuacguugugacuacagacauuagcgagaugggagcgaauuuccgggccgauagggucaucgacccucgccguugccuaaaacccgugauccugaaggaugguccagaaagaguaauuuuggcaggcccgaugccugugaccguugcuucggccgcacagcggagggggcgcaucggacgaaaccauaauaaggagggcgaccaguacauuuauaugggucagcccuuaaacaaugaugaggaccacgcccacuggacagaagcuaaaaugcugcucgauaacauaaauacuccagaggggaucauucccgcccuguuugaaccugagagagaaaagucugcggcaaucgacggcgaguaccggcuuaggggagaggcccgcaaaacguucgucgaacugaugagaaggggcgaucucccagugugguuguccuauaagguggcuagcgagggguuccaauacucagaccggcguuggugcuuugauggagaacgcaacaaucagguccuggaggaaaacauggacguugagaucuggaccaaagagggugaacgaaagaaacuaagacccagguggcuggaugcccggacauauagugacccucucgcucuucgcgaguucaaggaauuugcagccggcagaaggucuguguccggggaccugauuuuagagauaggaaaguugccgcagcaucugacucagcgggcucaaaaugcccucgauaaccugguaaugcuucacaauagcgaacagggcggucgagcauacagacaugcgauggaggagcugccagacaccaucgaaacacucauguugcuggccuuaauugcugugcuaaccgggggcgucacucuguucuuucucucaggacgcggccuugggaaaacgaguaucggacuguugugugugauggccagcuccguucugcucuggauggcaucuguggagccccacuggauugcugccagcaucauacuggaauucuuucuuaugguccuccugaucccugagcccgauaggcagcggaccccacaggacaaccaauuggcauauguagugauuggucuguuauucaucauucuaacaguugccgcuaaugagaugggccugcucgaaacuaccaagaaagaucuugggaucggacacguggcggucgagaaccaucaccaugccacaaugcuggacguggauuugcacccugcauccgcuuggacccuguacgccgucgccacuacaauaauuacgcccaugaugcgucauaccaucgaaaacacuacagcaaauauuucacucaccgcuaucgccaaccaggcggcuauacugaugggccuugacaaggguuggccaaucucuaaaauggauauuggggugccuuuacuggcccucggcugcuacagucagguuaauccguugacccugacagcagccgugcuaaugcugguagcucacuaugcaaucauuggacccggccuccaagccaaggcgacuagagaggcucagaagaggacggccgcagggaucaugaaaaacccaaccguggacggaauagucgccauugaucuugacccuguuguguacgaugcuaaguuugaaaaacagcugggccagaucauguugcugauccucuguacaucgcaaauucuguuaaugcgcacuaccugggcccuuugcgagagcaucacacuggcaaccgguccccucacuacgcuaugggagggguccccaggaaaguucuggaauacaaccauagcugucucuauggccaacauuuuucggggcucauaucuggcgggugccggcuuggcauucagccugaugaaaucccucgggggaggccgaagagggacuggagcucagggcgaaacccuuggugagaaguggaagaggcagcugaaucaguugaguaaaucugaauuuaacaucuacaagcgcagcgggauuauggagguggaccggucagaagccaaagagggacugaagagaggcgagacaacucgucacgcaguauccagggguaccgcuaaacuccggugguucguggaacgcaauuuaguuaagccugagggcaaggugaucgaccugggguguggacgaggcggguggaguuauuacugcgccggacuuaaaaaggucacagaagugaaaggcuauacgaagggugggcccggacaugaggaaccgauaccaauggccaccuacggcuggaaccuggucaaacuacacagcggcaaggauguguucuuuacuccucccgagaaaugugacacacuccugugcgauaucggggagucuuccccaaaucccaccauugaagagggaagaacuuugaggguucugaagaugguagaaccuuggcuccgggguaaccaauucuguaucaagauucuuaauccguacaugcccucaguggucgagacacuggagcagaugcagcgcaaacauggcgggauguuagugagaaacccacugagcaggaauucgacccacgaaauguauuggguuucuugcggaacgggcaacaucgugagugcggucaauaugaccucccgaauguugcucaaccgguuuacaauggcucaccguaagccuacuuacgagagagacguggaucugggugcagggacccgccauguagccguggaacccgagguugcuaaccuagacauuaucggacagaggauagaaaauauuaaacacgagcauaagagcacauggcacuaugaugaggacaacccuuacaaaacuugggccuaucauggcucauacgaagucaagccauccggcucugcaagcaguauggugaaugggguggucaagcuucugaccaaacccugggauguuaucccuauggugacacaaaucgccaugaccgacacuacgccauucggacagcagcggguauuuaaggagaaaguggauacaagaacccccaaggcuaaacgcgguacugcgcaaauuauggaagucaccgccagguggcucuggggcuuccugucccgaaacaagaagccgcggauauguacaagagaggaauuuacgaggaaagugcgcagcaaugcagcuaucggggccguuuucguggacgagaaccaguggaauucugcaaaggaggccgucgaagacgagcguuuuugggauuuggugcagaaagaacgggagcugcacaagcagggaaaaugcgcuaccugcguauauaacaugaugggcaagagagaaaagaaacucggugaguucgggaaggccaaaggaucaagggcgauuugguacauguggcuuggcgcacgcuuucuggaguucgaagccuuaggcuuuaugaaugaggaccacugguucagucgagaaaacucccugagcgggguugagggagaggguuugcauaagcucggcuacauccugcgggauauuucuaaaaucccugggggaaauauguaugcugacgauacugccggcugggacacaagaauaaccgaagaugaccuacaaaacgaggcaaagaucacugauauuauggaaccagagcacgcucuucuggccacaucgaucuucaaacucaccuaccagaauaagguggucagggugcagcgccccgcuaagaacgguacagugauggacgucauuucaagacgggaucagagggggagcggacaaguuggcacuuauggccugaauaccuuuacgaacauggaagcccaguugauccgucagauggaguccgaggggauauucuuaccuagugaacuggagaccccaaaccucgcagaacgagugcuugacuggcuggagaaauacggaguagaacgccuaaagagaauggcgauuucuggugaugacuguguggucaaacccaucgacgaucgguuugccacagcucugacugcccucaaugacaugggcaaggugaggaaagauaucccgcagugggagccuagcaagggguggaacgacuggcaacagguucccuucugcucccaucacuuucaccaguugauuaugaaggauggacgcgagauaguggucccauguagaaaucaggacgaacuggugggccgggcaaggguaucacaaggugcuggguggagucuucgagagaccgccugccugggaaaaucuuaugcacagauguggcagcucauguacuuccaucguagagauuuacgccuggccgcgaacgcuaucuguagcgccguuccuguggacuggguccccacaucccggacuaccuggucaauucacgcacaucaccaauggaugacgacagaagauauguugagcguguggaauaggguuuggaucgaggaaaacccauggauggaggacaagacccaugugucuuccuggggcgauguccccuaucugggcaaaagagaggaccaguggugcgggagucucauuggacuuacugcccgcgcuacaugggccagcaauauccagguggcaauaaaccagguacggaggcugaucgguaaugaaaacuaccuagacuacaugaccucgaugaagcgauuuaaaaaugagggcgauccugaaggggcucugugguga

SEQ ID NO: 13816 - RNA, 9879 nt, Artificial Sequence
  derived and/or modified CDS sequence (opt3) from DENV-1__FJ882569__SS-prME
agcgugaccaugcugcucaugcuuaugcccaccgcacuggcuuuccacuugacuacgagaggaggggaaccucauaugaucgucaccaagcaggaaagaggaaaauccuuacuguuuaagacaucugccgguguuaacaugugcacucugauugccauggaccucggagaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaggagcuggccacugaacgaaggcauaauggccguggggguugugucgauccuacugucaucucuucucaaaaacgacgucccccuggccggaccuuugauugcuggcgguauguuaaucgcauguuaugugauuaguggguccagcgccgaucugucucucgagaaggcggcugagguaagcugggaagaggaagccgagcacuccggagcaucacauaauauccugguggaaguccaggacgauggcaccaugaaaauaaaggacgaggagcgagaugacacucuuacaauucuguugaaagccacccuacuggcuguuaguggcguguacccccucagcaucccagcaacgcuguucgugugguauuuuuggcaaaagaagaaacagcgcucugggguccuuugggauacuccuucacccccagaaguggagcgggccguuuuagacgauggaaucuacagaauuaugcagaggggucugcucggccguagccagguaggggugggagucuuccaagaaaacguguuccacaccauguggcacguuacacgcggcgcgguguugauguaucaggguaagcggcuggagccgaguugggcuagcgucaaaaaggaccucauauccuacgggggaggcuggagacugcagggcucuuggaauaccggggaggaagugcagguaaucgccgucgagccuggcaaaaaucccaagaaugugcaaacagcaccagguacuuuuaagacccccgaaggcgagguuggggccauugcucuugacuucaaaccuggaacgucgggcagcccaaucgugaacagggaagguaagauugucgggcuguacggaaauggcgugguuacaacuucaggcaccuauguguccgccaucgcacaggcuaaagccagucaggaggggcccuugccugagauagaagaugaggucuuucgaaagcggaaccuaacaaucauggaccugcauccgggaucugguaaaacccgcagauaccucccagcgauugugagggaagccaucaagcggaaguuacgaacucugauucuugcacccaccagaguaguggcuagcgagauggccgaagcucugaaaggcaugccuauccgcuaucaaacaacggcaguuaaguccgagcacacugggaaagagauagucgaucucaugugccaugccaccuucacaaugagguugcugucaccagugcgugugcccaauuacaacaugauuaucauggacgaagcccacuuuaccgauccuucuagcaucgcugcgcggggauauauuaguacuagagucggcaugggugaggcagccgcuaucuucaugacagccaccccgcccggguccguagaagcauuuccacagagcaaugccgugauacaggacgaggaaagggauauuccugagcgcucuuggaacucaggauacgaguggaucacggacuuccccggcaagacuguuugguuugugccauccauuaaaaguggcaaugauaucgcuaacugucuccgaaagaaugggaagagagucauacagcugagccggaaaacauucgacaccgaauaucaaaagaccaaaaacaacgauugggacuacgugguuacuacagacauuucggagaugggagcgaauuuuagggccgaucgcgugaucgacccucguagaugccuuaagcccgucauccuaaaagaugguccagaacgggugauucuggcaggcccgaugccuguaaccguggcuucugccgcacagaggcgcgggcgaaucggaagaaaccauaauaaggagggcgaccaguacauuuauaugggucagcccuugaacaaugaugaggaccacgcccacuggacagaagcuaagauguuacuggauaacauaaauacuccagaggggaucauucccgcccucuucgaaccugagcgggaaaaauccgcggcaaucgacggcgaguacaggcugcgcggagaggccagaaagacguucguugaacuuaugaggcggggcgaucugccagucuggcucagcuauaaaguggcuucagagggguuucaauacagugaccgucgcuggugcuucgauggagaacgaaacaaucagguguuggaggaaaacauggacgucgagaucuggaccaaggagggugaaaggaaaaagcugaggccccgguggcuagaugcccgcacauauucugacccucuggcucucagagaguuuaaagaguucgcagccggcaggcgguccguuagcggggaccuuauucuggagauaggaaaguuaccgcagcauuugacucagcgagcucaaaaugcccuggauaaccucgugaugcugcacaauucagaacagggcgguagagcauaccgccaugcgauggaggagcuuccagacaccaucgaaacacugaugcucuuggcccugauugcuguauuaaccgggggcgugacucuauuuuuccugaguggaaggggccucgggaagacgagcaucggacuucugugugucauggccuccucuguguugcuguggauggcaagcguugagccccacuggauugcugccuccaucauacucgaauuuuuccugauggugcuucucaucccugagcccgaucggcagcguaccccacaggacaaccaacuggcauaugucguaauugguuugcuguuuaugaucuuaacaguggccgcuaaugagaugggccuacuggaaacuaccaaaaaggaucucgggauuggacacguugcgguggagaaccaucaccaugccacaaugcuugacgucgaucugcacccugcaucagcuuggaccuuguacgccguggccacuacaaucauaacgcccaugaugagacauaccauugaaaacacuacagcaaauaucucucugaccgcuauugccaaccaggcggcuauccucaugggccuggacaaagguuggccaauaaguaagauggauaucggggucccucuuuuagcccugggcugcuacagccaggugaauccgcucaccuugacagcagccguucugaugcuaguggcucacuaugcaauuaucggacccggccugcaagccaaagcgacuagggaggcucagaagcgcacggccgcagggauuaugaagaacccaaccguagacggaaucguggccauagaucucgacccugucguuuacgaugcuaaauucgaaaagcagcuuggccagauuaugcuguugauccuguguacaagccaaauccuccugaugcggacuaccugggccuuaugcgaguccauuacacuugcaaccgguccccugacuacgcucugggaggggucuccaggaaaauuuuggaauacaaccaucgcugugucaauggccaacauauuccgaggcagcuaucuagcgggugccggccuggcauuuuccuugaugaagagucuagggggaggcagaagggggacuggagcucagggcgaaacccucggugagaaauggaagcgccagcuuaaucagcugucuaagagcgaguucaacauuuacaaacggucagggaucauggaggucgacagauccgaagccaaggagggauugaaacguggcgagacaacuaggcacgcagugagucgggguaccgcuaagcugcgcugguucguagaacgaaaucucgugaaaccugagggcaagguuauugacuuaggguguggaagaggcggguggagcuauuacugcgccggacugaagaaagugacagaagucaagggcuauacgaaaggugggcccggacaugaggaaccgaucccaauggccaccuacggcuggaaccuugugaagcugcacucuggcaaagaugucuuuuucacuccucccgagaagugugacacacuacucugcgauauaggggaguccucaccaaaucccaccaucgaagagggaaggacucugcggguguugaaaaugguugaaccuuggcugcgcgguaaccaauuuuguauuaagauccucaauccguacaugcccagcguaguggagacacuugagcagaugcagagaaagcauggcgggaugcuggucaggaacccauuaucgcgaaauucuacccacgaaauguauugggugaguugcggaacgggcaacauuguuuccgcggugaauaugaccagccggaugcuguugaaccguuucacaauggcucacagaaaaccuacuuacgagcgcgacgucgaucucggugcagggaccaggcauguggccguagaacccgagguggcuaaccuggacaucauuggacagcggaucgaaaauauaaagcacgagcauaaaucaacauggcacuaugaugaggacaacccuuacaagacuugggccuaucauggcuccuacgaaguuaaaccaucuggcagcgcaaguuccauggucaaugggguggugaagcuacuuaccaagcccugggaugucauuccuaugguuacacaaaucgccaugaccgacacuacgccauuuggacagcagagaguguucaaagagaagguagauacacgcacccccaaagcuaagagggguacugcgcaaaucauggaagugaccgcccgauggcuguggggcuuucucagccggaacaaaaagccgagaauuuguacaagggaggaguucacgcgcaagguccguucuaaugcagcuauaggggccguguuuguugacgagaaccaguggaacucagcaaaagaggccguggaagacgagcgguucugggaucugguccagaaggaaagagaguugcacaaacagggaaagugcgcuaccugcguguauaacaugaugggcaaaagggaaaagaagcugggugaguuugggaaagccaagggaagucgcgcgaucugguacauguggcucggcgcacgauuccuugaguuugaagcccugggcuucaugaaugaggaccacugguucucccgggaaaacagcuuaucugggguagagggagagggucugcauaaauugggcuacauucucagagauaucucgaagauuccugggggaaauauguaugcugacgauacugccggcugggacacaaggaucaccgaagaugaccugcaaaacgaggcaaaaauaacugauaucauggaaccagagcacgcucuacuugccacaucaauuuuuaagcugaccuaccagaauaaaguugugcgcguccagagacccgcuaagaacgguacagugauggacgugaucagccggagggaucagcguggguccggacaagucggcacuuauggccucaauaccuucacgaacauggaagcccagcugauucgacagauggagagugaggggaucuuuuugccuucugaauuagagaccccaaaccuggcagaacgcguucucgacuggcuugagaaguacggaguggaaagacugaaacggauggcgauaagcggugaugacuguguagugaagcccauugacgauagguucgccacagcucuaacugcccugaaugacaugggcaaaguccgcaaggauaucccgcagugggagccuuccaaaggguggaacgacuggcaacaggugcccuuuugcucacaucacuuccaccagcucaucaugaaggauggaagagagauuguugugccaugucggaaucaggacgaauuggucggcagggcacgagugagucaaggugcuggguggucucugcgugagaccgccugccuuggaaagagcuaugcacagauguggcagcugauguacuuucauagacgcgaucuccgguuagccgcgaacgcuauauguuccgccguaccuguugacugggugcccacaucaaggacuaccuggagcauccacgcacaucaccaauggaugacgacagaagauaugcugucugucuggaauagaguguggauugaggaaaacccauggauggaggacaaaacccauguuuccaguuggggcgaugugcccuauuugggcaagcgcgaggaccaguggugcgggagccugaucggacucacugcccgggcuacaugggccucgaauauucaggucgcaaucaaccaggugaggcgacuuauagguaaugaaaacuaccuggacuacaugaccuccaugaaaagauucaagaaugagggcgauccugaaggggcucuaugguga

SEQ ID NO: 13817 - RNA, 9879 nt, Artificial Sequence
  derived and/or modified CDS sequence (opt3) from DENV-1__GQ199833__SS-prME
agcgugaccaugcugcucaugcuuaugcccaccgcacuggcuuuccacuugacuacgcggggcggggagccucauaugaucgucaccaagcaggaaaggggaaaguccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagaccguaggaguguggcccuugcaccccaugucggccuggguuuggagaccaggacagaaacuuggaugagcuccgagggggccuggaagcagauccagcggguggaaaccugggcucuccgccacccuggauucacaguuauugcacuguuucuggcccaugcuaucggcaccucuauuacgcagaaaggcaucauauucauccucuuaaugcuggugacuccaucgauggccaugagaugcgucgggauuggaucaagggauuuuguggagggucuuagcggcgcgacauggguagacguuguguuggagcacgggaguugugucaccacuauggcaaaggauaagcccacacuggacaucgaacuacucaaaaccgaggugacgaacccugccgugcugcggaaacuuugcauugaagcuaaaaucuccaauaccacaacugauucucgcuguccaacccaaggagaggccacacugauggaggaacaggacgcaaacuucgucugccgaagaacuuuuguugauaggggcugggguaauggguguggauuguucggcaagggcagccucauaaccugcgcuaaauuuaagugcgugacaaagcuggaggggaaaauuguacaguacgaaaacuuaaaguauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccacggacaggacuggacuucaacgaaaugguguugcuaacgaugaaaggcaagucuuggcugguccauaaacagugguuucucgaucugccgcuucccuggaccuccggugcaucaacuagccaagagacauggaaucgucaggaccuguuggugaccuucaagacagcucacgccaaaaagcaggagguaguugugcucgggagucaagaaggcgcuaugcacacugcccugaccggagcaacggagauccagaccucuggcacaacuaccauuuuugccgggcauuuaaagugccgccugaaaauggauaagcuaacacucaaaggaauguccuaugucauguguacugguagcuucaagcuggaaaaagagguggcugaaacccagcacggcacgguccuugugcagauaaaguacgaggggacagacgcgccuugcaagaucccauucucgacccaagaugagaaaggaguuacucagaacggcagauugauuacagcaaaucccaucgugaccgacaaggaaaaaccuguaaacauagaggccgaaccacccuuuggugagucuuauauugucaucggggcuggcgagaaggcccugaaacucuccugguucaagaagggaucaaguaucggcaaaauguuugaagcaacugccagaggggcucggcgaauggccauucugggagauaccgcaugggacuucgguagcaucggcgggguguuuacauccguuggaaaacuugugcaucagauuuucggcacggcguacgguguccuguuuucuggggugagcuggaccaugaaaauaggcaucggaguauugcucacuuggcugggcuuaaauucacgcaguacaucccugagcaugaccuguauugcuguggggcuaguuacacucuaccugggagucauggugcaggccgauucuggcugcgugaucaacuggaaggguagagagcuuaaaugugggucaggaaucuucgucacuaaugaaguucacaccuggacggagcaauauaaguuucaggcagacaguccgaagagguugagcgccgcuauuggcaaagccugggaagagggugugugcggcauacgguccgcaacacgccuggagaacaucauguggaagcagauuucuaacgaacucaaucauauccuguuagagaacgggaugaaauucaccgugguagucggagacgugguuggcauucuggcucaggggaagaaaaugaucagaccucaacccauggaacacaaguacucguggaaaagcuggggaaaggccaagauaaucggcgcggaugugcagaauacuaccuuuauuaucgacgguccaaacacaccugagugucccgaugaccagagggccuggaauauuugggaagucgaggauuauggguucggaaucuuuacuaccaacauauggcuuaaauugcgugacuccuacacacaggugugcgaucaccggcucaugucagcugcaauuaaggacaguaaagccguucaugcugauaugggcuauuggaucgagucugaaaagaaugagacguggaaacuggcccgagcaucguucauugaagugaagaccuguaucuggccaaagucccacacucuauggucaaacgguguacuggagagcgaaaugauaauccccaaaauuuacggcgggccuaucucucaacauaauuauagaccaggauacuucacacagaccgcgggcccguggcaccucgggaagcuggagcuugacuuugauuugugcgagggaacuacagucgugguggacgaacacugcggcaacaggggucccucccugcgcaccacgacugucaccgggaaaauuauccaugagugguguugccggaguuguacauuaccuccacucagauucaagggagaagauggcugcugguacgguauggagauaaggcccguuaaagagaaggaagagaaucuggugaaguccaugguaucugccggcuccggggaaguggacucauuuagucuuggacuguuguguauuagcaucaugaucgaggaagucaugcgcucgcgauggucccggaaaaugcucaugaccggcacucuggcuguguuccuacugcucauuauggggcagcugacauggaacgaccuuauccguuugugcauuaugguuggagccaaugcaucugauagaaugggcauggguaccacauaucuggcuuuaauggccacuuuuaagaugaggccuauguucgcaguggggcuccuguuucgccggcuuaccagcagagagguccugcuacucacgauaggacugucauugguggccaguguugagcugccaaacuccuuagaggaacucggcgacggccuggcuauggggaucaugauucuuaaacuguugacagauuuccaaucucaccagcucugggcgacccugcuaagccugacuuuuaucaagaccacacuuucccuccauuacgccuggaaaacuauggcaauggugcugucaauugucagcuuguucccccuguguuuaaguaccacgucucagaagacaaccuggcucccgguacugcuuggaucccuggguugcaagccuuugacuauguuucucaucgcugaaaauaaaauauggggcagaaagagcuggccacugaacgaggggaucauggccgugggaguugugucgauucuacugucaucucuucucaaaaacgacgucccccuggccggcccuuugaucgcuggugggauguuaauugcauguuaugugaucaguggauccagcgccgaucugucucucgaaaaggcggcugagguaagcugggaggaagaggccgaacacuccggcgcaucacauaauauacugguggagguccaggacgauggcacaaugaaaauuaaggacgaggaacgagaugacacccuuacuauccuguugaaagccacacuacuggcuguuagugggguguacccccucagcaucccagcaacccuguucgugugguauuuuuggcaaaagaagaaacagcgcucuggaguccuuugggauacgccuucacccccagagguggaacgggccguuuuagacgaugguauuuacagaauaaugcagaggggccugcucgggcguagccagguaggagugggcgucuuccaagagaacguguuccacacuauguggcacguuacccgcggugcgguguugauguaucaggggaagcggcuggaaccgaguugggcuagcgucaaaaaggaccucaucuccuacggaggcggcuggagacugcaggggucuuggaauacaggagaggaggugcagguaauugccgucgaaccugguaaaaaccccaagaaugugcaaaccgcaccaggcacauuuaagacucccgagggggaaguuggagccaucgcucuugacuucaaaccuggcaccucggguagcccaauugugaacagggaggggaagaucgucggacuguacggcaauggcgugguuacgacaucagggacuuauguguccgccauagcacaggcuaaagccagucaggaaggacccuugccugagaucgaggaugaagucuuucgaaagcggaaccuaaccauuauggaccugcauccggguucuggcaaaacacgcagauaccucccagcgaucgugagggaggccauuaagcggaaguuacgaacccugauccuugcacccacuagaguaguggcuagcgaaauggccgaggcucugaaagggaugccuauacgcuaucaaaccacagcaguuaaguccgaacacacgggaaaagagauugucgaucucaugugccaugccacuuucaccaugagguugcugucaccagugcgugugcccaauuacaacaugaucaucauggacgaggcccacuuuacagauccuucuagcauugcugcgcggggcuauaucaguaccagagucgguaugggggaagcagccgcuauauucaugacugccacaccgcccggauccguagaggcauuuccacagagcaaugccgugauucaggacgaagagagggauaucccugaacgcucuuggaacucaggcuacgaguggauuaccgacuuccccggcaagacgguuugguuugugccauccaucaaaagugggaaugauauagcuaacugucuccgaaagaauggaaagagagucauucagcugagccggaaaacuuucgacacagaguaucaaaagaccaaaaacaacgauugggacuacgugguuaccacugacaucucggaaaugggugcgaauuuuagggccgaucgcgugaucgacccucguagaugccuuaagcccgucauucuaaaagauggcccagagcgggugauccuggcagggccgaugccuguaacaguggcuucugccgcacagaggcgcggacgaauuggcagaaaccauaauaaggaaggugaccaguacauauauauggggcagcccuugaacaaugaugaggaccacgcccacuggaccgaggcuaagauguuacuggauaacaucaauacaccagaaggcauuauccccgcccucuucgagccugaacgggagaaauccgcggcaaucgacggagaauacaggcugcgcggcgaggccagaaagacuuucguugagcuuaugaggagaggggaucugccagucuggcucagcuauaaaguggcuucagaaggauuucaauacagugaccgucgcuggugcuucgauggugagcgaaacaaucagguguuggaagagaacauggacgucgaaauuuggacgaaggagggcgagaggaagaagcugaggccccgguggcuagaugcccgcaccuauucugacccucuggcucucagagaauuuaaagaguucgcagccgggaggcgguccguuagcggagaccuuauacuggaaaucggcaaguuaccgcagcauuugacacagcgagcucaaaaugcccuggauaaccucgugaugcugcacaauucagagcagggugggagagcauaccgccaugcgauggaggaacuuccagacacuauugagacccugaugcucuuggcccugaucgcuguauuaacaggcggagugacccuauuuuuccugaguggcagggggcucggaaagacuagcauuggucuucugugugucauggccuccucuguguugcuguggauggcaagcguugaaccccacuggaucgcugccuccauaauccucgaguuuuuccugauggugcuucucauuccugaacccgaucggcagcguacgccacaggacaaccaacuggcauaugucguaaucggcuugcuguuuaugauuuuaaccguggccgcuaaugagauggggcuacuggagacaacuaaaaaggaucucggaaucggccacguugcgguggaaaaccaucaccaugccaccaugcuugacgucgaucugcacccugcaucagcuuggacauuguacgccguggccaccacuauaauuacacccaugaugagacauacgaucgagaacaccacugcaaauauuucucugacagcuaucgccaaccaggcggcuauacucaugggucuggacaaaggguggccaaucaguaagauggauauuggcgucccucuuuuagcccugggaugcuacagccaggugaauccgcucaccuugaccgcagccguucugaugcuaguggcucacuaugcaaucauuggccccgggcugcaagccaaagcgacaagggaagcucagaagcgcacugccgcaggaaucaugaagaacccaacgguagacggcauaguggccauugaucucgacccugucguuuacgaugcuaaauucgagaagcagcuuggucagaucaugcuguugauccuguguaccagccaaauucuccugaugcggacaacuugggccuuaugcgaauccaucacccuugcaacagggccccugaccacucucugggagggaucuccaggcaaauuuuggaauacgacaauagcugugucaauggccaacauuuuccgagguagcuaucuagcgggcgccgggcuggcauuuuccuugaugaagagucugggaggcgggagaaggggaaccggcgcucagggugagacucucggggaaaaauggaagcgccagcuuaaucagcugucuaagagcgaguucaacaucuacaaacggucaggaauuauggaagucgacagauccgaggccaaggaaggcuugaaacguggugagaccacaaggcacgcagugagucggggcacugcuaagcugcgcugguucguagagcgaaaucucgugaaaccugaagggaagguuaucgacuuaggauguggcagagggggauggagcuauuacugcgccggccugaagaaagugaccgaggucaaggguuauacaaaagggggacccggccaugaggaaccgauaccaauggccacguacggcuggaaccuugugaagcugcacucugggaaagaugucuuuuucaccccucccgaaaagugugacacucuacucugcgauaucggagaguccucaccaaaucccacaauugaggaagguaggacccugcggguguugaaaaugguugagccuuggcugcgcggcaaccaauuuuguaucaagauucucaauccguacaugcccagcguaguggaaacucuugagcagaugcagagaaagcaugggggaaugcuggucaggaacccauuaucgcgaaauucuacacacgagauguauugggugaguugcggcaccgguaacaucguuuccgcggugaauaugacgagccggaugcuguugaaccguuucaccauggcucacagaaaaccuacauacgaacgcgacgucgaucucggggcaggaacuaggcauguggccguagagcccgaaguggcuaaccuggacauuaucggccagcggauagagaauauuaagcacgaacauaaaucaaccuggcacuaugaugaggacaacccuuacaagacaugggccuaucauggcuccuacgagguuaaaccaucugggagcgcaaguuccauggucaauggaguggugaagcuacuuacuaagcccugggaugucaucccuaugguuacccaaaucgccaugacagacaccacuccauuuggucagcagagaguguucaaagaaaagguagauacgcgcacacccaaagcuaagaggggcaccgcgcaaauuauggaggugacugcccgauggcuguggggguuucucagccggaacaaaaagccgagaauauguaccagggaagaguucacacgcaagguccguucuaaugcagcuaucggagccguguuuguugacgaaaaccaguggaacucagcaaaagaggccguggaggacgaacgguucugggaucugguccagaaggagagagaauugcacaaacagggcaagugcgcuacgugcguguauaacaugauggguaaaagggagaagaagcugggggaauuuggaaaagccaagggcagucgcgcgauuugguacauguggcucggcgcacgauuccuugaguuugaggcccugggguucaugaaugaagaccacugguucucccgggagaacagcuuaucuggaguagaaggugagggccugcauaaauugggguacauccucagagauauuucgaagaucccuggaggcaauauguaugcugacgauaccgccgguugggacacuaggauaacagaggaugaccugcaaaacgaagcaaaaaucaccgauauuauggagccagaacacgcucuacuugccacuucaaucuuuaagcugacauaccagaauaaaguugugcgcguccagagacccgcuaagaacgggaccgugauggacgugauuagccggagggaucagcguggauccggccaagucggcacauaugggcucaauacuuucaccaacauggaggcccagcugauccgacagauggaaagugagggaauauuuuugccuucugaguuagaaacgccaaaccuggcagagcgcguucucgacuggcuugaaaaguacgguguggagagacugaaacggauggcgauuagcggcgaugacuguguagugaagcccaucgacgauagguucgccaccgcucuaacagcccugaaugacauggggaaaguccgcaaggauaucccgcagugggaaccuuccaaaggauggaacgacuggcaacaggugcccuuuugcucacaucacuuccaccagcucauuaugaaggauggcagagagauaguugugccaugucggaaucaggacgaguuggucgguagggcacgagugagucaaggggcuggauggucucugcgugaaacugccugccuuggcaagagcuaugcacagauguggcagcugauguacuuucauagacgcgaucuccgguuagccgcgaacgcuaucuguuccgccguaccuguugacugggugcccaccucaaggacaacuuggagcauucacgcacaucaccaauggaugaccacggaggauaugcugucugucuggaauagaguguggaucgaagagaacccauggauggaagacaaaacacauguuuccaguuggggcgaugugcccuauuuggggaagcgcgaggaccaguggugcggaagccugauuggucucaccgcccgggcuacuugggccucgaauauccaggucgcaauaaaccaggugaggcgacuuaucggcaaugagaacuaccuggacuacaugacauccaugaaaagauucaagaaugaaggggauccugagggagcucuaugguga

SEQ ID NO: 13818 - RNA, 9879 nt, Artificial Sequence
  derived and/or modified CDS sequence (opt3) from DENV-1__FJ882570__SS-prME
agcgugaccaugcugcucaugcuuaugcccaccgcccuggcuuuccacuugacuacgaggggaggggagccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagggauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugggaagggaguuacucagaacggccgcuugauuacagcaaaucccaucgugaccgacaaagaaaagccuguaaacauagaggccgaaccacccuuuggugagucuuauauugucaucggggcuggcgagaaagcccugaagcucuccugguucaagaaaggaucaaguaucggcaagauguuugaagcaacugccagaggggcuaggcggauggccauucugggagauaccgcaugggacuucgguagcaucggcgggguguuuacauccguuggaaaacuugugcaucagauuuucggcacggcguacgguguccuguuuucuggggugagcuggaccaugaagauaggcaucggaguauugcucacuuggcugggcuuaaauucacgaaguacaucccugagcaugaccuguauugcuguggggcuaguuacacucuaccugggagucauggugcaggccgauucuggcugcgugaucaacuggaaaggucgcgagcuuaagugugggucaggaaucuucgucacuaaugaaguucacaccuggacggagcaauauaaguuucaggcagacaguccgaaaagauugagcgccgcuauuggcaaggccugggaagagggugugugcggcauaagguccgcaacacggcuggagaacaucauguggaaacagauuucuaacgaacucaaucauauccuguuagagaacgggaugaaguucaccgugguagucggagacgugguuggcauucuggcucaggggaaaaagaugauccgcccucaacccauggaacacaaauacucguggaaaagcuggggaaaggccaaaauaaucggcgcggaugugcagaauacuaccuuuauuaucgacgguccaaacacaccugagugucccgaugaccagagagccuggaauauuugggaagucgaggauuauggguucggaaucuuuacuaccaacauauggcuuaaguugagggacuccuacacacaggugugcgaucaccgucucaugucagcugcaauuaaagacaguaaggccguucaugcugauaugggcuauuggaucgagucugagaagaaugagacguggaagcuggcccgggcauccuucauugaagugaagaccuguaucuggccaaaaucccacacucuauggucaaacgguguacuggagagcgaaaugauaauccccaagauuuacggcgggccuaucucucaacauaauuaucgaccaggauacuucacacagaccgcgggcccguggcaccucgggaaacuggagcuugacuuugauuugugcgagggaacuacagucgugguggacgaacacugcggcaacagaggucccucccugaggaccacgacugucaccgggaagauuauccaugagugguguugccgcaguuguacauuaccuccacuccgguucaaaggagaagauggcugcugguacgguauggagauaagacccguuaaggagaaggaagagaaucuggugaaaagcaugguaucugccggcuccggggaaguggacucauuuagucuuggacuguuguguaccagcauuaugaucgaggaagucaugaggucgcgcuggucccgaaagaugcucaugacuggcacacuggcuguguuccuacugcucaucauggggcagcugaccuggaacgaccuuauucgguugugcaucaugguuggagccaaugcaucugaucguaugggcauggguacaacuuaucuggcuuuaauggccaccuuuaaaaugagaccuauguucgcaguggggcuccuguuuaggcgccuuacgagccgggagguccugcuacucacaauuggacugucauugguggccaguguugagcugccaaacuccuuagaagaacucggcgacggccuggcuauggggauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuuggaucccuggguugcaaaccuuugacaauguuucucauugcugaaaauaagaucuggggcagaaaaagcuggccacugaacgaggggauaauggccgugggaguugugucgauccuacugucaucucuucucaagaacgacgucccccuggccggcccuuugauugcuggugggauguuaaucgcauguuaugugauuaguggauccagcgccgaucugucucucgaaaaagcggcugagguaagcugggaggaagaggccgaacacuccggcgcaucacauaauaucuucguggagguccaggacgauggcaccaugaagauaaaagacgaagagagggaugacacucugacaauucuucugaaggccaccuugcuagcuguuagugggguguacccccugagcaucccagcaacgcucuuugugugguauuucuggcaaaagaaaaagcagcgaucuggaguccugugggauacuccuucacccccagagguggaacgcgccgcgcuugacgaugguaucuaccggauuaugcagagaggcuuacuggggaggagccagguuggaguaggcguguuccaagagaacgucuuucacaccauguggcacgugacacguggugcuguucucauguaucaggggaaacgcuuggaaccgaguugggccagcgugaagaaagaccugauauccuacggaggcggcuggcggcuccaggggucuuggaauaccggagaggagguccaggugaucgcaguagaaccugguaagaaccccaagaauguccaaacagccccaggcacuuucaaaacccccgagggggaagugggagcuauugcccuggacuuuaagccuggcacgucggguagcccaaucguuaacagagaggggaaaauugugggacuuuacggcaauggcgucgugacaacuucagggaccuauguuuccgcaaucgcucaggccaaggcgagucaggaaggaccccugccugagauagaggaugaaguguucaggaaacgaaacuugacaaucauggaccuacauccggguucuggcaagacccggcgcuaccugccagccauugucagagaggcaaucaagaggaaacuccggacuuuaauucuggcucccacccgagugguagccagcgaaauggcugaggcacuuaaggggaugccuaucagauaucaaacaacggccgugaaauccgaacacacuggaaaggagauaguugaucugaugugccaugccaccuuuacaaugcgccucuugucaccagucagggugcccaauuacaacaugauuaucauggacgaggcucacuucaccgauccuucuagcaucgcggcacguggcuauauuaguacucggguggguaugggggaagccgcugccaucuuuaugacagcaaccccgcccggauccgucgaggccuucccacagagcaaugcuguaauacaggacgaagagagagauauuccugaaaggucuuggaacucaggcuacgaguggaucacggacuuucccggcaaaacugugugguucguuccauccauuaagagugggaaugauaucgcgaacugucugcgcaagaauggaaaacgagugauacagcucagcagaaagacauuugacaccgaguaucagaaaaccaagaacaacgauugggacuacgucgugacuacagacauuucggaaaugggugccaauuuccgggcagauaggguuaucgacccucgccguugccugaaacccgugauccuuaaggauggcccagagagagucauucuagcugggccgaugccugugaccguagccucugcagcccagcggaggggacgcaucggccgaaaccauaauaaggaaggugaccaguacauuuauauggggcagccccugaacaaugaugaggaccacgcucacuggacagaggccaaaauguuguuagauaacauaaauacuccagaaggcaucauucccgcgcuguucgagccugaaagagagaaguccgcagccaucgacggagaauaccggcucaggggcgaggcucgcaaaacguuuguggagcugaugagaagaggggaucuuccaguuuggcugagcuauaaggucgccucagaaggauuccaauacagugaccggcguuggugcuuugauggugagcgcaacaaucaggugcucgaagagaacauggacguggaaaucuggaccaaagagggcgagcgaaagaaauugagacccagguggcuggaugcucggacauauucugacccucuagcacugcgcgaguucaaggaguuugccgcugggagaagguccgucagcggagaccucauucuugaaauaggcaagcugccgcagcauuuaacucagcgggcccaaaaugcauuggauaaccugguuaugcuccacaauucagagcagggugggcgagcguacagacaugccauggaagaacugccagacaccaucgagacacuuaugcugcucgcuuugauugccgugcugaccggcggaguaacuuuauucuuucuaaguggccgcgggcugggaaaaacgagcaucggucuccuuugugugauggcauccucuguccuguuguggauggcuagcguggaaccccacuggauugccgcauccaucauacuggaguucuuucucaugguucugcuuaucccugaacccgauaggcagcggaccccacaggacaaccaacucgccuauguggucauuggccuguuguucaucauucugacaguagcugcgaaugagaugggguuacuagagacuaccaagaaagaucugggaaucggccacguggccguugaaaaccaucaccaugcaacaaugcucgacguggaucuucacccugcuucagccuggacccuguacgccgucgcaacuacaauaauuacgcccaugaugcgucauaccaucgagaacacuacagcuaauauuucuuugaccgccaucgcgaaccaggcugccauacugaugggucucgacaagggguggccaaucaguaaaauggauauuggcgugccucugcuugcauuaggaugcuacucgcaggucaauccgcugacccucacagccgcuguguugaugcugguugcacacuaugccaucauuggccccgggcuacaagcgaaggcuacuagagaagcccagaagaggacggcagccggaaucaugaaaaacccaaccguggacggcauaguagcuauugaucuggacccuguggucuacgaugccaaguuugagaaacagcucggucagaucaugcuucugaucuuguguacaagccaaauucugcucaugcgcacuaccugggcacugugcgaauccaucacauuagcuaccgggccccuuacuacgcugugggagggaucuccaggcaaguucuggaauacaaccauagccguuucaauggcgaacauuuuucgggguagcuaucucgccggcgcagggcuagcuuucucccugaugaaaaguuugggaggcgggcgaagaggaacuggcgcccagggugagacccugggggaaaaguggaagaggcagcucaaucagcuuucuaaaagcgaguucaacaucuacaagcgcucaggaauuauggaaguggaccgguccgaggcaaaagaaggccugaagagaggugagacaacucgucacgcugucaguaggggcaccgccaaauugcggugguuuguggagcgcaaucugguaaagccugaagggaaggugaucgaccucggauguggccgagggggauggagcuauuacugcgccggccuaaagaagguuacagaggugaaagguuauacgaaagggggacccggccaugaggaaccgauaccaauggcgaccuacggcuggaaccuggucaaacuucacucugggaaggauguguucuuuacuccucccgaaaaaugugacacacugcuaugcgauaucggagaguccucaccaaaucccaccauugaggaagguagaacucucaggguccugaagaugguggagccuugguugcggggcaaccaauucuguaucaagauucugaauccguacaugcccagcguuguagaaacacucgagcagaugcagcgcaaacaugggggaaugcuugugagaaacccacugucgagaaauucuacccacgagauguauugggucaguugcggcacggguaacaucguguccgcuguuaauaugaccagccgaauguuacugaaccgguuuacaauggcacaccguaagccuacuuacgaaagagacguggauuugggggccggaacccgccaugucgcuguggagcccgaaguagccaaccucgacauuaucggccagaggauagagaauauuaaacacgaacauaagucaacauggcacuaugaugaggacaacccuuacaaaacuugggcauaucauggcuccuacgaggugaagccaucugggagcgccaguuccaugguuaauggagucgugaagcugcuaaccaaacccugggaugugaucccuauggucacacaaaucgcuaugaccgacacuacgccauucggucagcagcggguuuuuaaggaaaaaguggauacaagaacccccaaggcgaaacgcggcacugcccaaauuauggagguaaccgcaagguggcuuuggggguuccugagccgaaacaagaagccgcggauauguacaagagaagaguuuacgaggaaagugcgcucuaaugcugccaucggagcagucuucguggacgaaaaccaguggaacucagccaaggaggcuguugaggacgaacguuuuugggaucucgugcagaaagagcgggaacugcacaagcagggcaaaugcgcaaccugcgucuauaacaugauggguaagagagagaagaaauugggggaguucggaaaggcgaaaggcaguagggcaauuugguacauguggcugggcgcccgcuuucucgaguucgaggcucuuggguucaugaaugaagaccacugguuuucccgagagaacagccugucuggaguggaaggugagggcuuacauaagcugggguacaucuugcgggauauuucgaaaaucccuggaggcaauauguaugccgacgauacugcagguugggacacaagaauaaccgaggaugaccuccaaaacgaagcuaagaucacugauauuauggagccagaacacgcccugcuagcuacaucaaucuucaaacuuaccuaccagaauaagguaguuagggugcagcgccccgccaagaacgggacagucauggacgugauuagcagacgggaucagaggggauccggccaagugggcacuuaugggcugaauaccuuuacgaacauggaggcacagcucauccgucagauggaaagugagggaauauuccugccuucugaguuggaaaccccaaacuuagcggagcgaguccuggacuggcucgaaaaauacgguguugagcgccuuaagagaauggccauuagcggcgaugacugugugguaaaacccaucgacgaucgguuugcuacagcccugacugcacuaaaugacauggggaaggugaggaaagauaucccgcagugggaaccuuccaagggauggaacgacuggcaacagguccccuucugcucacaucacuuucaccagcugauuaugaaggauggccgcgagauagugguuccauguagaaaucaggacgagcucgugggucgggcuagggucagucaaggggccggauggucuuugcgagaaaccgcaugccugggcaaaagcuaugcccagauguggcagcuuauguacuuccaucguagagaucugcgccucgcggcuaacgccaucuguuccgcagugccuguagacuggguucccacaucacggacuaccuggagcauucacgcccaucaccaauggaugacgacagaggauauguuaucuguguggaauagggucuggaucgaagagaacccauggauggaagacaagacccauguguccaguuggggcgauguucccuaucuggggaaaagagaggaccaguggugcggcagcuugauuggucugacugcucgcgccacaugggcaucgaauauccagguggcuauaaaccagguccggaggcucaucggcaaugagaacuaccuugacuacaugaccuccaugaagcgauuuaaaaaugaaggggauccugagggagcccugugguga

SEQ ID NO: 13819 - RNA, 9879 nt, Artificial Sequence
  derived and/or modified CDS sequence (opt3) from DENV-1__GQ199834__SS-prME
agcgugaccaugcugcucaugcuuaugcccaccgcccuggcuuuccacuugacuacgaggggaggggaaccucauaugaucgucaccaagcaggaaaggggaaaauccuuacuguuuaagacaucugcugguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaacuugcugagacccagcacgguacgguguugguccagauaaaguacgagggcacagacgcgccuugcaaaaucccauucucgacccaagaugaaaagggggugacucagaacggacgccugauuacagcaaaucccaucguuaccgacaaagagaagccugugaacauagaagccgagccacccuuuggcgagucuuauauuguaaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcgucuuuacauccguggggaaacugguucaucagauuuucggaacggcguacggcguguuguuuucuggugucagcuggaccaugaagauagggaucggcgugcuccugacuugguuaggacuaaauucacgaaguacaucccuaagcaugaccuguauugcuguaggccucgugacacuguaccuugggguuaugguccaggccgauucuggaugcgugaucaacuggaaaggccgcgaauugaagugugguucagggaucuucgugacuaaugagguccacaccuggacggaacaauauaaguuucaggcagacaguccgaaaagacugagcgccgcuauuggaaaggccugggaggagggcguuugcgguauaagguccgcaacacggcucgaaaacaucauguggaaacagauuucuaacgagcugaaucauaucuuacuggaaaacggcaugaaguucaccguggugguaggggacgucgauggcauucuugcucagggcaaaaagaugauccgcccucaacccauggagcacaaauacucguggaaaagcugggggaaggccaagauaaucggagcggacgugcagaauacuaccuuuauuaucgauggcccaaacacaccugaaugucccgacgaucagagagccuggaauauuugggagguugaggacuaugguuucgggaucuuuacuaccaacauaugguugaagcucagggauuccuacacacaggugugcgaccaccgucugaugucagcugcaauuaaagauaguaaggccguccaugcugacaugggauauuggaucgaaucugagaaaaaugaaacguggaagcuagcccgggcuuccuucauugaggugaagaccuguaucuggccaaaaucccacacucuguggucaaacggcguucucgaaagcgagaugauaauccccaagauuuacgguggcccuaucucucaacauaauuaucgaccaggguacuucacacagaccgcgggaccguggcaccugggcaaacuugaguuggauuuugaccugugcgaagggacuacagugguagucgaugagcacugcggaaacagaggccccuccuuaaggaccacgacugugaccgguaagauuauccaugaaugguguugccgcaguuguacacucccuccacugcgguucaaaggggaggacggaugcugguacggcauggagauaagacccgugaaggaaaaggaggaaaaucuugucaaaagcaugguuucugccgguuccggcgagguggacucauuuagucugggguugcucuguauuagcaucaugaucgaagagguaaugaggucgcgcuggucccgaaagaugcugaugaccggaacucuagcuguguuccugcuccugauuaugggccagcuuacauggaacgauuugauccggcugugcauuauggucggggccaaugcaucugaccguaugggaaugggcaccacauauuuagcucucauggccacuuuuaaaaugagaccuauguucgcagugggucugcuuuuuaggcgccugaccagccgggagguucuacuccugacgauaggguugucacugguggccagugucgaauuaccaaacucccucgaggaacugggagauggccuugcuaugggcaucaugauucugaaguugcucacagacuuccaaucucaccagcugugggcgacccuacugagccuuacuuuuaucaaaaccacacucucccugcauuacgccuggaagacuauggcaaugguguugucaauuguuagccuguuccccuuaugucucaguaccacgucucagaagacaaccuggcugccggugcuucugggguccuugggaugcaaaccucucacuauguuucugaucgcugagaauaagauaugggguagaaaaagcuggccacuaaacgaaggcaucauggccgucgggguagugucgauucugcuuucaucucuccugaagaacgauguucccuuggccggaccuuuaaucgcuggcgguaugcugauugcauguuaugugaucaguggguccagcgccgaccucucucuggagaaagcggcugaggucagcugggaagaggaagccgagcacuccggagcaucacauaauauacuuguggaaguacaggaugacggcacaaugaagauuaaagaugaggagagggacgauacccugacuaucuugcuaaaggccacacugcucgcugugaguggcgucuacccccugagcaucccagcaacccuuuucguuugguauuuuuggcaaaagaaaaagcagcgaucugggguguuaugggacacgccuucacccccagaaguggagcgcgccguccuggaugacggaauuuaccggauaaugcagagaggucucuugggcaggagccagguggggguuggaguauuccaagaaaacguguuccacacuauguggcacgucacccguggcgcggugcugauguaucaggguaaacgccucgagccgaguugggcuagcguuaagaaagaccugaucuccuacgggggaggcuggcggcuucagggcucuuggaauacaggggaggaagugcaggucauugccguggagccuggaaagaaccccaagaauguacaaaccgcaccagguacauuuaaaacucccgaaggcgaggucggggccaucgcucuggauuucaagccuggaaccucgggcagcccaauugugaacagagaagguaaaaucguuggguuguacggaaauggcguggucacgacaucaggcacuuauguguccgccauagcacaggcuaaggccagucaggaggggccccuaccugagaucgaagacgagguuuuuaggaaacgaaaccugaccauuauggaucuccauccgggaucugguaagacacggcgcuacuuaccagcgaucgugagagaagccauuaagaggaaacugcggacccuuauccuggcacccacucgagucguggcuagcgagauggccgaagcucucaagggcaugccuauaagauaucaaaccacagcaguaaaauccgagcacacggggaaggagauuguggacuugaugugccaugccacuuucaccaugcgccugcucucaccaguuaggguccccaauuacaacaugaucaucauggaugaagcccacuuuacagacccuucuagcauugcugcgcguggauauaucaguacccgggugggcaugggugaggcagccgcuauauucaugacugccacaccgcccggguccguggaagcauuuccacagagcaaugccgucauucaggaugaggaaagagacaucccugagaggucuuggaacucaggauacgaguggauuaccgauuuccccggcaaaacgguaugguuugugccauccaucaagaguggcaaugacauagcuaacugucugcgcaagaaugggaaacgaguuauucagcuuagcagaaagacuuucgauacagaauaucagaagaccaagaacaacgacugggacuacguggucaccacugauaucucggagaugggagcgaauuuucgggccgacagggugaucgauccucgccguugccuaaaacccguuauucugaaggacgguccagaaagagugaucuuggcaggcccgaugccugucacaguggcuucugccgcacagcggagggggcgcauuggacgaaaccauaauaaggagggcgaucaguacauauauaugggucagcccuuaaacaaugacgaggaucacgcccacuggaccgaagcuaaaaugcugcucgacaacaucaauacaccagaggggauuauccccgcccuguucgaaccugagagagaaaaguccgcggcaaucgauggcgaguaccggcuuaggggagaggcccgcaaaacuuucguagaacugaugagaaggggcgaccucccagugugguugagcuauaagguugcuucagagggguuucaauacagugaucggcguuggugcuucgacggagaacgcaacaaucagguccuggaggaaaacauggauguggagauuuggacgaaagagggugaacgaaagaaacuaagacccagguggcuggacgcccggaccuauucugacccucucgcacuucgcgaguuuaaggaguucgcagccggcagaagguccgugagcggggaucugauauuagagaucggaaaguugccgcagcaucugacacagcgggcucaaaaugcccucgacaaccuggucaugcuucacaauucagaacagggcggucgagcauacagacaugcgauggaggagcugccagauacuauugaaacccucauguugcuggccuuaaucgcuguucuaacagggggcgugacccuguuuuuccucaguggacgcggccuugggaaaacuagcauuggacuguuguguguaauggccuccucugugcugcucuggauggcaagcgucgagccccacuggaucgcugccuccauaauccuggaauuuuuccuuauggugcuccugauuccugagcccgacaggcagcggacgccacaggauaaccaauuggcauauguugugaucggucuguuauuuaugauucuaaccgucgccgcuaaugagaugggccugcucgaaacaacuaagaaagaccuugggaucggacacguagcgguggagaaccaucaccaugccaccaugcuggauguugacuugcacccugcaucagcuuggacacuguacgccguggccaccacuauaauuacacccaugaugcgucauacgaucgaaaacaccacugcaaauauuucucucacagcuaucgccaaccaggcggcuauacugaugggccuugauaaggguuggccaaucaguaaaauggacauuggggucccuuuacuggcccucggcugcuacagccaggugaauccguugacccugaccgcagccguccuaaugcugguggcucacuaugcaaucauuggacccggccuccaagccaaggcgacaagagaggcucagaagaggacugccgcagggaucaugaaaaacccaacgguugauggaauaguggccauugaccuugauccuguaguguacgacgcuaaguucgaaaaacagcugggccagaucauguugcugauccucuguaccagccaaauucuguuaaugcgcacaacuugggcccuuugcgaguccaucacccuggcaacagguccccucaccacucuaugggaggggucuccaggaaaguuuuggaauacgacaauagcugucucaauggccaacauuuuccggggcagcuaucuggcgggugccggcuuggcauuuucccugaugaaaagucucgggggaggccgaagagggaccggagcucagggcgaaacucuuggugagaaguggaagaggcagcugaaucaguugucuaaaagcgaguucaacaucuacaagcgcucagggauuauggagguugaccgguccgaagccaaagagggacugaagagaggcgagaccacacgucacgcagugaguagggguacugcuaaacuccggugguucgucgaacgcaauuuagugaagccugagggcaagguaaucgaucugggguguggacgaggcggguggagcuauuacugcgccggacuuaaaaaggugaccgaaguuaaaggcuauacaaagggugggcccggacaugaggaaccgauaccaauggccacguacggcuggaaccuggugaaacuacacucuggcaaggacgucuuuuucaccccucccgagaaaugugauacucuccugugcgacaucggggaguccucaccaaaucccacaauugaagagggaagaaccuugagggugcugaagauggucgaaccuuggcuccgggguaaccaauuuuguaucaagauucuuaauccguacaugcccagcgugguugagacucuggagcagaugcagcgcaaacauggcgggauguuaguaagaaacccacugucgagaaauucuacacacgaaauguauugggugaguugcggaaccggcaacaucgucuccgcggugaauaugacgagccgaauguugcucaaccgguucaccauggcucaccguaagccuacauacgagagagauguugaccugggugcagggacucgccauguggccgucgaacccgagguggcuaaccuagauauuaucggacagaggauagaaaauauuaaacacgagcauaagucaaccuggcacuaugacgaggauaacccuuacaaaacaugggccuaucauggcuccuacgaaguaaagccaucuggcagcgcaaguuccauggugaaugggguugucaaacuucugacuaaacccugggacgugaucccuauggugacccaaaucgccaugacagauaccacuccauuuggacagcagcgggucuucaaggagaaaguugacacgagaacacccaaggcuaaacgcgguaccgcgcaaauuauggaagugacugccagguggcucuggggcuuucugagccgaaacaagaagccgcggauauguaccagagaggaguucacaaggaaaguacgcucuaaugcagcuaucggggccguguuugucgacgagaaccaguggaacucagcaaaggaggccguggaagaugagcguuucugggacuugguucagaaagaacgggagcugcacaagcagggaaaaugcgcuacgugcguguauaacaugaugggcaagagagaaaagaaacucggugaguuugggaaggccaaaggaaguagggcgauuugguacauguggcuuggcgcacgcuuccuggaguuugaagccuuaggcuucaugaaugaggaucacugguucucccgagaaaacagccugucuggggucgagggagaggguuugcauaagcucggcuacauccugcgggacauuucgaaaaucccugggggaaauauguaugcugaugacaccgccggcugggauacuagaauaacagaagacgaucuacaaaacgaggcaaagaucaccgacauuauggaaccagagcacgcacuucuggccacuucaaucuuuaaacucacauaccagaauaaggugguaaggguucagcgccccgcuaagaacgguaccgugauggaugucauuagcagacgggaccagaggggguccggacaagugggcacauauggccugaauacuuucaccaacauggaagcccaguugauccgucagauggagagugaggggauauuuuuaccuucugaacuggagacgccaaaccucgcagaacgagugcuugauuggcuggagaaauacggagucgaacgccuaaagagaauggcgauuagcggugacgacuguguugugaaacccaucgaugaccgguucgccaccgcucugacagcccucaaugauaugggcaagguaaggaaagacaucccgcagugggagccuuccaagggguggaacgauuggcaacaggugcccuuuugcucacaucacuuccaccaguugauuaugaaggacggacgcgagauagucgugccauguagaaaucaggaugaacugguuggccgggcaagggugagucaaggugcuggguggucucuucgagagacugccugccugggaaaaagcuaugcacagauguggcagcucauguacuuucaucguagagacuuacgccuggccgcgaacgcuaucuguuccgccgucccuguggauuggguacccaccucacggacaacuuggagcauucacgcacaucaccaauggaugaccacggaagacauguugucuguuuggaauaggguguggaucgaggaaaacccauggauggaggauaagacacaugucuccaguuggggcgacgugcccuaucugggcaaaagagaggaccaguggugcgggagccucauuggacuuaccgcccgcgcuacuugggccucgaauauccagguugcaauaaaccaggugcggaggcugaucgguaaugaaaacuaccuagauuacaugacauccaugaagcgauucaaaaaugagggcgacccugaaggggcucugugguga

SEQ ID NO: 13820 - RNA, 9879 nt, Artificial Sequence
  derived and/or modified CDS sequence (opt3) from DENV-1__GQ199835__SS-prME
agcgugaccaugcugcucaugcuuaugcccaccgcccuggcuuuccacuugacuacgaggggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucugacuuuaauggcuaccuuuaaaaugagaccuauguucgccgugggccuccugcuuaggcgccugacgagccgggagguccuacuccugacaauagguuugucacugguggcaaguguugaauuaccaaacucccucgaggaacugggggauggacuugccaugggcaucaugauucugaaguugcucaccgacuuucaaucucaccagcugugggcuacucuacugagccuuaccuucaucaaaacaacucucucccugcauuacgcguggaagaccauggccaugguguugucaauugucagccuguuucccuuaugucucaguacgacaucucagaagaccacuuggcugccgguacuucugggcuccuuggggugcaaaccucucacaauguuccugaucgcagagaauaagauauggggaagaaaaagcuggccacuaaacgaagguaucauggcugugggcguugugucgauucugcuuucaucucuccugaagaacgauguccccuuggccgggccuuuaaucgccggaggcaugcugauugcuuguuaugugaucagugguuccagcgcagaccucucucuggagaaagccgcggagguaagcugggaagaggaagcugagcacuccggggccucacauaauauacuuguggaaguccaggaugacggaaccaugaagauuaaagaugaggagagggacgauacucugacaaucuugcuaaaggcaacccugcucgccguuaguggcguguacccccugagcaucccagcuacgcuuuuugugugguauuucuggcaaaagaaaaagcagcgaucuggcgucuuaugggacacuccuucacccccagaaguggagcgcgcaguucuggaugacgggauuuaccggauaaugcagagaggacucuuggguaggagccagguaggcgugggggucuuucaagaaaacguguuccacaccauguggcacguuacacguggagccgugcugauguaucagggcaaacgccucgagccgaguugggcgagcgucaagaaagaccugaucuccuacggugggggauggcggcuucagggcucuuggaauaccggcgaggaagugcagguaauugcugucgagccugggaagaaccccaagaaugugcaaacagccccaggaacuuucaaaacccccgaaggugagguuggcgcaaucgcccuggauuuuaagccugggacgucgggaagcccaauugugaacagagaaggcaaaaucgucgguuuguacgggaauggagugguuacaacuucaggcaccuauguguccgcuauagcccaggcaaaggcuagucaggagggcccccuaccugagaucgaagacgaggucuucaggaaacgaaaccugacaauuauggaucuccauccggggucuggaaagacccggcgcuacuuaccagccaucgugagagaagcgauuaagaggaaacugcggacucuuauccuggcccccacccgaguaguggcaagcgagauggcugaagcccucaaggguaugccuauaagauaucaaacaacggcuguuaaauccgagcacacuggcaaggagauugucgacuugaugugccaugcaaccuuuacaaugcgccugcucucaccagugagggugcccaauuacaacaugaucaucauggaugaagcccacuucaccgacccuucuagcauugccgcucguggguauaucaguacucgggucggaaugggcgaggcggcagccauauuuaugacagcuaccccgcccgguuccguagaagccuucccacagagcaaugcagugauucaggaugaggaaagagacaucccugagaggucuuggaacucaggguacgaguggauuacggauuuucccggaaaaacuguuugguucgugccauccaucaagaguggcaaugacauagccaacugucugcgcaagaauggcaaacgagucauucagcuuagcagaaagacauuugauaccgaauaucagaaaaccaagaacaacgacugggacuacgugguuacuacagauaucucggagaugggggcuaauuuccgggcggacagggugaucgauccucgccguugccuaaaacccgucauucugaaggacggaccagaaagagugaucuuggccgguccgaugccuguaaccguggcaucugcugcccagcggaggggccgcauugggcgaaaccauaauaaggagggagaucaguacauauauaugggccagcccuuaaacaaugacgaggaucacgcacacuggacagaagccaaaaugcugcucgacaacaucaauacuccagaggguauuauccccgcucuguuugaaccugagagagaaaaguccgccgcgaucgauggggaguaccggcuuaggggcgaggcacgcaaaacguucguugaacugaugagaaggggagaccucccagucugguugagcuauaagguggccucagagggcuuccaauacagugaucggcguuggugcuuugacggggaacgcaacaaucaggugcuggaggaaaacauggaugucgagauuuggaccaaagagggagaacgaaagaaacuaagacccagguggcuggacgcucggacauauucugacccucucgcccuucgcgaguucaaggaauuugcugcagguagaagguccguuagcggcgaucugauauuagagaucgggaaguugccgcagcaucugacucagcgggcccaaaaugcucucgacaaccuggugaugcuucacaauucagaacagggaggccgagccuacagacaugcaauggaggagcugccagauaccauugaaacacucauguugcuggcguuaaucgccguacuaaccgguggggugacucuguucuuucucaguggccgcggacuuggcaaaacgagcauugggcuguugugugucauggcuuccucugugcugcucuggauggccagcguugagccccacuggaucgcagcuuccauaauccuggaguucuuucuuauggugcuccugauuccugagcccgacaggcagcggaccccacaggauaaccaauuggccuaugucguaaucggacuguuauucaugauucuaacaguggcagccaaugagaugggucugcucgaaacuaccaagaaagaccuuggcaucgggcacguugcuguggagaaccaucaccaugcgacaaugcuggaugucgacuugcacccugccucagcauggacccuguacgcuguggccacuacaauaauuacgcccaugaugcgucauaccaucgaaaacacuacagccaauauuucucucaccgcaaucgcuaaccaggccgcgauacugaugggacuugauaagggcuggccaaucaguaaaauggacauuggugucccuuuacuggcucucgggugcuacagccaggugaauccguugacccugacagccgcaguucuaaugcugguggcccacuaugcuaucauuggccccggacuccaagcaaaggccacuagagaggcgcagaagaggacggcugccggcaucaugaaaaacccaaccguagaugggauaguggcaauugaccuugauccugucguuuacgacgccaaguuugaaaaacagcugggacagaucauguugcugauccucuguacaagccaaauucuguuaaugcgcacuaccugggcucuuugcgaguccaucacacuggccaccggcccccucacuacgcuaugggaggguucuccagggaaguucuggaauacaaccauagcagugucaauggcuaacauuuuucggggaagcuaucuggccggcgcggguuuggccuucucccugaugaaaagucucggcgggggacgaagaggcacuggggcacagggagaaacccuuggcgagaaguggaagaggcagcugaaucaguugucuaaaagcgaauuuaacaucuacaagcgcucagguauuauggaggucgaccgguccgaagcuaaagaggggcugaagagaggagagacaacucgucacgccgugaguaggggcaccgcaaaacuccggugguucguagaacgcaauuuagugaagccugaggguaagguuaucgaucugggcugugggcgaggaggcuggagcuauuacugcgcugggcuuaaaaaggugacagaagucaaaggauauacgaagggcggucccgggcaugaggaaccgauaccaauggccaccuacggauggaaccuggugaaacuacacucuggcaaggacgucuucuuuacuccucccgagaaaugugauacacuccugugcgacaucggcgaguccucaccaaaucccaccauugaagaggggagaacuuugagggugcugaagaugguugaaccuuggcuccggggaaaccaauucuguaucaagauucuuaauccguacaugcccagcguaguggagacacuggagcagaugcagcgcaaacaugguggcauguuagucagaaacccacugucgagaaauucuacccacgaaauguauugggugaguugcgggacgggaaacaucguuuccgccgugaauaugaccagccgaauguugcucaaccgguuuacaauggcgcaccguaagccuacuuacgagagagaugucgaccugggcgcugguacccgccauguggcaguagaacccgagguggccaaccuagauauuaucgggcagaggauagaaaauauuaaacacgagcauaagucaacauggcacuaugacgaggauaacccuuacaaaacuugggcuuaucauggauccuacgaaguuaagccaucuggcagcgccaguuccauggucaauggcguggugaaacuucugaccaaacccugggacgucaucccuaugguuacacaaaucgcaaugaccgauacuacgccauucgggcagcagcggguguuuaaggagaaaguagacacaagaacccccaaggccaaacgcggaacugcucaaauuauggaagugaccgcgagguggcucugggguuuccugagccgaaacaagaagccgcggauauguacaagagaggaauuuacgaggaaaguccgcucuaaugccgcaaucggcgcuguguucguugacgagaaccaguggaacucagccaaggaggcaguggaagaugagcguuuuugggacuugguccagaaagaacgggagcugcacaagcaggggaaaugcgcaaccugcguguauaacaugaugggaaagagagaaaagaaacucggcgaguucgguaaggcuaaagggaguagggccauuugguacauguggcuuggagcgcgcuuucuggaguucgaagcauuaggcuuuaugaaugaggaucacugguucucccgagaaaacagccugucuggcguagagggggagggauugcauaagcucgguuacauccugcgggacauuucgaaaaucccuggcgggaauauguaugccgaugacacugcuggaugggauacaagaauaaccgaagacgaucuacaaaacgaggccaagaucacugacauuauggaaccagagcacgcacuucuggcuacaucaaucuucaaacucaccuaccagaauaagguugugaggguccagcgccccgccaagaacggcacagugauggaugugauuagcagacgggaccagagggguuccgggcaagucggaacuuauggccugaauaccuuuacgaacauggaagcucaguugauccgucagauggagagugagggcauauucuuaccuucugaacuggagaccccaaaccucgccgaacgaguucuugauuggcuggagaaauacgggguggaacgccuaaagagaauggcaauuagcggagacgacuguguagugaaacccaucgaugaccgguuugcgacagcccugacugcucucaaugauauggguaaggucaggaaagacaucccgcagugggagccuuccaagggcuggaacgauuggcaacaggugcccuucugcucacaucacuuucaccaguugauuaugaaggacgggcgcgagauaguugugccauguagaaaucaggaugaacuggucggacgggccagggugagucaaggcgcagguuggucucuucgagagaccgcuugccuggggaaaagcuaugcccagauguggcagcucauguacuuccaucguagagacuuacgccuggcagccaacgcgaucuguuccgcuguaccuguugauugggugcccacaucacggacuaccuggagcauucacgcccaucaccaauggaugacgacagaagacauguugucugucuggaauaggguguggaucgaggaaaacccauggauggaggauaagacccauguuuccaguuggggagacgugcccuaucugggcaaaagagaggaccaguggugcggcagccucauugggcuuacugcacgcgccacaugggcuucgaauauccaggucgccauaaaccaggugcggaggcugaucggaaaugaaaacuaccuagauuacaugaccuccaugaagcgauuuaaaaaugagggugacccugaaggcgcacugugguga

SEQ ID NO: 13821 - RNA, 9879 nt, Artificial Sequence
  derived and/or modified CDS sequence (opt3) from DENV-1__FJ898386__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaaaaugagaccuauguucgcagugggccuccuguuuaggcgccuuaccagccgggagguccugcuacucacgauaggucugucauugguggccaguguugaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuuggcucccuggggugcaaaccuuugacuauguuucucaucgcugagaauaagauauggggaagaaaaagcuggccacugaacgaagguaucauggccgugggcguugugucgauucuacugucaucucuucucaagaacgaugucccccuggccgggccuuugaucgcuggaggcauguuaauugcauguuaugugaucagugguuccagcgccgaccugucucucgagaaagcggcugagguaagcugggaagaggaagccgagcacuccggggcaucacauaauauacugguggaaguccaggaugacggaacaaugaagauuaaagaugaggagagggacgauacccuuacuauccuguugaaggccacacuacuggcuguuaguggcguguacccccucagcaucccagcaacccuguucgugugguauuuuuggcaaaagaaaaagcagcgaucuggcguccuuugggacacgccuucacccccagaaguggagcgcgccguuuuagaugacgggauuuaccggauaaugcagagaggacugcucgguaggagccagguaggcgugggggucuuccaagaaaacguguuccacacuauguggcacguuacccguggagcgguguugauguaucagggcaaacgccuggagccgaguugggcuagcgucaagaaagaccucaucuccuacggugggggauggcggcugcagggcucuuggaauacaggcgaggaagugcagguaauugccgucgagccugggaagaaccccaagaaugugcaaaccgcaccaggaacauuuaaaacucccgaaggugagguuggcgccaucgcucuugauuucaagccugggaccucgggaagcccaauugugaacagagaaggcaaaaucgucggucuguacgggaauggagugguuacgacaucaggcacuuauguguccgccauagcacaggcuaaggccagucaggagggccccuugccugagaucgaagacgaggucuuuaggaaacgaaaccuaaccauuauggaucugcauccggggucuggaaagacacggcgcuaccucccagcgaucgugagagaagccauuaagaggaaauuacggacccugauccuugcacccacucgaguaguggcuagcgagauggccgaagcucugaaggguaugccuauaagauaucaaaccacagcaguuaaauccgagcacacgggcaaggagauugucgaccucaugugccaugccacuuucaccaugcgcuugcugucaccagugagggugcccaauuacaacaugaucaucauggaugaagcccacuuuacagacccuucuagcauugcugcgcguggguauaucaguacccgggucggaaugggcgaggcagccgcuauauucaugacugccacaccgcccgguuccguagaagcauuuccacagagcaaugccgugauucaggaugaggaaagagacaucccugagaggucuuggaacucaggguacgaguggauuaccgauuuccccggaaaaacgguuugguuugugccauccaucaagaguggcaaugacauagcuaacugucuccgcaagaauggcaaacgagucauucagcugagcagaaagacuuucgauacagaauaucagaaaaccaagaacaacgacugggacuacgugguuaccacugauaucucggagaugggggcgaauuuucgggccgacagggugaucgauccucgccguugccuuaaacccgucauucuaaaggacggaccagaaagagugauccuggcagguccgaugccuguaacaguggcuucugccgcacagcggaggggccgcauugggcgaaaccauaauaaggagggagaucaguacauauauaugggccagcccuugaacaaugacgaggaucacgcccacuggaccgaagcuaaaauguuacuggacaacaucaauacaccagaggguauuauccccgcccucuucgaaccugagagagaaaaguccgcggcaaucgauggggaguaccggcugaggggcgaggcccgcaaaacuuucguugaacuuaugagaaggggagaccugccagucuggcucagcuauaagguggcuucagagggcuuucaauacagugaucggcguuggugcuucgacggggaacgcaacaaucagguguuggaggaaaacauggaugucgagauuuggacgaaagagggagaacgaaagaaacugagacccagguggcuagacgcccggaccuauucugacccucuggcucuccgcgaguuuaaggaguucgcagccgguagaagguccguuagcggcgaucuuauacuggagaucgggaaguuaccgcagcauuugacacagcgggcucaaaaugcccuggacaaccucgugaugcugcacaauucagaacagggaggccgagcauacagacaugcgauggaggagcuuccagauacuauugaaacccugaugcucuuggcccugaucgcuguauuaacagguggggugacccuauuuuuccugaguggccgcggacucggcaaaacuagcauugggcuucugugugucauggccuccucuguguugcuguggauggcaagcguugagccccacuggaucgcugccuccauaauccucgaauuuuuccugauggugcuucucauuccugagcccgacaggcagcggacgccacaggauaaccaacuggcauaugucguaaucggauugcuguuuaugauuuuaaccguggccgcuaaugagaugggucuacuggaaacaacuaagaaagaccucggcaucgggcacguugcgguggagaaccaucaccaugccaccaugcuugaugucgaccugcacccugcaucagcuuggacauuguacgccguggccaccacuauaauuacacccaugaugcgucauacgaucgaaaacaccacugcaaauauuucucugacagcuaucgccaaccaggcggcuauacucaugggacuggauaagggcuggccaaucaguaaaauggacauuggugucccucuuuuagcccuggggugcuacagccaggugaauccgcucaccuugaccgcagccguucugaugcuaguggcucacuaugcaaucauuggccccggacugcaagccaaggcgacaagagaggcucagaagaggacugccgcaggcaucaugaaaaacccaacgguagaugggauaguggccauugaccucgauccugucguuuacgacgcuaaguucgaaaaacagcuuggacagaucaugcuguugauccuguguaccagccaaauucuccugaugcgcacaacuugggccuuaugcgaguccaucacccuugcaacaggcccccugaccacucucugggaggguucuccagggaaguuuuggaauacgacaauagcugugucaauggccaacauuuuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacaucuacaagcgcucagguauuauggaggucgaccgguccgaagccaaagagggguugaagagaggagagaccacacgucacgcagugaguaggggcacugcuaaacugcggugguucguagaacgcaaucucgugaagccugaggguaagguuaucgauuuaggcugugggcgaggaggcuggagcuauuacugcgccgggcugaaaaaggugaccgaagucaaaggauauacaaagggcggucccgggcaugaggaaccgauaccaauggccacguacggauggaaccuugugaaacugcacucuggcaaggacgucuuuuucaccccucccgagaaaugugauacucuacucugcgacaucggcgaguccucaccaaaucccacaauugaagaggggagaacccugaggguguugaagaugguugaaccuuggcugcggggaaaccaauuuuguaucaagauucucaauccguacaugcccagcguaguggagacucuugagcagaugcagcgcaaacaugguggcaugcuggucagaaacccauuaucgagaaauucuacacacgaaauguauugggugaguugcgggaccggaaacaucguuuccgcggugaauaugacgagccgaaugcuguugaaccgguucaccauggcucaccguaagccuacauacgagagagaugucgaccucggcgcagguacucgccauguggccguagaacccgagguggcuaaccuggauauuaucgggcagaggauagaaaauauuaaacacgagcauaagucaaccuggcacuaugacgaggauaacccuuacaaaacaugggccuaucauggauccuacgaaguuaagccaucuggcagcgcaaguuccauggucaauggcguggugaagcuacuuacuaaacccugggacgucaucccuaugguuacccaaaucgccaugacagauaccacuccauuugggcagcagcggguguucaaggagaaaguagacacgagaacacccaaggcuaaacgcggaaccgcgcaaauuauggaagugacugccagguggcugugggguuuucucagccgaaacaagaagccgcggauauguaccagagaggaguucacaaggaaaguccgcucuaaugcagcuaucggcgccguguuuguugacgagaaccaguggaacucagcaaaggaggccguggaagaugagcguuucugggaccugguccagaaagaacgggaguugcacaagcaggggaaaugcgcuacgugcguguauaacaugaugggaaagagagaaaagaaacugggcgaguuugguaaggccaaagggaguagggcgauuugguacauguggcucggagcacgcuuccuugaguuugaagcccugggcuucaugaaugaggaucacugguucucccgagaaaacagcuuaucuggcguagagggggagggacugcauaaguuggguuacauccuccgggacauuucgaaaaucccuggcgggaauauguaugcugaugacaccgccggaugggauacuagaauaacagaagacgaucugcaaaacgaggcaaagaucaccgacauuauggaaccagagcacgcucuacuugccacuucaaucuuuaaacugacauaccagaauaagguugugaggguccagcgccccgcuaagaacggcaccgugauggaugugauuagcagacgggaccagagggguuccgggcaagucggaacauauggccucaauacuuucaccaacauggaagcccagcugauccgucagauggagagugagggcauauuuuugccuucugaauuagagacgccaaaccuggcagaacgaguucucgauuggcuugagaaauacgggguggaacgccugaagagaauggcgauuagcggagacgacuguguagugaaacccaucgaugaccgguucgccaccgcucuaacagcccugaaugauauggguaaggucaggaaagacaucccgcagugggagccuuccaagggcuggaacgauuggcaacaggugcccuuuugcucacaucacuuccaccagcucauuaugaaggacgggcgcgagauaguugugccauguagaaaucaggaugaauuggucggacgggcaagggugagucaaggcgcugguuggucucugcgagagacugccugccuugggaaaagcuaugcacagauguggcagcugauguacuuucaucguagagaccuccgcuuagccgcgaacgcuaucuguuccgccguaccuguugauugggugcccaccucacggacaacuuggagcauucacgcacaucaccaauggaugaccacggaagacaugcugucugucuggaauaggguguggaucgaggaaaacccauggauggaggauaagacacauguuuccaguugggaggacgugcccuauuugggaaaaagagaagaccaguggugcggcagccugauuggccucaccgcccgcgcuacuugggccucgaauauccaggucgcaauaaaccaggugcggaggcuuaucgggaaugagaacuaccuggauuacaugacauccaugaagcgauucaaaaaugaaggagacccugagggugcuuuuugguga

SEQ ID NO: 13822 - RNA, 9879 nt, Artificial Sequence
  derived and/or modified CDS sequence (opt3) from DENV-1__FJ898387__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacacgaaauuugaaaagcagcuaggacagaucaugcugcucauccuuuguaccucucagauucuguugaugcgcacaacuugggcacugugcgagucaaucacccucgcuacaggcccucugaccacuuuaugggaggguagccccgggaaauucuggaauacgacaauagccguuuccauggcgaacauuuuccggggaaguuaccuugccggcgcaggucuggcuuuuucucucaugaaaagccuaggcgggggacgaagaggcaccggggcccaaggagaaacucugggcgagaaguggaaaaggcaguugaaucagcugucaaaguccgaguucaacaccuauaaacgcagugguaucauggagguggaccggagcgaagcaaaggaggggcucaaaagaggagagacaacuaagcacgcugucucucguggcaccgccaaacuuaggugguuuguggaacggaaucugguaaaaccagaggguaaggugauugauuugggcugugggcgcggaggcugguccuacuauugcgccgggcugaaaaagguuacagaagugaaaggauacacgaagggcgguccugggcacgaggaacccaucccgauggcgaccuacggauggaaccucgucaaauuacauucaggcaaggacguguucuuuauaccaccugagaagugugauacucugcuuugcgacaucggcgagagcucgcccaauccaacaauugaagaggggcgaacccugagaguccuaaaaaugguggaacccuggcucaggggaaaccaguucuguaucaagauucugaauccuuauaugccgucuguuguagagacuuuggagcaaaugcagcggaaacacgguggcaugcuggugcgcaacccccucaguagaaauuccacacaugaaauguacugggucagcugcgggaccggaaacaucgugucagcuguuaauaugacguccaggaugcuucugaaccgauuuaccauggcacaccggaagccaacauaugagcgugauguggacuuaggcgccgguacuagacacgucgcuguggaaccugagguagccaaccuggauauuaucgggcagcgcauagaaaauauuaaacaugagcacaagucuaccuggcauuacgacgaggauaaccccuauaagacaugggcauaccacggaagcuaugaagugaaaccuaguggcuccgccagcucuaugguuaauggcgucgugaaguugcucacuaaaccaugggacgugauccccauggucacccagaucgcuaugacagauaccacuccuuucgggcaacagaggguuuuuaaggagaaaguggacacgcggacaccaaaggcgaagagaggaaccgcccagauuauggaaguaacugcaaaauggcugugggguuuccuaucacgcaacaagaaacccaggauauguacccgagaggaauuuacacggaaggugagaaguaaugcugccaucggcgcagucuucguggacgagaaccaauggaacuccgccaaagaggcuguugaagaugagagguuuugggaccuugugcaucgcgaacgugagcugcacaagcaggggaagugcgccacgugcgucuacaacaugaugggaaaacgggaaaagaaacucggcgaguucgguaaggcgaaagggagcagagcaauuugguacauguggcugggagccagguucuuggaguuugaagcucugggcuucaugaaugaggaucacugguuuucucgcgaaaacucgcucucaggcguggagggggagggacuucauaagcuggguuauaucuuacgagacauuagcaaaaucccgggcgggaauauguacgccgaugacaccgcaggaugggauacucggauaacagaagacgaucugcagaacgaggcuaagaucaccgacauuauggaaccugagcacgccuugcucgcuaaguccaucuucaaacugacuuaucagaauaagguaguuagagugcaaaggccagccaaaaacggcacagucauggaugugauuagucgcagagaccagcgggguucuggacaggugggaaccuacggccuaaauacauuuacuaacauggaagcacagcuuaucaggcaaauggagagcgagggcauauucucccccucagaacuggagaccccuaaccucgcggggcguguccuggauugguuggaaaagcauggaguugagcgauuaaaacgcauggccauuaguggugacgacugugugguaaagccaaucgaugacagauuugcuacggcccugaccgcacucaaugauaugggcaaggugcggaaagacaucccccagugggaaccgucuaagggguggaacgauuggcagcaggucccuuucugcagccaccacuuucaucaacuuauuaugaaagacggaagggagauagugguucccugucgcaaucaggaugagcuggugggcagagcucgggucucccagggugccggguggucacuaagggaaacagcaugccugggaaagagcuaugcccagauguggcaacucauguacuuccaccgacgugacuugagacuggcggcuaacgccaucuguucugcagugccaguagauuggguuccuacuucccgcaccacauggaguauucaugcccaccaucaguggaugacuaccgaggacaugcuuagcguguggaaucgggucuggaucgaagagaaccccuggauggaagauaaaacgcacauuucguccuggggcgacgugccauaucugggcaagagggaggaccaguggugcgggucucucaucggauuaacagcuagagccaccugggcaacuaauauacaaguugcuaucaaccaggugcgccggcugauugguaaugagaacuacuuggauuacaugacaucaaugaagagguuuaaaaaugaaagcgaccccgagggcgcccugugguga

SEQ ID NO: 13823 - RNA, 9879 nt, Artificial Sequence
  derived and/or modified CDS sequence (opt3) from DENV-1__FJ898389__SS-prME
agcgugaccaugcugcucaugcuuaugcccacagcacuggcuuuccacuugacuacgaggggaggggaaccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuauuucugauuaugggacagcucacauggaacgaucugauccggcuuugcauuaugguuggcgccaaugcaucugaccguauggggaugggaaccacauauuuggcucugauggccacuuucaaaaugagaccuauguuugcagugggcuuacucuucaggcgccugaccagccgggagguccuucugcuaacgauaggucucucacugguggccaguguugaauugccaaacucccuggaggaauuaggggauggacucgcuaugggcaucaugauucugaaacuucugacagacuuucaaucucaccaguugugggcgacccuccugagccuaacuuucaucaaaaccacacugucccuucauuacgccuggaagacuauggcaauggugcucucaauugucagccuguuucccuugugucugaguaccacgucucagaagacaaccugguuaccgguacuccugggcuccuucgggugcaaaccucuugcuauguuucugaucgccgagaauaagauauggggaagaaaaagcuggccauugaacgaagguaucauggccgugggcguugugucgauucuccugucaucucuacugaagaacgaugucccccuugcugggccucucaucgcaggaggcaugcugauugccuguuaugugaucagugguuccagcgcggacuugucuuuagagaaagcugccgagguaagcugggaagaggaagcagagcacuccggggccucacauaauauacugguggaaguccaggaugacggaacuaugaagauuaaagaugaggagagggacgauacacucaccauccugcuuaaggcuacucuguuggcaguuaguggcguguacccccuaagcaucccagccacacuguucgugugguauuucuggcaaaagaaaaagcagcgaucuggcguccucugggacaccccuucacccccagaaguggagcgcgcgguucuggaugacgggauuuaccggauaaugcagagaggacuuuuagguaggagccagguaggcgugggggucuuucaagaaaacguguuccacacgauguggcacguuacucguggagcugugcugauguaucagggcaaacgccucgagccgaguugggccagcgucaagaaagacuugaucuccuacggugggggauggcggcugcagggcucuuggaauaccggcgaggaagugcagguaauugcagucgagccugggaagaaccccaagaaugugcaaacagccccaggaaccuuuaaaacacccgaaggugagguuggcgcuaucgcccucgauuucaagccugggacuucgggaagcccaauugugaacagagaaggcaaaaucgucggucuguacgggaauggagugguuaccacgucaggcacauauguguccgcaauagcucaggccaaggcgagucaggagggcccccuuccugagaucgaagacgaggucuuuaggaaacgaaaccugacuauuauggauuugcauccggggucuggaaagacccggcgcuaccuaccagccaucgugagagaagcaauuaagaggaaacugcggacacucaucuuagcucccacccgaguaguggccagcgagauggcugaagcacugaaggguaugccuauaagauaucaaacuaccgccguuaaauccgagcacacaggcaaggagauugucgaccuuaugugccaugccacguucacuaugcgccugcucucaccagugagggugcccaauuacaacaugaucaucauggaugaagcucacuuuaccgacccuuucucuauugcggcacguggguauaucagcacacgggucggaaugggcgaggccgcugccauauuuaugaccgcaacuccgcccgguaguguagaagccuucccacaguccaaugcugugauucaggaugaggaaagagacaucccugagaggagcuggaacucuggguacgaguggauuacagauuuucccggaaaaaccguuugguucgugccaucaaucaaguccggcaaugacauagcgaacuguuugcgcaagaauggcaaacgagucauucagcugaguagaaagacguucgauacugaauaucagaagaccaagaacaacgacugggacuacgugguuaccaccgauaucagcgagaugggggccaauuuucgggcagacagggugaucgauccucgccguugccucaaacccgucauucugaaggacggaccagaaagagugauccuugcugguccgaugccuguaacuguggccucggcagcccagcggaggggccgcauugggcgaaaccauaauaaggagggagaucaguacauauauaugggccagccccuaaacaaugacgaggaucacgcucacuggacagaagccaaaaugcuguuggacaacaucaauaccccagaggguauuauccccgcguuauucgaaccugagagagaaaagucugcagccaucgauggggaguaccggcugaggggcgaggcucgcaaaacauuuguugaacucaugagaaggggagaccugccagucuggcuuuccuauaagguggccagcgagggcuuccaauacucagaucggcguuggugcuuugacggggaacgcaacaaucaggugcuggaggaaaacauggaugucgagauuuggacuaaagagggagaacgaaagaaacucagacccaggugguuggacgcucggacguauagugacccucuggcacuacgcgaguucaaggaauuugccgcugguagaaggucuguuuccggcgaucugauacucgagaucgggaaacuuccgcagcaucugacccagcgggcccaaaaugcauuagacaacuuggugaugcugcacaauagcgaacagggaggccgagcguacagacaugccauggaggagcucccagauacaauugaaacucugaugcuucuggcucucaucgccguauugaccgguggggugacacuguucuuuuuaucaggccgcggacuaggcaaaaccaguauugggcugcucugugucauggcaagcuccgugcuucuguggauggcuucuguugagccccacuggaucgccgcaagcauaaucuuggaguucuuucugauggugcuccugauuccugagcccgacaggcagcggacuccacaggauaaccaacuugccuaugucguaaucggacuccuguucaugauuuugacgguggcugcgaaugagaugggucuguuagaaaccacaaagaaagaccuaggcaucgggcacguugccguggagaaccaucaccaugcaacuaugcuggaugucgaccuccacccugcuuccgccuggacccuuuacgccguggcaacaaccauaauuacucccaugaugcgucauacaaucgaaaacacgaccgcuaauauuucacugacugccaucgcgaaccaggcugccauauugaugggacuggauaagggcuggccaaucucuaaaauggacauuggugucccucuccuggcacuugggugcuacagucaggugaauccguuaacacugaccgccgcuguucucauguugguggcacacuaugccaucauuggccccggacugcaagcgaaggcuaccagagaggcccagaagaggacagcagccggcaucaugaaaaacccaacuguagaugggauaguggcuauugaccuagauccugucguuuacgacgccaaguuugaaaaacagcugggacagaucaugcuccuuauccuguguacgucgcaaauuuugcugaugcgcaccacaugggcacucugcgagagcaucacucuggcuaccggccccuuaacaacccuuugggaggguuccccagggaaguucuggaauacuacgauagccgugucuauggcgaacauuuuccggggaucauaucuggccggcgcaggucucgcuuuuagccuaaugaaaucccugggcgggggacgaagaggcacaggggcccagggagaaaccuugggcgagaaguggaagaggcagcugaaucagcucaguaaaucugaguucaacaucuacaagcgcagcgguauuauggaggucgaccggucagaagcaaaagaggggcuuaagagaggagagacuacccgucacgcuguguccaggggcacagccaaacugcggugguuuguagaacgcaauuuggugaagccugaggguaagguuaucgaucugggcugugggcgaggaggcuggaguuauuacugcgccgggcucaaaaaggugacugaagucaaaggauauaccaagggcggucccgggcaugaggaaccgauaccaauggcgacauacggauggaacuuagugaaacugcacagcggcaaggacgucuucuuuacgccucccgagaaaugugauacccuucugugcgacaucggcgagucuuccccaaaucccacuauugaagaggggagaacacuaagggugcucaagaugguugaaccuuggcugcggggaaaccaauucuguaucaagauuuugaauccguacaugcccucaguaguggagacccuggagcagaugcagcgcaaacaugguggcaugcucgucagaaacccacuuagcagaaauucgacucacgaaauguauugggugucuugcgggacaggaaacaucguuagugcugugaauaugaccucccgaaugcuguuaaaccgguuuacgauggcacaccguaagccuaccuacgagagagaugucgaccugggcgccgguacacgccauguggcuguagaacccgagguggccaacuuggauauuaucgggcagaggauagaaaauauuaaacacgagcauaagagcacuuggcacuaugacgaggauaacccuuacaaaaccugggcauaucauggaucauacgaaguuaagccauccggcucugccagcaguauggucaauggcguggugaagcuccugacaaaacccugggacgucaucccuaugguuacucaaaucgcuaugaccgauacaaccccauucgggcagcagcggguguuuaaggagaaaguagacacuagaacgcccaaggcgaaacgcggaacagcccaaauuauggaagugaccgcaagguggcuaugggguuuccuuucccgaaacaagaagccgcggauauguacuagagaggaauuuaccaggaaaguccgcagcaaugcugccaucggcgcaguguucguugacgagaaccaguggaacucugccaaggaggcuguggaagaugagcguuuuugggaccugguccagaaagaacgggagcuccacaagcaggggaaaugcgccacaugcguguauaacaugaugggaaagagagaaaagaaacugggcgaguucgguaaggcgaaagggucaagggcaauuugguacaugugguugggagcccgcuuccuggaguuugaagcucucggcuucaugaaugaggaucacugguuuagucgagaaaacucccuuagcggcguagagggggagggacugcauaaguuagguuacauccugcgggacauuucuaaaaucccuggcgggaauauguaugccgaugacacggcaggaugggauaccagaauaacugaagacgauuugcaaaacgaggcuaagaucacagacauuauggaaccagagcacgcccuccuggcuaccucgaucuucaaacuaacuuaccagaauaagguugugaggguccagcgccccgccaagaacggcacagugauggaugugauuucaagacgggaccagagggguagcgggcaagucggaaccuauggccuuaauacauuuacuaacauggaagcacagcugauccgucagauggaguccgagggcauauuccucccuagugaacuggagaccccaaacuuggcggaacgaguuuuagauuggcuggagaaauacgggguggaacgccucaagagaauggccauuucuggagacgacuguguagugaaacccaucgaugaccgguuugcuacggcccuuaccgcacugaaugauauggguaaggucaggaaagacaucccgcagugggagccuagcaagggcuggaacgauuggcaacaggugcccuucugcucccaucacuuucaccagcuaauuaugaaggacgggcgcgagauaguugugccauguagaaaucaggaugaacuggucggacgggcuagggugucacaaggcgccgguuggagucuccgagagacagcaugcuuggggaaaucuuaugcccagauguggcagcugauguacuuccaucguagagaccuucgccuggcggcuaacgccaucuguagcgcaguaccuguugauugggugcccacuucccggaccacauggucaauucacgcccaucaccaauggaugacuaccgaagacaugcucagcgucuggaauaggguguggaucgaggaaaacccauggauggaggauaagacgcauguuucuuccuggggagacgugcccuauuuaggcaaaagagaggaccaguggugcggcagucugauuggguugacagcucgcgccaccugggcaagcaauauccaggucgcuauaaaccaggugcggaggcugaucggaaaugaaaacuaccucgauuacaugacuucgaugaagcgauuuaaaaaugagggugacccugaaggcgcccuuugguga

SEQ ID NO: 13824 - RNA, 9879 nt, Artificial Sequence
  derived and/or modified CDS sequence (opt3) from DENV-1__FJ898390__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugugggggaaaaagcucugaagcucuccugguucaagaaaggcucaaguaucggaaagauguuugaggccacugcaagaggcgccaggcggauggcuauucugggggauaccgccugggacuucggaagcaucgguggcguuuuuacauccguggggaaacuuguccaucagauuuucggaacggcauacggcgugcuguuuucugguguaagcuggaccaugaagauagggaucggcguguugcucacuuggcugggauuaaauucacgaaguacaucccugagcaugaccuguauugcgguuggccuagucacacucuaccugggggugauggugcaggcugauucuggaugcgucaucaacuggaaaggccgcgaacuuaagugugguucagggaucuucguuacuaaugaggugcacaccuggacggaacaauauaaguuucaggccgacaguccgaaaagauugagcgcagccauuggaaaggcuugggaggagggcgugugcgguauaagguccgccacacggcuggaaaacaucauguggaaacagauuucuaacgagcucaaucauauccuguuagaaaacgacaugaaguucaccguagucgugggcgauguuguggggauucuggcacagggcaaaaagaugauccgcccucaacccauggagcacaaauacucguggaaaagcuggggcaaggcuaagauaaucggggccgacguccagaauacuaccuuuauuaucgauggaccaaacacaccugaaugucccgacgaucagagagcguggaauauuugggagguggaggacuauggcuucgguaucuuuacuaccaacauauggcuuaaguugagggauuccuacacacagguuugcgaccaccgucucaugucagccgcuauuaaagauaguaaggcagugcaugccgacaugggguauuggaucgaaucugagaaaaaugaaacguggaagcuggcucgggccagcuucauugagguaaagaccuguaucuggccaaaaucccacacucuauggucaaacggaguccuggaaagcgagaugauaauccccaagauuuacggcgguccuaucucucaacauaauuaucgaccaggcuacuucacacagaccgcagggccguggcaccucggaaaacuggagcuugauuuugacuugugcgaaggcacuacagugguggucgaugagcacugcgggaacagaggacccucccugaggaccacgacuguuaccggcaagauuauccaugaaugguguugccgcaguuguacauuaccuccacuccgguucaaaggugaggacgggugcugguacggaauggagauaagacccgugaaggaaaaggaggaaaaucugguaaaaagcauggugucugcgggcuccggugaggucgacucauuuagucuuggccuguuguguauuagcaucaugaucgaagaggugaugaggucgcgcuggucccgaaagaugcucaugaccgggacucuggccguuuuccuacugcucauuaugggacagcugacauggaacgaucuuauccgguugugcauuauggugggcgcuaaugccucugaccguauggggaugggaaccacauaucuggcauuaauggcuacuuuuaaaaugagaccuauguucgccgucggccuccuguuuaggcgccuuaccagccgggaggugcugcuacucacgauaggucugucauugguugcaaguguggaacugccaaacuccuuagaggaacucggggauggacuggccaugggcaucaugauucuuaagcuguugacagacuuccaaucucaccagcucugggcuacccugcuaagccugacuuuuaucaaaaccacacuuucccuccauuacgcguggaagacuauggccaugguccugucaauuguauccuuguucccccuguguuuaaguaccacgucucagaagacaaccuggcucccggugcugcuuggcucccuggggugcaaaccuuugacuauguuucucaucgcagagaauaagauauggggaagaaaaagcuggccacugaacgaagguaucauggcuguuggcguggucucgauucuacugucaucucuucucaagaacgaugugccccuggccgggccuuugaucgccggaggcauguuaauugcuuguuauguaaucagugguuccagcgcagaccugucucucgagaaagccgcggaggugagcugggaagaggaagcugagcacuccggggccucacauaauauacuggucgaaguucaggaugacggaacaaugaagauuaaagaugaggagagggacgauacccuuacuauccuguugaaggcaacacuacuggccgugaguggcguguacccccucagcaucccagcuacccuguucgucugguauuuuuggcaaaagaaaaagcagcgaucuggcgugcuuugggacacgccuucacccccagaaguugagcgcgcaguauuagaugacgggauuuaccggauaaugcagagaggacugcucgguaggagccaggugggcgucgggguguuccaagaaaacguuuuccacacuauguggcacgugacccguggagccgucuugauguaucagggcaaacgccuggagccgaguugggcgagcgugaagaaagaccucaucuccuacggugggggauggcggcugcagggcucuuggaauacaggcgaggaaguacaggucauugcuguggagccugggaagaaccccaagaauguucaaaccgccccaggaacauuuaaaacucccgaaggugaggugggcgcaaucgcccuugauuucaagccugggaccucgggaagcccaauugucaacagagaaggcaaaaucgugggucuguacgggaauggaguugugacgacaucaggcacuuaugucuccgcuauagcccaggcaaaggcuagucaggagggccccuugccugagaucgaagacgagguguuuaggaaacgaaaccuaaccauuauggaucugcauccggggucuggaaagacacggcgcuaccucccagccaucguaagagaagcgauuaagaggaaauuacggacccugauccuugcccccacucgagugguugcaagcgagauggcugaagcccugaaggguaugccuauaagauaucaaaccacagcugucaaauccgagcacacgggcaaggagauuguggaccucaugugccaugcaacuuucaccaugcgcuugcugucaccagugaggguccccaauuacaacaugaucaucauggaugaagcccacuuuacagacccuucuagcauugccgcucguggguauaucaguacccggguaggaaugggcgaggcggcagccauauucaugacugcuacaccgcccgguuccguggaagccuuuccacagagcaaugcaguuauucaggaugaggaaagagacaucccugagaggucuuggaacucaggguacgaguggauuaccgauuuccccggaaaaacggugugguuugucccauccaucaagaguggcaaugacauagccaacugucuccgcaagaauggcaaacgagugauucagcugagcagaaagacuuucgauacagaauaucagaaaaccaagaacaacgacugggacuacguugugaccacugauaucucggagaugggggcuaauuuucgggcggacagggucaucgauccucgccguugccuuaaacccgugauucuaaaggacggaccagaaagaguaauccuggccgguccgaugccugugacaguugcaucugcugcccagcggaggggccgcauugggcgaaaccauaauaaggagggagaucaguacauauauaugggccagcccuugaacaaugacgaggaucacgcacacuggaccgaagccaaaauguuacuggacaacaucaauacaccagaggguauuauccccgcucucuucgaaccugagagagaaaaguccgccgcgaucgauggggaguaccggcugaggggcgaggcacgcaaaacuuucgucgaacuuaugagaaggggagaccugccaguguggcucagcuauaagguggccucagagggcuuucaauacagugaucggcguuggugcuucgacggggaacgcaacaaucaggucuuggaggaaaacauggauguugagauuuggacgaaagagggagaacgaaagaaacugagacccagguggcuagacgcucggaccuauucugacccucuggcccuccgcgaguuuaaggaguucgcugcagguagaagguccgugagcggcgaucuuauacuggagaucgggaaguuaccgcagcauuugacacagcgggcccaaaaugcucuggacaaccucguaaugcugcacaauucagaacagggaggccgagccuacagacaugcaauggaggagcuuccagauacuauugaaacccugaugcucuuggcgcugaucgccguguuaacagguggggucacccuauuuuuccugaguggccgcggacucggcaaaacuagcauugggcuucugugugugauggcuuccucuguuuugcuguggauggccagcguggagccccacuggaucgcagcuuccauaauccucgaauuuuuccugaugguccuucucauuccugagcccgacaggcagcggacgccacaggauaaccaacuggccuauguagugaucggauugcuguuuaugauuuuaaccguugcagccaaugagaugggucuacuggaaacaacuaagaaagaccucggcaucgggcacguggcugucgagaaccaucaccaugcgaccaugcuugauguggaccugcacccugccucagcauggacauuguacgcugucgccaccacuauaauuacacccaugaugcgucauacgaucgaaaacaccacugccaauauuucucugacagcaaucgcuaaccaggccgcgauacucaugggacuggauaagggcuggccaaucaguaaaauggacauuggugugccucuuuuagcucuggggugcuacucgcagguuaauccgcucaccuugaccgccgcagugcugaugcuaguagcccacuaugcuaucauuggccccggacugcaagcaaaggccacaagagaggcgcagaagaggacugcugccggcaucaugaaaaacccaacgguggaugggauagucgcaauugaccucgauccuguuguguacgacgccaaguucgaaaaacagcuuggacagaucaugcuguugauccuguguaccagccaaauucuccugaugcgcacaacuugggcuuuaugcgaguccaucacccuugccacaggcccccugaccacucucugggaggguucuccagggaaguuuuggaauacgacaauagcagucucaauggcuaacauuuuccggggaagcuaucuagccggcgcgggucuggccuuuuccuugaugaaaagucugggcgggggacgaagaggcaccggggcacagggagaaacucucggcgagaaguggaagaggcagcuuaaucagcugucuaaaagcgaguucaacaucuacaagcgcucagguauuauggagguggaccgguccgaagcuaaagagggguugaagagaggagagaccacacgucacgccguaaguaggggcacugcaaaacugcggugguucguggaacgcaaucucguuaagccugaggguaaggugaucgauuuaggcugugggcgaggaggcuggagcuauuacugcgcugggcugaaaaaggucaccgaagugaaaggauauacaaagggcggucccgggcaugaggaaccgauaccaauggccacguacggauggaaccuugucaaacugcacucuggcaaggacguguuuuucaccccucccgagaaaugugauacucuacucugcgacaucggcgaguccucaccaaaucccacaauugaagaggggagaacccugaggguuuugaagaugguagaaccuuggcugcggggaaaccaauuuuguaucaagauucucaauccguacaugcccagcguggucgagacucuugagcagaugcagcgcaaacaugguggcaugcuggugagaaacccauuaucgagaaauucuacacacgaaauguauuggguuaguugcgggaccggaaacaucguguccgccgucaauaugacgagccgaaugcuguugaaccgguucaccauggcgcaccguaagccuacauacgagagagauguggaccucggcgcugguacucgccauguagcaguggaacccgagguugccaaccuggauauuaucgggcagaggauagaaaauauuaaacacgagcauaagucaaccuggcacuaugacgaggauaacccuuacaaaacaugggcuuaucauggauccuacgaagucaagccaucuggcagcgccaguuccauggugaauggcguggucaagcuacuuacuaaacccugggacguuaucccuauggugacccaaaucgcaaugacagauaccacuccauuugggcagcagcggguauucaaggagaaaguggacacgagaacacccaaggccaaacgcggaaccgcucaaauuauggaagucacugcgagguggcugugggguuuucucagccgaaacaagaagccgcggauauguaccagagaggaguucacaaggaaagugcgcucuaaugccgcaaucggcgcuguuuuuguggacgagaaccaguggaacucagccaaggaggcagucgaagaugagcguuucugggaccuggugcagaaagaacgggaguugcacaagcaggggaaaugcgccacgugcguauauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguugagggggagggacugcauaaguuggguuacauccuccgggacauuucgaaaaucccuggcgggaauauguaugccgaugacaccgcuggaugggauacuagaauaacagaagacgaucugcaaaacgaggccaagaucaccgacauuauggaaccagagcacgcacuacuugcuacuucaaucuuuaaacugacauaccagaauaagguggucagggugcagcgccccgccaagaacggcaccgugauggaugucauuagcagacgggaccagagggguuccgggcaaguuggaacauauggccucaauacuuucaccaacauggaagcucagcugauccgucagauggagagugagggcauauuuuugccuucugaauuagagacgccaaaccuggccgaacgagugcucgauuggcuugagaaacaugggguagaacgccugaagagaauggcaauuagcggagacgacuguguggucaaacccaucgaugaccgguucgcgaccgcccuaacagcucugaaugauauggguaaggugaggaaagacaucccgcagugggagccuuccaagggcuggaacgauuggcaacagguucccuuuugcucacaccacuuccaucagcucauuaugaaggacgggcgcgagauaguggucccauguagaaaucaggaugaauuggugggacgggccaggguaagucaaggcgcagguuggucucugcgagagacugcuugccuugggaaaagcuacgcccagauguggcagcugauguauuuucaccguagagaccuccgcuuagcagccaacgcgaucuguuccgcuguuccuguggauuggguccccaccucacggacaacuuggagcauucaugcccaccaucaauggaugaccacggaagacaugcugucuguguggaauaggguuuggaucgaggaaaacccauggauggaggauaagacacacguguccaguuggggagacguccccuacuugggcaaaagagaggaccaguggugcggcagccugauugggcucaccgcacgcgccacuugggcuucgaauauccagguggccauaaaccagguacggaggcuuaucggaaaugaaaacuaucuggauuacaugacauccaugaagcgauucaaaaaugagggugacccugaaggcgcacuaugguga

SEQ ID NO: 13825 - RNA, 9879 nt, Artificial Sequence
  derived and/or modified CDS sequence (opt3) from DENV-1__FJ898391__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuacuauugcgcggggcugaaaaagguuaccgaagugaaaggauacacaaagggcgguccugggcacgaggaacccaucccgauggcuacguacggauggaaccucgucaaauuacauucaggcaaggacguguucuuuauaccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuauaugccgucuguuguagagaccuuggagcaaaugcagcggaaacacgguggcaugcuggugcgcaacccccucaguagaaauuccacucaugaaauguacugggucagcugcgggacaggaaacaucgugucagcaguuaauaugaccuccaggaugcuucugaaccgauuuacgauggcccaccggaagccaaccuaugagcgugauguggacuuaggcgcugguacaagacacgucgccguggaaccugagguagcaaaccuggauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgacaugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacacggcuggaugggauacccggauaacugaagacgaucugcagaacgaggccaagaucacagacauuauggaaccugagcacgcuuugcucgccaaguccaucuucaaacugaccuaucagaauaagguaguuagagugcaaaggccagccaagaacggcacugucauggaugugauuagucgcagagaccagcgggguucuggacaggugggaacauacggccuaaauaccuuuacaaacauggaagcgcagcuuaucaggcaaauggagagcgagggcauauucucccccucagaacuggagacuccuaaccucgccgggcguguccuggauugguuggaaaagcauggaguugagcgauuaaaacgcauggcuauuaguggugacgacugugugguaaagccaaucgaugacagauuugccaccgcacugacggcucucaaugauaugggcaaggugcggaaagacaucccccagugggaaccgucuaagggguggaacgauuggcagcaggucccuuucugcagccaccacuuucaucaacuuauuaugaaagacggaagggagauagugguucccugucgcaaucaggaugagcuggugggcagagcccgggucucccagggugcaggguggucacuaagggaaaccgccugccugggaaagagcuaugcgcagauguggcaacucauguacuuccaccgacgugacuugagacuggcugccaacgcaaucuguucugccgugccaguagauuggguuccuacaucccgcacuaccuggaguauucaugcucaccaucaguggaugacaacugaggacaugcuuagcguguggaaucgggucuggaucgaagagaaccccuggauggaagauaaaacccacauuucguccuggggcgacgugccauaucugggcaagagggaggaccaguggugcgggucucucaucggauuaacggccagagcaacaugggcuaccaauauacaaguugccaucaaccaggugcgccggcugauugguaaugagaacuacuuggauuacaugacuucaaugaagagguuuaaaaaugaaagcgaccccgagggcgcgcugugguga

SEQ ID NO: 13826 - RNA, 9879 nt, Artificial Sequence
  derived and/or modified CDS sequence (opt3) from DENV-1__FJ898392__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaaaagcuggccacugaacgaaggcauaauggccguggggguugugucgauccuacugucaucucuucucaagaacgacgucccccuggccggaccuuugauugcuggcgguauguuaaucgcauguuaugugauuaguggguccagcgccgaucugucucucgagaaagcggcugagguaagcugggaagaggaagccgagcacuccggagcaucacauaauauccugguggaaguccaggacgauggcaccaugaagauaaaagacgaggagagggaugacacucuuacaauucuguugaaggccacccuacuggcuguuaguggcguguacccccucagcaucccagcaacgcuguucgugugguauuuuuggcaaaagaaaaagcagcgaucugggguccuuugggauacuccuucacccccagaaguggagcgcgccguuuuagacgauggaaucuaccggauuaugcagagaggucugcucggcaggagccagguaggggugggagucuuccaagaaaacguguuccacaccauguggcacguuacacguggcgcgguguugauguaucaggguaaacgccuggagccgaguugggcuagcgucaagaaagaccucauauccuacgggggaggcuggcggcugcagggcucuuggaauaccggggaggaagugcagguaaucgccgucgagccuggaaagaaccccaagaaugugcaaacagcaccagguacuuuuaaaacccccgaaggcgagguuggggccauugcucuugacuucaagccuggaacgucgggcagcccaaucgugaacagagaagguaaaauugucgggcuguacggaaauggcgugguuacaacuucaggcaccuauguguccgccaucgcacaggcuaaggccagucaggaggggcccuugccugagauagaagaugaggucuuuaggaaacgaaaccuaacaaucauggaccugcauccgggaucugguaagacccggcgcuaccucccagcgauugugagagaagccaucaagaggaaauuacggacucugauucuugcacccacccgaguaguggcuagcgagauggccgaagcucugaagggcaugccuaucagauaucaaacaacggcaguuaaauccgagcacacugggaaggagauagucgaucucaugugccaugccaccuucacaaugcgcuugcugucaccagugagggugcccaauuacaacaugauuaucauggacgaagcccacuuuaccgauccuucuagcaucgcugcgcguggauauauuaguacucgggucggcaugggugaggcagccgcuaucuucaugacagccaccccgcccggguccguagaagcauuuccacagagcaaugccgugauacaggacgaggaaagagauauuccugagaggucuuggaacucaggauacgaguggaucacggacuuccccggcaaaacuguuugguuugugccauccauuaagaguggcaaugauaucgcuaacugucuccgcaagaaugggaaacgagucauacagcugagcagaaagacauucgacaccgaauaucagaaaaccaagaacaacgauugggacuacgugguuacuacagacauuucggagaugggagcgaauuuucgggccgauagggugaucgacccucgccguugccuuaaacccgucauccuaaaggaugguccagaaagagugauucuggcaggcccgaugccuguaaccguggcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuucgaaccugagagagaaaaguccgcggcaaucgacggcgaguaccggcugaggggagaggcccgcaaaacguucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagaucuggaccaaagagggugaacgaaagaaacugagacccagguggcuagaugcccggacauauucugacccucuggcucuccgcgaguuuaaggaguucgcagccggcagaagguccguuagcggggaccuuauucuggagauaggaaaguuaccgcagcauuugacucagcgggcucaaaaugcccuggauaaccucgugaugcugcacaauucagaacagggcggucgagcauacagacaugcgauggaggagcuuccagacaccaucgaaacacugaugcucuuggcccugauugcuguauuaaccgggggcgugacucuauuuuuccugaguggacgcggccucgggaaaacgagcaucggacuucugugugucauggccuccucuguguugcuguggauggcaagcguugagccccacuggauugcugccuccaucauacucgaauuuuuccugauggugcuucucaucccugagcccgauaggcagcggaccccacaggacaaccaacuggcauaugucguaauugguuugcuguuuaucauuuuaacaguggccgcuaaugagaugggccuacuggaaacuaccaagaaagaucucgggaucggacacguugcgguggagaaccaucaccaugccacaaugcuugacgucgaucugcacccugcaucagcuuggaccuuguacgccguggccacuacaauaauuacgcccaugaugcgucauaccaucgaaaacacuacagcaaauauuucucugaccgcuaucgccaaccaggcggcuauacucaugggccuggacaaggguuggccaaucaguaaaauggauauuggggucccucuuuuagcccugggcugcuacagccaggugaauccgcucaccuugacagcagccguucugaugcuaguggcucacuaugcaaucauuggacccggccugcaagccaaggcgacuagagaggcucagaagaggacggccgcagggaucaugaaaaacccaaccguagacggaauaguggccauugaucucgacccugucguuuacgaugcuaaguucgaaaaacagcuuggccagaucaugcuguugauccuguguacaagccaaauucuccugaugcgcacuaccugggccuuaugcgaguccaucacacuugcaaccgguccccugacuacgcucugggaggggucuccaggaaaguuuuggaauacaaccauagcugugucaauggccaacauuuuccggggcagcuaucuagcgggugccggccuggcauuuuccuugaugaaaagucuagggggaggccgaagagggacuggagcucagggcgaaacccucggugagaaguggaagaggcagcuuaaucagcugucuaaaagcgaguucaacaucuacaagcgcucagggauuauggaggucgaccgguccgaagccaaagagggauugaagagaggcgagacaacucgucacgcagugaguagggguaccgcuaaacugcggugguucguagaacgcaaucucgugaagccugagggcaagguuaucgacuuaggguguggacgaggcggguggagcuauuacugcgccggacugaaaaaggugacagaagucaaaggcuauacgaagggugggcccggacaugaggaaccgauaccaauggccaccuacggcuggaaccuugugaaacugcacucuggcaaggaugucuuuuucacuccucccgagaaaugugacacacuacucugcgauaucggggaguccucaccaaaucccaccauugaagagggaagaacucugaggguguugaagaugguugaaccuuggcugcgggguaaccaauuuuguaucaagauucucaauccguacaugcccagcguaguggagacacuugagcagaugcagcgcaaacauggcgggaugcuggucagaaacccauuaucgagaaauucuacccacgaaauguauugggugaguugcggaacgggcaacaucguuuccgcggugaauaugaccagccgaaugcuguugaaccgguucacaauggcucaccguaagccuacuuacgagagagacgucgaucucggugcagggacccgccauguggccguagaacccgagguggcuaaccuggacauuaucggacagaggauagaaaauauuaaacacgagcauaagucaacauggcacuaugaugaggacaacccuuacaaaacuugggccuaucauggcuccuacgaaguuaagccaucuggcagcgcaaguuccauggucaaugggguggugaagcuacuuaccaaacccugggaugucaucccuaugguuacacaaaucgccaugaccgacacuacgccauuuggacagcagcggguguucaaggagaaaguagauacaagaacccccaaggcuaaacgcgguacugcgcaaauuauggaagugaccgccagguggcuguggggcuuucucagccgaaacaagaagccgcggauauguacaagagaggaguucacgaggaaaguccgcucuaaugcagcuaucggggccguguuuguugacgagaaccaguggaacucagcaaaggaggccguggaagacgagcguuucugggaucugguccagaaagaacgggaguugcacaagcagggaaaaugcgcuaccugcguguauaacaugaugggcaagagagaaaagaaacugggugaguuugggaaggccaaaggaaguagggcgauuugguacauguggcucggcgcacgcuuccuugaguuugaagcccugggcuucaugaaugaggaccacugguucucccgagaaaacagcuuaucugggguagagggagagggucugcauaaguugggcuacauccuccgggauauuucgaaaaucccugggggaaauauguaugcugacgauacugccggcugggacacaagaauaaccgaagaugaccugcaaaacgaggcaaagaucacugauauuauggaaccagagcacgcucuacuugccacaucaaucuuuaaacugaccuaccagaauaagguugugaggguccagcgccccgcuaagaacgguacagugauggacgugauuagcagacgggaucagaggggguccggacaagucggcacuuauggccucaauaccuucacgaacauggaagcccagcugauccgucagauggagagugaggggauauuuuugccuucugaauuagagaccccaaaccuggcagaacgaguucucgacuggcuugagaaauacggaguggaacgccugaagagaauggcgauuagcggugaugacuguguagugaaacccaucgacgaucgguucgccacagcucuaacugcccugaaugacaugggcaaggucaggaaagauaucccgcagugggagccuuccaagggguggaacgacuggcaacaggugcccuuuugcucacaucacuuccaccagcucauuaugaaggauggacgcgagauaguugugccauguagaaaucaggacgaauuggucggccgggcaagggugagucaaggugcuggguggucucugcgagagaccgccugccuuggaaaaagcuaugcacagauguggcagcugauguacuuucaucguagagaucuccgcuuagccgcgaacgcuaucuguuccgccguaccuguugacugggugcccacaucacggacuaccuggagcauucacgcacaucaccaauggaugacgacagaagauaugcugucugucuggaauaggguguggaucgaggaaaacccauggauggaggacaagacccauguuuccaguuggggcgaugugcccuauuugggcaaaagagaggaccaguggugcgggagccugauuggacucacugcccgcgcuacaugggccucgaauauccaggucgcaauaaaccaggugcggaggcuuaucgguaaugaaaacuaccuggacuacaugaccuccaugaagcgauucaaaaaugagggcgauccugaaggggcucuaugguga

SEQ ID NO: 13827 - RNA, 9879 nt, Artificial Sequence
  derived and/or modified CDS sequence (opt3) from DENV-1__FJ898393__SS-prME
agcgugaccaugcugcucaugcuuaugcccacagcacuggcuuuccacuugacuacgagaggcggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaggaacaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaagggccugggaggagggcgugugcgguauucgguccgcaacacgccuggaaaacauaauguggaagcagaucucuaacgagcucaaucauauucuguuagaaaacgacaugaaauucaccguagucgugggcgauguuguggggauccuggcucagggaaagaaaaugauuagaccucaacccauggagcacaaguacucguggaaaagcuggggcaaggccaagaucauaggggcggacguccagaauacuaccuuuaucauugauggaccaaacacaccugaaugucccgacgaucagagggccuggaauaucugggagguggaggacuauggcuucgguauuuuuacuaccaacaucuggcuuaaauugcgugauuccuacacacagguuugcgaccaccggcucaugucagcugcaauaaaggauaguaaagccgugcaugcugacaugggguauuggauugaaucugagaagaaugaaacguggaaacuggcccgagcauccuucaucgagguaaagaccuguauuuggccaaagucccacacucuauggucaaacggaguccuggaaagcgagaugaucauacccaaaaucuacggcgguccuauuucucaacauaauuauagaccaggcuacuucacacagaccgcggggccguggcaccucggaaagcuggagcuugauuuugacuugugcgaaggcacuacagugguggucgaugagcacugcgggaacaggggacccucccugcgcaccacgacuguuaccggcaaaaucauucaugaaugguguugccggaguuguacauuaccuccacucagauucaagggugaggacgggugcugguacggaauggagaucaggcccgugaaagaaaaggaggaaaaucugguaaagagcauggugucugccggcuccggugaggucgacucauuuagucuuggccuguuguguauaagcauuaugaucgaagaggugaugcgcucgcgauggucccggaaaaugcucaugaccgggacucuggcuguuuuccuacugcucaucaugggacagcugacauggaacgaucuuauucguuugugcaucauggugggcgccaaugcaucugacagaauggggaugggaaccacauaucuggcuuuaauggccacuuuuaagaugaggccuauguucgcagucggccuccuguuucgccggcuuaccagcagagaggugcugcuacucacgauuggucugucauugguugccaguguggaacugccaaacuccuuagaggaacucggggauggacuggcuaugggcauaaugauccuuaaacuguugacagacuuccaaucucaccagcucugggcgacccugcuaagccugacuuuuauuaagaccacacuuucccuccauuacgccuggaaaacuauggcaaugguccugucaaucgcuagcuuguucccccuguguuuaaguaccacgucucagaagacaaccuggcucccgguacugcuuggcucccuggggugcaagccuuugacuauguuucucauuacagagaccaaaaucuggggaagaaagagcuggccacugaaugaagguauaauggccgugggcguugugucgauccuacugucaucucuucucaaaaacgaugucccccuggccgggccuuugauugcuggaggcauguuaaucgcauguuaugugauuagugguuccagcgccgaccugucucucgagaaggcggcugagguaagcugggaagaggaagccgagcacuccggggcaucacauaacauccugguggucguucaggaugacggaacuaugaaaauaaaggaugaggaacgagacgauacacuuaccauucuguugaaagccacgcuacuggcugugaguggcguguacccccucagcaucccagcaacucuguucgucugguauuuuuggcaaaagaagaaacagcgcucuggcgugcuuugggacaccccuucacccccagagguugaacgggccguauuagaugacgggaucuacagaauuaugcagaggggacugcucggucguagccaggugggcgucgggguguuccaagagaauguuuuccacacaauguggcacgugacccgcggagcggucuugauguaucagggcaagcggcuggaaccgaguugggcuagcgugaaaaaggaccucauauccuacggugggggauggagacugcagggcucuuggaacacaggcgaggagguacaggucaucgccguggaaccugggaaaaaucccaagaacguucaaacugcaccaggaaccuuuaagacgcccgagggugaagugggcgccauugcucuugauuucaaaccugggacaucgggaagcccaaucgucaauagggagggcaagauugugggucuguacgggaacggaguugugacuaccucaggcacauaugucuccgccaucgcacaggcuaaagccagucaggaaggccccuugccugagauagaggacgaaguguuucgaaagcggaaucuaaccaucauggaucugcauccggggucuggaaaaacucgcagauaccucccagcgauuguaagggaggccaucaagcggaaguuacgaacccugauucuugcacccacaagagugguugcuagcgaaauggccgaggcucugaaagguaugccuauccgcuaucaaacgacugcagucaaguccgaacacaccggcaaagagauaguggaccucaugugccaugccacauucaccaugagguugcugucaccagugcguguccccaacuacaauaugauuaucauggaugaggcccacuuuacugacccuucuagcaucgcugcgcggggguauauuaguacaagaguaggaaugggcgaagcagccgcuaucuucaugaccgccacgccgcccgguuccguggaggcauuuccacagagcaacgccguuauacaggaugaagagagggacauuccugaacgcucuuggaacucaggguacgaguggaucacugauuuccccggaaagacagugugguuugucccauccauuaaaaguggcaacgacaucgcuaauugucuccgaaagaacggcaagagagugauacagcugagccggaaaaccuucgauaccgaguaucaaaagacuaaaaauaacgacugggacuacguugugacaaccgauauuucggaaaugggggcgaacuuuagggccgaccgcgucaucgauccucguagaugccuuaagcccgugauccuaaaagacggaccagagcggguaauucuggcagguccgaugccugugacaguugcuucugccgcacagaggcgcggccgaaucgggagaaaucauaacaaggaaggagaucaguacauuuauaugggccagcccuugaauaacgacgaggaucacgcccacuggacugaggcuaagauguuacuggacaauauaaacacgccagaagguaucauucccgcccucuucgagccugaacgggagaaauccgcggcaaucgauggggaauacaggcugcgcggcgaggccagaaagaccuucgucgagcuuaugaggcggggagaccugccaguguggcucagcuauaaaguggcuucagaaggcuuucaauacagugaucgucgcuggugcuucgacggggagcgaaauaaccaggucuuggaagagaauauggauguugaaaucuggacaaaggagggagagaggaaaaagcugaggccccgguggcuagacgcccgcacuuauucugacccucuggcucucagagaauuuaaagaguucgcagccgguaggcgguccgugagcggcgaucuuauucuggaaauagggaaguuaccgcagcauuugacccagcgagcucaaaacgcccuggacaaucucguaaugcugcacaacucagagcagggaggcagagcauaccgccaugcgauggaggaacuuccagauacaaucgagacccugaugcucuuggcccugauugcuguguuaacugguggggucacgcuauuuuuccugaguggcaggggacucggcaagaccagcaucgggcuucugugugugauggccuccucuguuuugcuguggauggcaagcguggaaccccacuggauugcugccuccaucauacucgaguuuuuccugaugguccuucucaucccugaacccgaccggcagcguacaccacaggauaaucaacuggcauauguagugauuggauugcuguuuaugaucuuaacuguugccgcuaacgagaugggucuacuggagaccaccaaaaaggaccucggcauugggcacguggcggucgaaaaucaucaccaugccaccaugcuugauguggaccugcacccugcaucagcuuggacuuuguacgccgucgccacaacgaucauaacccccaugaugagacauacuauugagaacacaaccgcaaacaucucucugaccgcuauugccaaucaggcggcuauccucaugggacuggauaaaggcuggccaauaaguaagauggacaucggugugccucuuuuagcccuggggugcuacucgcagguuaacccgcucacauugacugcagccgugcugaugcuaguagcucacuaugcaauuaucggccccggacugcaagccaaagcgacgagggaagcucagaagcgcaccgccgcaggcauuaugaagaauccaacaguggaugggaucgucgccauagaccucgauccuguuguguacgacgcuaaauucgagaagcagcuuggacagauuaugcuguugauccuguguacuagccaaauccuccugaugcggaccacaugggccuuaugcgaauccauuacccuugcaacuggcccccugacgacacucugggaggguucuccagggaaauuuuggaacaccacuaucgcugucucaauggccaauauauuccgaggaagcuaucuagcgggcgccggucuggcauuuuccuugaugaagagucugggcgggggaagaaggggcaccggggcucagggagagacacucggcgaaaaauggaagcgccagcuuaaccagcugucuaagagcgaguucaauauuuacaaacggucagguaucauggaaguggacagauccgaggccaaggaaggguugaaacguggagagacuaccaggcacgcaguaagucggggcacagcuaagcugcgcugguucguggagcgaaaccucguuaaaccugaagguaaggugauugauuuaggcugugggagaggaggcuggagcuauuacugcgccgggcugaagaaagucacggaggugaagggauauaccaaaggcggucccgggcaugaggaaccgaucccaauggccacuuacggauggaaucuugucaagcugcacucuggcaaagacguguuuuucacaccucccgaaaagugugauacccuacucugcgacauaggcgaguccucaccaaaccccacuaucgaggaagggaggacacugcggguuuugaaaaugguagagccuuggcugcgcggaaaucaauuuuguauuaagauccucaacccguacaugcccagcguggucgaaacccuugagcagaugcagagaaagcaugguggcaugcuggugaggaauccauuaucgcgaaacucuacgcacgagauguauuggguuaguugcgggaccggaaauauuguguccgcggucaacaugacaagccggaugcuguugaaucguuucacuauggcucacagaaaaccuaccuacgaacgcgauguggaccucggcgcagguacaaggcauguagccguggagcccgaaguugcuaaccuggauaucauugggcagcggaucgagaacauaaagcacgaacauaaaucaacuuggcacuaugacgaggauaauccuuacaagaccugggccuaucauggauccuacgaggucaaaccaucuggcagcgcaaguuccauggugaacggcguggucaagcuacuuacaaagcccugggacguuauuccuauggugacccaaaucgccaugacugauacgacaccauuugggcagcagagaguauucaaagaaaagguggacacccgcacucccaaagcuaagaggggaaccgcgcaaaucauggaggucacagcccgauggcugugggguuuucucagccggaauaaaaagccgagaauuuguacgagggaagaguucacccgcaaggugcguucuaacgcagcuauaggcgccguuuuuguggacgaaaaucaguggaacucagcaaaagaggccgucgaggaugaacgguucugggaccuggugcagaaggagagagaauugcacaaacaggggaagugcgcuacuugcguauauaauaugaugggaaaaagggagaagaagcugggcgaauuugguaaagccaaggggagucgcgcgaucugguacauguggcucggagcacgauuccuugaguuugaggcccugggcuucaugaacgaagaucacugguucucccgggagaauagcuuaucuggcguugaaggggagggacugcauaaauuggguuacauucucagagacaucucgaagauuccuggcgggaacauguaugcugaugacacagccggaugggauaccaggaucacugaggacgaucugcaaaaugaagcaaaaauaacagacaucauggagccagaacacgcucuacuugccaccucaauuuuuaagcugacauaccagaacaaagugguccgcgugcagagacccgcuaagaauggcacugugauggaugucaucagccggagggaccagcgugguuccgggcaaguuggaaccuauggccucaacacguucaccaauauggaggcccagcugauucgacagauggaaagugagggcaucuuuuugccuucugaguuagaaacaccaaaccuggcagagcgcgugcucgauuggcuugaaaaguacgggguagagagacugaaacggauggcgauaagcggagacgacuguguggucaagcccauugaugacagguucgccacugcucuaaccgcccugaacgauauggguaaagugcgcaaggacaucccgcagugggaaccuuccaaaggcuggaaugauuggcaacagguucccuuuugcucacaucacuuccaccagcucaucaugaaggacgggagagagauuguggucccaugucggaaccaggaugaguuggugggaagggcacgaguaagucaaggcgcugguuggucucugcgugaaacagccugccuuggaaagagcuaugcacagauguggcagcugauguacuuucauagacgcgaccuccgguuagccgcgaaugcuauauguuccgccguuccuguggauuggguccccacuucaaggaccacguggagcauccacgcacaucaccaauggaugacaaccgaggacaugcugucuguguggaacagaguuuggauugaagagaauccauggauggaagauaaaacucauguguccaguuggggagacguccccuauuugggcaagcgcgaggaccaguggugcggcagccugaucgggcucacagcccgggcuaccugggccucgaacauucagguggcaaucaaucagguaaggcgacuuauaggaaacgagaauuaccuggauuacaugacuuccaugaaaagauucaagaacgaaggugacccugagggcgcucuaugguga

SEQ ID NO: 13828 - RNA, 9879 nt, Artificial Sequence
  derived and/or modified CDS sequence (opt3) from DENV-1__FJ898394__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuccucaagagacauggaaucggcaggaccuguuggugaccuucaaaacagcucacgccaagaagcaggaaguaguugugcucgguagccaagagggggcuaugcacacugcccugaccggcgcaacggaaauccagaccaguggaacaacuaccauuuuugccggccauuuaaaaugccgucugaagauggauaaacuaacacucaaggggaugucuuaugucauguguacuggauccuucaaacuggagaaggaaguggcugagacccagcacgguacgguccuugugcagauaaaguacgagggcacagacgcgccaugcaaaauccccuucagcacccaagaugaaaaggggguuacucagaacggacgcuugauuacagcaaauccuaucgugaccgacaaagagaagccaguaaacauagaagccgagcccccguuuggcgagucguauauugucaucggugcuggggaaaaagcccugaagcucucuugguucaagaaaggcuccucaaucggaaagauguuugaggcaacugccagaggcgcuaggcggauggccauucugggggauaccgcaugggacuucggaaguaucgguggcguguuuacaagcguugggaaacuugugcaucagauuuucggaacggcguacggcguccuguuuuccggugugucuuggaccaugaagauagggaucggcguauugcucacuuggcugggauuaaauagccgaucaacaagucuguccaugaccuguauugcugugggccuaguuacacucuaccugggggucauggugcaggccgauagcggaugcgugaucaacuggaaaggccgcgaacuuaagugugguucugggaucuucgucacuaaugagguucacaccuggacggaacaauauaaguuucaggcagacucaccuaaaagauugagugccgcuauuggaaaggccugggaggagggcgugugcgguauaaggagcgcaacacggcuggaaaacaucauguggaaacagauuuccaacgagcucaaucauauccuguuagaaaacgacaugaaguucaccgugguagucggcgaugugguugggauucuggcucagggaaaaaagaugauccgcccccaaccaauggagcacaaauacucuuggaagucguggggcaaggccaaaauaaucggggcggacgugcagaauacuaccuuuauuaucgauggaccuaacacacccgaauguccagacgaucagagagccuggaauauuugggaggucgaggacuauggcuucgguaucuuuacuaccaacauauggcuuaaguugagggauagcuacacacaggugugcgaccaccgucucauguccgcugcaauuaaagauucaaaggccguucaugcugacaugggguauuggaucgaaagugagaaaaaugaaacguggaagcuggcccgggcaucuuucauugaggugaagaccuguaucuggcccaaaagccacacucuaugguccaacggaguacuggaaucagagaugauaaucccuaagauuuacggcgguccaaucagccaacauaauuaucgaccgggcuacuucacacagaccgcggggcccuggcaccucggaaaacuggagcuugauuuugacuugugcgaaggcacuacagucgugguggaugagcacugcgggaacagaggaccuucucugaggaccacgacugucaccggcaagauuauccaugaaugguguugccgcuccuguacauuaccaccccuccgguucaaaggugaggacgggugcugguacggaauggagauaagaccuguuaaggaaaaggaggaaaaucuggugaaaaguaugguaagcgccggcucuggugagguggacuccuuuucacuuggccuguuguguauuaguaucaugaucgaagaggucaugaggagccgcuggucgcgaaagaugcucaugaccgggacucuggcuguguuccuacugcucauuaugggacagcugacauggaacgaucuuauccgguugugcauuaugguuggcgccaauguguccgaccguauggggaugggaaccacauaucuggcauuaauggcuacuuuuaaaaugagaccaauguucgccgucggccuccuguuuaggcgccuuaccucucgggaggugcugcuacucacgauaggucugagcuugguugcaucaguggaacugcccaacaguuuagaggaacucggggauggacuggccaugggcaucaugauucuuaagcuguugacagacuuccaaucccaccagcucugggcuacccugcuaucucugacuuuuaucaaaaccacacuuagccuccauuacgcguggaagacuauggccaugguccuguccauuguaucauuguucccgcuguguuuaagcaccacgagucagaagacaaccuggcucccugugcugcuuggcucucuggggugcaaaccauugacuauguuucucaucgcagagaauaagauauggggaagaaaauccuggccccugaacgaagguaucauggcuguuggcguggucagcauucuacugucgucacuucucaagaacgaugugccucuggccgggcccuugaucgccggaggcauguuaauugcuuguuauguaaucucugguaguuccgcagaccugagccucgagaaagccgcggaggugucuugggaagaggaagcugagcacagcggggccucccauaauauacuggucgaaguucaggaugacggaacaaugaagauuaaagaugaggagagggacgauacccuuacuauccuguugaaggcaacacuacuggccgugucaggcguguacccacucaguaucccugcuacccuguucgucugguauuuuuggcaaaagaaaaagcagcgaagcggcgugcuuugggacacgcccucuccaccggaaguugagcgcgcaguauuagaugacgggauuuaccggauaaugcagagaggacugcucgguaggucccaggugggcgucgggguguuccaagaaaacguuuuccacacuauguggcacgugacccguggagccgucuugauguaucagggcaaacgccuggagccuucaugggcgagugugaagaaagaccucaucagcuacggugggggauggcggcugcagggcuccuggaauacaggcgaggaaguacaggucauugcuguggagcccgggaagaacccaaagaauguucaaaccgcccccggaacauuuaaaacuccugaaggugaggugggcgcaaucgcccuugauuucaagccagggaccucuggaucgcccauugucaacagagaaggcaaaaucgugggucuguacgggaauggaguugugacgacaagcggcacuuaugucucagcuauagcccaggcaaaggcuucccaggagggcccuuugccggagaucgaagacgagguguuuaggaaacgaaaccuaaccauuauggaucugcauccagggaguggaaagacacggcgcuaccuccccgccaucguaagagaagcgauuaagaggaaauuacggacccugauccuugccccuacucgagugguugcaucugagauggcugaagcccugaaggguaugccaauaagauaucaaaccacagcugucaaaagcgagcacacgggcaaggagauuguggaccucaugugccaugcaacuuucaccaugcgcuugcugucccccgugagggucccuaauuacaacaugaucaucauggaugaagcccacuuuacagacccgucaucuauugccgcucguggguauaucagcacccggguaggaaugggcgaggcggcagccauauucaugacugcuacacccccagguaguguggaagccuuuccucaguccaaugcaguuauucaggaugaggaaagagacauccccgagaggagcuggaacucuggguacgaguggauuaccgauuucccaggaaaaacggugugguuugucccuucaaucaaguccggcaaugacauagccaacugucuccgcaagaauggcaaacgagugauucagcugaguagaaagacuuucgauacagaauaucaaaaaaccaagaacaacgacugggacuacguugugaccacugauaucagcgagaugggggcuaauuuucgggcggacagggucaucgauccccgccguugccuuaaaccagugauucuaaaggacggaccggaaagaguaauccuggccgguccuaugcccgugacaguugcaucggcugcccagcggaggggccgcauugggcgaaaccauaauaaggagggagaucaguacauauauaugggccagccauugaacaaugacgaggaucacgcacacuggaccgaagccaaaauguuacuggacaacaucaauacacccgaggguauuaucccugcucucuucgaaccagagagagaaaagucugccgcgaucgauggggaguaccggcugaggggcgaggcacgcaaaacuuucgucgaacuuaugagaaggggagaccugcccguguggcucuccuauaagguggccagcgagggcuuucaauacucagaucggcguuggugcuucgacggggaacgcaacaaucaggucuuggaggaaaacauggauguugagauuuggacgaaagagggagaacgaaagaaacugagaccuagguggcuagacgcucggaccuauagugacccgcuggcccuccgcgaguuuaaggaauucgcugcagguagaaggucuguguccggcgaucuuauacuggagaucgggaaguuaccacagcauuugacacagcgggcccaaaaugcucuggacaaccucguaaugcugcacaauagcgaacagggaggccgagccuacagacaugcaauggaggagcuucccgauacuauugaaacccugaugcucuuggcgcugaucgccguguuaacagguggggucacccuauuuuuccugucaggccgcggacucggcaaaacuaguauugggcuucugugugugauggcuagcuccguuuugcuguggauggccucuguggagccucacuggaucgcagcuagcauaauccucgaauuuuuccugaugguccuucucauucccgagccagacaggcagcggacgccucaggauaaccaacuggccuauguagugaucggauugcuguuuaugauuuuaaccguugcagccaaugagaugggucuacuggaaacaacuaagaaagaccucggcaucgggcacguggcugucgagaaccaucaccaugcgaccaugcuugauguggaccugcaccccgccuccgcauggacauuguacgcugucgccaccacuauaauuacaccaaugaugcgucauacgaucgaaaacaccacugccaauauuucacugacagcaaucgcuaaccaggccgcgauacucaugggacuggauaagggcuggccuaucucuaaaauggacauuggugugccgcuuuuagcucuggggugcuacagucagguuaauccccucaccuugaccgccgcagugcugaugcuaguagcccacuaugcuaucauuggcccaggacugcaagcaaaggccacaagagaggcgcagaagaggacugcugccggcaucaugaaaaacccuacgguggaugggauagucgcaauugaccucgaucccguuguguacgacgccaaguucgaaaaacagcuuggacagaucaugcuguugauccuguguaccucgcaaauucuccugaugcgcacaacuugggcuuuaugcgagagcaucacccuugccacaggcccacugaccacucucugggaggguuccccugggaaguuuuggaauacgacaauagcagucucuauggcuaacauuuuccggggaucauaucuagccggcgcgggucuggccuuuagcuugaugaaaucccugggcgggggacgaagaggcaccggggcacagggagaaacucucggcgagaaguggaagaggcagcuuaaucagcugaguaaaucugaauucaacaucuacaagcgcagcgguauuauggagguggaccggucagaagcuaaagagggguugaagagaggagagaccacacgucacgccguauccaggggcacugcaaaacugcggugguucguggaacgcaaucucguuaagcccgaggguaaggugaucgauuuaggcugugggcgaggaggcuggaguuauuacugcgcugggcugaaaaaggucaccgaagugaaaggauauacaaagggcgguccggggcaugaggaaccaauaccuauggccacguacggauggaaccuugucaaacugcacagcggcaaggacguguuuuucacccccccagagaaaugugauacucuacucugcgacaucggcgagucuucccccaauccuacaauugaagaggggagaacccugaggguuuugaagaugguagaaccguggcugcggggaaaccaauuuuguaucaagauucucaaucccuacaugccaucaguggucgagacucuugagcagaugcagcgcaaacaugguggcaugcuggugagaaacccuuuaagcaggaauucgacacacgaaauguauuggguuucuugcgggaccggaaacaucgugagugccgucaauaugacgucccgaaugcuguugaaccgguucaccaugacacaccguaagcccacuuacgagagagauguggaccucggcgcggguacccgccauguagcuguggaaccugagguugcaaaccuggauauuaucgggcagaggauagaaaauauuaaacacgagcauaagagcacauggcacuaugacgaggauaacccauacaaaacuugggccuaucauggaucauacgaagucaagcccuccggcucugcuagcaguauggugaauggcguggucaagcuacuuaccaaaccuugggacguuaucccaauggugacacaaaucgccaugaccgauacuacgcccuuugggcagcagcggguauucaaggagaaaguggacacaagaaccccgaaggcaaaacgcggaacugcccaaauuauggaagucaccgcuagguggcugugggguuuucucucccgaaacaagaagccucggauauguacaagagaggaauucacgaggaaagugcgcagcaaugcggccaucggcgcaguuuuuguggacgagaaccaguggaauucugcuaaggaggccgucgaagaugagcguuucugggaccuggugcagaaagaacgggaguugcacaagcaggggaaaugcgcaaccugcguauauaacaugaugggaaagagagaaaagaaacugggcgaguuugguaaggccaaagggucaagggcuauuugguacauguggcucggagcccgcuuccuugaguuugaagcgcugggcuucaugaaugaggaucacugguucagucgagaaaacuccuuaagcggcguugagggggagggacugcauaaguuggguuacauccuccgggacauuucuaaaaucccaggcgggaauauguaugcagaugacacugccggaugggauacaagaauaaccgaagacgaucugcaaaacgaggcuaagaucacugacauuauggaacccgagcacgcccuacuugcaacaucgaucuuuaaacugaccuaccagaauaagguggucagggugcagcgcccugcuaagaacggcacagugauggaugucauuucaagacgggaccagagggguagcgggcaaguuggaacuuauggccucaauaccuucacgaacauggaagcccagcugauccgucagauggaguccgagggcauauuuuugccaagugaauuagagacccccaaccuggcugaacgagugcucgauuggcuugagaaacaugggguagaacgccugaagagaauggccauuucuggagacgacuguguggucaaaccgaucgaugaccgguucgcaacagcgcuaacugcccugaaugauauggguaaggugaggaaagacaucccucagugggagcccagcaagggcuggaacgauuggcaacagguuccauuuugcucccaccacuuccaucagcucauuaugaaggacgggcgcgagauaguggucccuuguagaaaucaggaugaauuggugggacgggcuaggguaucacaaggcgccgguuggagucugcgagagaccgcaugccuugggaaaucuuacgcucagauguggcagcugauguauuuucaccguagagaccuccgcuuagccgcaaacgccaucuguagcgcgguucccguggauugggucccaacaucccggacuaccuggucaauucaugcucaccaucaauggaugacgacagaagacaugcugagcguguggaauaggguuuggaucgaggaaaaccccuggauggaggauaagacccacgugucuuccuggggagacgucccuuacuugggcaaaagagaggaccaguggugcggcagucugauugggcucacugcccgcgcaacaugggccagcaauauccagguggcuauaaaccagguacggaggcuuaucggaaaugaaaacuaucuggauuacaugaccucgaugaagcgauucaaaaaugagggugacccagaaggcgcccuaugguga

SEQ ID NO: 13829 - RNA, 9879 nt, Artificial Sequence
  derived and/or modified CDS sequence (opt3) from DENV-1__GQ199838__SS-prME
agcgugaccaugcugcucaugcuuaugcccaccgcccuggcuuuccacuugacuacgaggggaggggagccucauaugaucgucaccaagcaggaaaggggaaaauccuuacuguuuaagacaucugcugguguuaauaugugcacucugauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuugguugauagaggcugggguaauggguguggacucuuuggcaaaggcagccugauaaccugcgcuaaguucaagugcgugacaaaauuagaggggaagauuguacaguacgaaaaccugaaauauuccgugaucgucaccgugcacacuggagaccagcaucaaguugguaaugagucaacggaacacggcacaaccgccacuauuacaccccaggcgccuacaagugagauccagcucaccgacuacggggcccuuacucuggauuguagcccaaggacaggauuggacuuuaacgaaauggugcuacugacgaugaaggagaaaucuuggcucguccauaagcagugguuccuggaucuuccgcugcccuggaccuccggcgcaucaacuagccaagagacauggaaucggcaggacuugcucgugaccuuuaaaacagcucacgccaagaagcaggaaguaguugugcuggguagucaagagggggcuaugcacacugccuuaaccggcgcaacggaaauccagaccucuggaacaacuaccauuuucgccggccaucugaaaugccgucuaaagauggauaaacucacacugaaggggauguccuaugucauguguacuggaucguuuaaacuugagaaggaaguggcugagacccagcacgguacggucuuggugcagauaaaguacgagggcacagacgcgccuugcaaaaucccauucucgacccaagaugaaaaggggguuacucagaacggacgccugauuacagcaaaucccaucgugaccgacaaagagaagccuguaaacauagaagccgagccacccuucggcgagucuuauauugucaucggugcuggggaaaaagcccucaagcuguccugguuuaagaaaggcucaaguaucggaaagauguucgaggcaacugccagaggcgcuaggcggauggccauucuuggggauaccgcaugggacuuuggaagcaucgguggcguguucacauccguugggaaacuggugcaucagauuuuuggaacggcguacggcgucuuguucucuggugugagcuggaccaugaagauagggaucggcguacuccugacuugguuaggacuaaauucacgaaguacaucccuaagcaugaccuguauugcugugggccucguuacacuguaccuuggggucauggugcaggccgauucuggaugcgugaucaacuggaaaggccgcgaauugaagugugguucagggaucuuugucacuaaugagguucacaccuggacggaacaauauaaguuccaggcagacaguccgaaaagacugagcgccgcuauuggaaaggccugggaggagggcgugugcgguauaagguccgcaacacggcucgaaaacaucauguggaaacagauuucuaacgagcugaaucauaucuuacuggaaaacggcaugaaguuuaccgugguagucggggacgugguuggcauucuugcucagggcaaaaagaugauccgcccucaacccauggagcacaaauacucguggaaaagcugggggaaggccaagauaaucggagcggaugugcagaauacuaccuucauuaucgacggcccaaacacaccugaaugucccgaugaccagagagccuggaauauuugggaggucgaggauuaugguuuugggaucuucacuaccaacauaugguugaagcucagggacuccuacacacaggugugcgaucaccgucugaugucagcugcaauuaaagacaguaaggccguucaugcugauaugggauauuggaucgaaucugagaaaaaugaaacguggaagcuagcccgggcuuccuuuauugaggugaagaccuguaucuggccaaaaucccacacucuguggucaaacggcguacucgaaagcgagaugauaauccccaagauuuacgguggcccuaucucucaacauaauuaucgaccaggguacuucacacagaccgcgggaccguggcaccugggcaaacuugaguuggacuucgaucugugcgaagggacuacagucgugguggacgagcacugcggaaacagaggccccuccuuaaggaccacgacugucaccgguaagauuauccaugaaugguguugccgcaguuguacacucccuccacugcgguuuaaaggggaggauggaugcugguacggcauggagauaagacccguuaaggaaaaggaggaaaaucuugugaaaagcaugguaucugccgguuccggcgagguggacucauucagucugggguugcucuguaccagcauuaugaucgaagaggucaugaggucgcgcuggucccgaaagaugcugaugacuggaacacuagcuguguuucugcuccugaucaugggccagcuuaccuggaacgacuugauucggcugugcaucaugguuggggccaaugcaucugaucguaugggaaugggcacaacuuauuuagcucucauggccaccuucaaaaugagaccuauguuugcagugggucugcuuuucaggcgccugacgagccgggagguccuacuccugacaauuggguugucacugguggccaguguugaauuaccaaacucccucgaggaacugggagacggccuugcuaugggcauaaugauccugaaguugcucaccgauuuucaaucucaccagcugugggcgacucuacugagccuuaccuucauuaaaacaacucucucccugcauuacgccuggaagaccauggcaaugguguugucaaucgucagccuguuucccuuaugucucaguacgacaucucagaagaccacuuggcugccgguacuucugggguccuugggaugcaaaccucucacaauguuccugauugcugagaauaagaucugggguagaaaaagcuggccacuaaacgaaggcauaauggccguggggguugugucgauccugcuuucaucucuccugaagaacgacguccccuuggccggaccuuuaauugcuggcgguaugcugaucgcauguuaugugauuaguggguccagcgccgaucucucucuggagaaagcggcugagguaagcugggaagaggaagccgagcacuccggagcaucacauaauauccuuguggaaguccaggacgauggcaccaugaagauaaaagacgaggagagggaugacacucugacaauuuugcuaaaggccacccugcucgcuguuaguggcguguacccccugagcaucccagcaacgcuuuuugugugguauuucuggcaaaagaaaaagcagcgaucuggggucuuaugggauacuccuucacccccagaaguggagcgcgccguucuggacgauggaaucuaccggauuaugcagagaggucucuugggcaggagccagguaggggugggagucuuucaagaaaacguguuccacaccauguggcacguuacacguggcgcggugcugauguaucaggguaaacgccucgagccgaguugggcuagcgucaagaaagaccugauauccuacgggggaggcuggcggcuucagggcucuuggaauaccggggaggaagugcagguaaucgccgucgagccuggaaagaaccccaagaaugugcaaacagcaccagguacuuucaaaacccccgaaggcgagguuggggccauugcucuggacuuuaagccuggaacgucgggcagcccaaucgugaacagagaagguaaaauugucggguuguacggaaauggcgugguuacaacuucaggcaccuauguguccgccaucgcacaggcuaaggccagucaggaggggccccuaccugagauagaagaugaggucuucaggaaacgaaaccugacaaucauggaccuccauccgggaucugguaagacccggcgcuacuuaccagcgauugugagagaagccaucaagaggaaacugcggacucuuauucuggcacccacccgaguaguggcuagcgagauggccgaagcucucaagggcaugccuaucagauaucaaacaacggcaguuaaauccgagcacacugggaaggagauagucgauuugaugugccaugccaccuuuacaaugcgccugcucucaccagugagggugcccaauuacaacaugauuaucauggacgaagcccacuucaccgauccuucuagcaucgcugcgcguggauauauuaguacucgggucggcaugggugaggcagccgcuaucuuuaugacagccaccccgcccggguccguagaagcauucccacagagcaaugccgugauacaggacgaggaaagagauauuccugagaggucuuggaacucaggauacgaguggaucacggacuuucccggcaaaacuguuugguucgugccauccauuaagaguggcaaugauaucgcuaacugucugcgcaagaaugggaaacgagucauacagcuuagcagaaagacauuugacaccgaauaucagaagaccaagaacaacgauugggacuacgugguuacuacagacauuucggagaugggagcgaauuuccgggccgauagggugaucgacccucgccguugccuaaaacccgucauccugaaggaugguccagaaagagugauuuuggcaggcccgaugccuguaaccguggcuucugccgcacagcggagggggcgcaucggacgaaaccauaauaaggagggcgaccaguacauuuauaugggucagcccuuaaacaaugaugaggaccacgcccacuggacagaagcuaaaaugcugcucgauaacauaaauacuccagaggggaucauucccgcccuguuugaaccugagagagaaaaguccgcggcaaucgacggcgaguaccggcuuaggggagaggcccgcaaaacguucguugaacugaugagaaggggcgaucucccagucugguugagcuauaagguggcuucagagggguuccaauacagugaccggcguuggugcuuugauggagaacgcaacaaucaggugcuggaggaaaacauggacgucgagaucuggaccaaagagggugaacgaaagaaacuaagacccagguggcuggaugcccggacauauucugacccucucgcacuucgcgaguucaaggaauuugcagccggcagaagguccguuagcggggaccugauuuuagagauaggaaaguugccgcagcaucugacucagcgggcucaaaaugcccucgauaaccuggugaugcuucacaauucagaacagggcggucgagcauacagacaugcgauggaggagcugccagacaccaucgaaacacucauguugcuggccuuaauugcuguacuaaccgggggcgugacucuguucuuucucaguggacgcggccuugggaaaacgagcaucggacuguugugugucauggccuccucugugcugcucuggauggcaagcguugagccccacuggauugcugccuccaucauacuggaguucuuucuuauggugcuccugaucccugagcccgauaggcagcggaccccacaggacaaccaauuggcauaugucguaauuggucuguuauucaucauucuaacaguggccgcuaaugagaugggccugcucgaaacuaccaagaaagaucuugggaucggacacguugcgguggagaaccaucaccaugccacaaugcuggacgucgauuugcacccugcaucagcuuggacccuguacgccguggccacuacaauaauuacgcccaugaugcgucauaccaucgaaaacacuacagcaaauauuucucucaccgcuaucgccaaccaggcggcuauacugaugggccuugacaaggguuggccaaucaguaaaauggauauuggggucccuuuacuggcccucggcugcuacagccaggugaauccguugacccugacagcagccguucuaaugcugguggcucacuaugcaaucauuggacccggccuccaagccaaggcgacuagagaggcucagaagaggacggccgcagggaucaugaaaaacccaaccguagacggaauaguggccauugaucuugacccugucguuuacgaugcuaaguuugaaaaacagcugggccagaucauguugcugauccucuguacaagccaaauucuguuaaugcgcacuaccugggcccuuugcgaguccaucacacuggcaaccgguccccucacuacgcuaugggaggggucuccaggaaaguucuggaauacaaccauagcugugucaauggccaacauuuuucggggcagcuaucuggcgggugccggcuuggcauucucccugaugaaaagucucgggggaggccgaagagggacuggagcucagggcgaaacccuuggugagaaguggaagaggcagcugaaucaguugucuaaaagcgaauuuaacaucuacaagcgcucagggauuauggaggucgaccgguccgaagccaaagagggacugaagagaggcgagacaacucgucacgcagugaguagggguaccgcuaaacuccggugguucguagaacgcaauuuagugaagccugagggcaagguuaucgaccugggguguggacgaggcggguggagcuauuacugcgccggacuuaaaaaggugacagaagucaaaggcuauacgaagggugggcccggacaugaggaaccgauaccaauggccaccuacggcuggaaccuggugaaacuacacucuggcaaggaugucuucuuuacuccucccgagaaaugugacacacuccugugcgauaucggggaguccucaccaaaucccaccauugaagagggaagaacuuugagggugcugaagaugguugaaccuuggcuccgggguaaccaauucuguaucaagauucuuaauccguacaugcccagcguaguggagacacuggagcagaugcagcgcaaacauggcgggauguuagucagaaacccacugucgagaaauucuacccacgaaauguauugggugaguugcggaacgggcaacaucguuuccgcggugaauaugaccagccgaauguugcucaaccgguuuacaauggcucaccguaagccuacuuacgagagagacgucgaucugggugcagggacccgccauguggccguagaacccgagguggcuaaccuagacauuaucggacagaggauagaaaauauuaaacacgagcauaagucaacauggcacuaugaugaggacaacccuuacaaaacuugggccuaucauggcuccuacgaaguuaagccaucuggcagcgcaaguuccauggucaaugggguggugaaacuucugaccaaacccugggaugucaucccuaugguuacacaaaucgccaugaccgacacuacgccauucggacagcagcggguguuuaaggagaaaguagauacaagaacccccaaggcuaaacgcgguacugcgcaaauuauggaagugaccgccagguggcucuggggcuuccugagccgaaacaagaagccgcggauauguacaagagaggaauuuacgaggaaaguccgcucuaaugcagcuaucggggccguguucguugacgagaaccaguggaacucagcaaaggaggccguggaagacgagcguuuuugggauuugguccagaaagaacgggagcugcacaagcagggaaaaugcgcuaccugcguguauaacaugaugggcaagagagaaaagaaacucggugaguucgggaaggccaaaggaaguagggcgauuugguacauguggcuuggcgcacgcuuucuggaguucgaagccuuaggcuuuaugaaugaggaccacugguucucccgagaaaacagccugucugggguagagggagaggguuugcauaagcucggcuacauccugcgggauauuucgaaaaucccugggggaaauauguaugcugacgauacugccggcugggacacaagaauaaccgaagaugaccuacaaaacgaggcaaagaucacugauauuauggaaccagagcacgcacuucuggccacaucaaucuucaaacucaccuaccagaauaagguugugaggguccagcgccccgcuaagaacgguacagugauggacgugauuagcagacgggaucagaggggguccggacaagucggcacuuauggccugaauaccuuuacgaacauggaagcccaguugauccgucagauggagagugaggggauauucuuaccuucugaacuggagaccccaaaccucgcagaacgaguucuugacuggcuggagaaauacggaguggaacgccuaaagagaauggcgauuagcggugaugacuguguagugaaacccaucgacgaucgguuugccacagcucugacugcccucaaugacaugggcaaggucaggaaagauaucccgcagugggagccuuccaagggguggaacgacuggcaacaggugcccuucugcucacaucacuuucaccaguugauuaugaaggauggacgcgagauaguugugccauguagaaaucaggacgaacuggucggccgggcaagggugagucaaggugcuggguggucucuucgagagaccgccugccugggaaaaagcuaugcacagauguggcagcucauguacuuccaucguagagauuuacgccuggccgcgaacgcuaucuguuccgccguaccuguugacugggugcccacaucacggacuaccuggagcauucacgcacaucaccaauggaugacgacagaagauauguugucugucuggaauaggguguggaucgaggaaaacccauggauggaggacaagacccauguuuccaguuggggcgaugugcccuaucugggcaaaagagaggaccaguggugcgggagccucauuggacuuacugcccgcgcuacaugggccucgaauauccaggucgcaauaaaccaggugcggaggcugaucgguaaugaaaacuaccuagacuacaugaccuccaugaagcgauuuaaaaaugagggcgauccugaaggggcucugugguga

SEQ ID NO: 13830 - RNA, 9879 nt, Artificial Sequence
  derived and/or modified CDS sequence (opt3) from DENV-1__FJ898396__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgcuagcuuguucccccuguguuuaaguaccacgucucagaagacaaccuggcucccgguacugcuuggcucccuggggugcaaaccuuugacuauguuucucauuacagagaccaagaucuggggaagaaaaagcuggccacugaaugaagguauaauggccgugggcguugugucgauccuacugucaucucuucucaagaacgaugucccccuggccgggccuuugauugcuggaggcauguuaaucgcauguuaugugauuagugguuccagcgccgaccugucucucgagaaagcggcugagguaagcugggaagaggaagccgagcacuccggggcaucacauaacauccugguggucguucaggaugacggaacuaugaagauaaaagaugaagagagggacgauacacuuaccauucuguugaaggccacgcuacuggcugugaguggcguguacccccucagcaucccagcaacucuguucgucugguauuuuuggcaaaagaaaaagcagcgaucuggcgugcuuugggacaccccuucacccccagagguugaacgcgccguauuagaugacgggaucuaccggauuaugcagagaggacugcucgguaggagccaggugggcgucgggguguuccaagagaauguuuuccacacaauguggcacgugacccguggagcggucuugauguaucagggcaaacgccuggaaccgaguugggcuagcgugaagaaagaccucauauccuacggugggggauggcggcugcagggcucuuggaacacaggcgaggagguacaggucaucgccguggaaccugggaagaaucccaagaacguucaaacugcaccaggaaccuuuaaaacgcccgagggugaagugggcgccauugcucuugauuucaagccugggacaucgggaagcccaaucgucaauagagagggcaaaauugugggucuguacgggaacggaguugugacuaccucaggcacauaugucuccgccaucgcacaggcuaaggccagucaggaaggccccuugccugagauagaggacgaaguguuuaggaaacgaaaucuaaccaucauggaucugcauccggggucuggaaagacucggcgcuaccucccagcgauuguaagagaggccaucaagaggaaauuacggacccugauucuugcacccacacgagugguugcuagcgaaauggccgaggcucugaaggguaugccuaucagauaucaaacgacugcagucaaauccgaacacaccggcaaggagauaguggaccucaugugccaugccacauucaccaugcgcuugcugucaccagugaggguccccaacuacaauaugauuaucauggaugaggcccacuuuacugacccuucuagcaucgcugcgcguggguauauuaguacacggguaggaaugggcgaagcagccgcuaucuucaugaccgccacgccgcccgguuccguggaggcauuuccacagagcaacgccguuauacaggaugaagagagagacauuccugaaaggucuuggaacucaggguacgaguggaucacugauuuccccggaaaaacagugugguuugucccauccauuaagaguggcaacgacaucgcuaauugucuccgcaagaacggcaaacgagugauacagcugagcagaaagaccuucgauaccgaguaucagaaaacuaagaauaacgacugggacuacguugugacaaccgauauuucggaaaugggggcgaacuuucgggccgacagggucaucgauccucgccguugccuuaaacccgugauccuaaaggacggaccagagagaguaauucuggcagguccgaugccugugacaguugcuucugccgcacagcggaggggccgcaucgggcgaaaucauaacaaggaaggagaucaguacauuuauaugggccagcccuugaauaacgacgaggaucacgcccacuggacugaggcuaaaauguuacuggacaauauaaacacgccagaagguaucauucccgcccucuucgagccugaaagagagaaguccgcggcaaucgauggggaauaccggcugaggggcgaggcccgcaaaaccuucgucgagcuuaugagaaggggagaccugccaguguggcucagcuauaagguggcuucagaaggcuuucaauacagugaucggcguuggugcuucgacggggagcgcaauaaccaggucuuggaagagaauauggauguugaaaucuggacaaaagagggagagcgaaagaaacugagacccagguggcuagacgcccggacuuauucugacccucuggcucuccgcgaauuuaaggaguucgcagccgguagaagguccgugagcggcgaucuuauucuggaaauagggaaguuaccgcagcauuugacccagcgggcucaaaacgcccuggacaaucucguaaugcugcacaacucagagcagggaggccgagcauacagacaugcgauggaggaacuuccagauacaaucgagacccugaugcucuuggcccugauugcuguguuaacugguggggucacgcuauuuuuccugaguggccgcggacucggcaaaaccagcaucgggcuucugugugugauggccuccucuguuuugcuguggauggcaagcguggaaccccacuggauugcugccuccaucacacucgaguuuuuccugaugguccuucucauaccugaacccgacaggcagcggacuccacaggauaaucaacuggcauauguagugaucggauugcuguuuaugauuuuaaccguugccgcuaacgagaugggucuacuggagacaaccaagaaagaccucggcaucgggcacguggcggucgaaaaucaucaccaugccacuaugcuugauguggaccugcacccugcaucagcuuggacauuguacgccgucgccacgaccauuaucacucccaugaugcgucauacaauagagaacaccaccgcaaacauuucucugacagcuaucgccaaucaggcggcuauucucaugggacuggauaagggcuggccaaucaguaaaauggacauaggugugccucuuuuagcccuggggugcuacucgcagguuaacccgcucacuuugacggcagccgugcugaugcuaguagcucacuaugcaaucauuggccccggacugcaagccaaggcgaccagagaagcucagaagaggacagccgcaggcaucaugaaaaauccaacuguggaugggauugucgccaucgaccucgauccuguuguguacgacgcuaaguucgagaaacagcuuggacagauaaugcuguugauucuguguaccagccaaauccuccugaugcgcacaaccugggccuuaugcgaauccaucacucuugcaacgggcccccugacaacccucugggaggguucuccagggaaguuuuggaacacuaccauugcugucucaauggccaauaucuuccggggaagcuaucuagcgggcgccggucuggcauuuuccuugaugaaaagucugggcgggggacgaagaggcacaggggcucagggagagacucucggcgaaaaguggaagaggcagcuuaaccagcugucuaaaagcgaguucaauauauacaagcgcucagguauuauggaaguggaccgguccgaggccaaagaaggguugaagagaggagagaccacacgucacgcaguaaguaggggcacggcuaaacugcggugguucguggagcgcaaccucguuaagccugaagguaaggugaucgauuuaggcugugggcgaggaggcuggagcuauuacugcgccgggcugaaaaaggucaccgaggugaaaggauauacuaagggcggucccgggcaugaggagccgauuccaauggccacauacggauggaaucuugucaaacugcacucuggcaaggacguguuuuucaccccucccgaaaaaugugauacucuacucugcgacaucggcgaguccucaccaaaccccacaauagaggaagggagaacccugaggguuuugaagaugguagagccuuggcugcggggaaaucaauuuuguaucaagauucucaacccguacaugcccagcguggucgaaacgcuugagcagaugcagcgcaaacaugguggcaugcuggugagaaauccauuaucgaggaacucuacccacgagauguauuggguuaguugcgggacaggaaauaucguguccgcggucaacaugacuagccgaaugcuguugaaucgguucaccauggcucaccguaagccuacauacgaaagagauguggaccucggcgcagguacucgccauguagccguggagcccgaaguugcuaaccuggauauuaucgggcagaggauugagaacaucaaacacgaacauaagucaaccuggcacuaugacgaggauaauccuuacaaaacaugggccuaucauggauccuacgaggucaagccaucuggcagcgcaaguuccauggugaacggcguggucaagcuacuuaccaaacccugggacguuauaccuauggugacucaaauugccaugacggauacaaccccauuugggcagcagcggguauucaaggaaaaaguggacacuagaacccccaaggcuaaacgcggaacagcgcaaaucauggaggucacggccagguggcugugggguuuucucagccgaaauaagaagccgcggaucuguaccagagaagaguucacuaggaaagugcgcucuaacgcagcuauuggcgccguuuuuguggacgaaaaucaguggaacucagcaaaggaggccgucgaggaugaacguuucugggaccuggugcagaaagagcgggaauugcacaagcaggggaaaugcgcuacaugcguauauaauaugaugggaaagagagagaagaaacugggcgaauuugguaaggccaaagggaguagggcgauaugguacauguggcucggagcacgcuuccuugaguuugaggcccugggcuucaugaacgaagaucacugguucucccgagagaauagcuuaucuggcguugaaggggagggacugcauaaguuggguuacauccuccgggacauuucgaaaaucccuggcgggaacauguaugcugaugacaccgccggaugggauacuagaauuacagaggacgaucugcaaaaugaagcaaagaucaccgacauaauggagccagaacacgcucuacuugccacaucaaucuuuaaacugacuuaccagaacaagguggucagggugcagcgccccgcuaagaauggcaccgugauggaugucauuagcagacgggaccagagggguuccgggcaaguuggaacguauggccucaacaccuucacaaauauggaggcccagcugauccgucagauggaaagugagggcauauuuuugccuucugaguuagaaacuccaaaccuggcagagcgagugcucgauuggcuugaaaaauacgggguagagcgccugaagagaauggcgaucagcggagacgacuguguggucaaacccauagaugaccgguucgccaccgcucuaacagcccugaacgauauggguaaggugaggaaagacauuccgcagugggaaccuuccaagggcuggaaugauuggcaacagguucccuuuugcucacaucacuuccaccagcucaucaugaaggacgggcgcgagaucguggucccauguagaaaccaggaugaguuggugggacgggcaaggguaagucaaggcgcugguuggucucugcgagaaacugccugccuugggaaaagcuaugcacagauguggcagcugauguacuuucaucguagagaccuccgcuuagccgcgaaugcuauuuguuccgccguuccuguggauuggguccccaccucacggacgacauggagcauacacgcacaucaccaauggaugaccacugaggacaugcugucuguguggaacaggguuuggaucgaagagaauccauggauggaagauaagacacauguguccaguuggggagacguccccuauuugggcaaaagagaggaccaguggugcggcagccugauugggcucaccgcccgcgcuacuugggccucgaacauccagguggcaauuaaucagguacggaggcuuaucggaaacgagaauuaccuggauuacaugaccuccaugaagcgauucaaaaacgaaggugacccugagggcgcucuaugguga

SEQ ID NO: 13831 - RNA, 9879 nt, Artificial Sequence
  derived and/or modified CDS sequence (opt3) from DENV-1__GQ199839__SS-prME
agcgugaccaugcugcucaugcuuaugcccaccgcacuggcuuuccacuugacuacgagaggaggggaaccucauaugaucgucaccaagcaggaaaggggaaaauccuuacuguuuaagacaucugccgguguuaauaugugcacucugauugccauggaccucggcgagcugugugaagauaccaugacauacaaaugcccacggauaaccgaggcggaaccggacgauguggacuguuggugcaaugcuacugauacauggguaaccuaugggacguguucacgcacuggagagcaccgacgugacaagagaaguguggcccuugcaccccaugucggccuggguuuggagaccaggacagaaacuuggaugagcuccgagggggccuggaaacaaauccagcggguggaaaccugggcucuccgccacccuggauucacaguuauugcacuguuucuggcccaugcuaucggcaccucuauuacgcagaagggcaucauauucauccucuuaaugcuggugacuccaucgauggccaugagaugcgucgggauuggaucaagggauuuuguggagggucuuagcggcgcgacauggguagacguuguguuggagcacgggaguugugucaccacuauggcaaaggauaaacccacacuggacaucgaacuacucaagaccgaggugacgaacccugccgugcugcggaaacuuugcauugaagcuaagaucuccaauaccacaacugauucucgcuguccaacccagggagaggccacacugauggaagaacaagacgcaaacuucgucugccgaagaacuuuuguugauaggggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucagguugguaaugagucaacggaacacggcacaaccgccacuauuacaccccaagcgccuacaagugagauccagcugaccgacuacggggcccucacucuugauuguagcccacggacaggacuggacuucaacgaaaugguguugcuaacgaugaaggagaaaucuuggcugguccauaagcagugguuucucgaucugccgcuucccuggaccuccggcgcaucaacuagccaggagacauggaaucgucaagaccuguuggugaccuucaaaacagcucacgccaagaagcaggaaguaguugugcucgguagucaggagggggcuaugcacacugcccugaccggcgcaacggaaauccaaaccucuggaacaacuaccauuuuugccggccauuuaaaaugccgccugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaggaugaaaaggggguuacucaaaacggaagauugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccaggggcgcucggcgaauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgcaguacaucccugagcaugaccuguauugcugugggccuaguuacacucuaccugggggucauggugcaggccgauucuggaugcgugaucaacuggaaaggcagagaacuuaagugugguucagggaucuucgucacuaaugagguucacaccuggacggaacaguauaaguuucaagcagacaguccgaaaagguugagcgccgcuauuggaaaggccugggaggagggcgugugcgguauacgguccgcaacacgccuggaaaacaucauguggaaacagauuucuaacgagcucaaucauauccuguuagaaaacggccugaaguucaccgugguagucggggacgugguuggcauucuugcucagggcaaaaagaugaucagaccucagcccauggagcacaaauacucguggaaaagcugggggaaggccaagauaaucggagcggaugugcaaaauacuaccuuuauuaucgacggcccaaacacaccugaaugucccgaugaccagagggccuggaauauuugggaggucgaggauuaugguuucgggaucuuuacuaccaacauaugguugaagcuccgugacuccuacacacaggugugcgaucaccggcugaugucagcugcaauuaaagacaguaaggccguucaugcugauaugggauauuggaucgaaucugagaaaaaugaaacguggaagcuagcccgagcauccuucauugaggugaagaccuguaucuggccaaaaucccacacucuguggucaaacggcguacucgaaagcgagaugauaauccccaagauuuacgguggcccuaucucucagcauaauuauagaccaggguacuucacacaaaccgcgggaccguggcaccugggcaaacuugaguuggacuuugaucugugcgaagggacuacagucgugguggacgagcacugcggaaacaggggccccuccuuacgcaccacgacugucaccgguaagauuauccaugaaugguguugccggaguuguacacucccuccacugagauucaaaggggaggauggaugcugguacggcauggagauaaggcccguuaaggaaaaggaggaaaaucuugugaaaagcaugguaucugccgguuccggcgagguggacucauuuagucugggguugcucuguaccagcauuaugaucgaagaggucaugcgcucgcgauggucccggaagaugcugaugacuggaacacuagcuguguuccugcuccugaucaugggccagcuuaccuggaacgacuugauucgucugugcaucaugguuggggccaaugcaucugauagaaugggaaugggcacaacuuauuuagcucucauggccaccuuuaaaaugaggccuauguucgcagugggucugcuuuuucgccggcugacgagcagagagguccuacuccugacaauuggguugucacugguggccaguguugaauuaccaaacucccucgaggaacugggagacggccuugcuaugggcauaaugauccugaaguugcucaccgauuuccagucucaccaacugugggcgacucuacugagccuuaccuuuauuaaaacaacucucucccugcauuacgccuggaagaccauggcaaugguguugucaaucgucagccuguuccccuuaugucucaguacgacaucucagaagaccacuuggcugccgguacuucugggguccuugggaugcaaaccucucacaauguuucugauugcugagaauaagaucugggguaggaaaagcuggccacuaaacgaaggcauaauggccguggggguugugucgauccugcuuucaucucuccugaagaacgacguccccuuggccggaccuuuaauugcuggcgguaugcugaucgcauguuaugugauuaguggguccagcgccgaucucucucuggagaaagcggcugagguaagcugggaagaggaagccgagcacuccggagcaucacauaauaucuucguggaaguccaggacgauggcaccaugaagauaaaagacgaggagcgagaugacacucuuacaauucuguugaaggccacccuacuggcuguuaguggcguguacccccucagcaucccagcaacgcuguuugugugguauuucuggcagaagaaaaagcaacgcucugggguccuuugggauacuccuucacccccagaaguggagcgggccgcguuagacgauggaaucuacagaauuaugcagaggggucugcucggccguagccagguugggguaggaguguuccaggaaaacgucuuucacaccauguggcacgugacacgcggcgcuguuuugauguaucaagguaaacggcuggagccgaguugggccagcgugaagaaagaccucauauccuacgggggaggcuggagacugcagggcucuuggaauaccggggaggaaguccaggugaucgcaguagagccuggaaagaaccccaagaauguccagacagccccagguacuuucaaaacccccgaaggcgaggugggggcuauugcccuugacuuuaagccuggaacgucgggcagcccaaucguuaacagggaagguaaaauuguggggcuguacggaaauggcgucgugacaacuucaggcaccuauguuuccgcaaucgcucaaacaaaggccagucaggaggggcccuugccugagauagaagaugagguguuccgaaaacggaaccuaaccaucauggaccugcauccgggaucugguaagacucgcagauaccucccagcgauugucagggaagccaucaagcggaaauuacgaacccugauucuugcacccacaagagugguagcuagcgagauggccgaagcucugaagggcaugccuauccgcuaucagacgacugcagugaaauccgagcacaccgggaaggagauaguugaucucaugugccaugccacauuuaccaugagguugcugucaccaguccgugugcccaauuacaacaugauuaucauggacgaagcccacuucacugauccuucuagcaucgcugcgcggggauauauuaguacaagagugggcaugggugaggcagccgcuaucuuuaugaccgccacgccgcccggguccgucgaagcauucccacaaagcaaugccguaauacaggacgaggaaagggauauuccugagcgcucuuggaacucaggauacgaguggaucacugacuuucccggcaaaacagugugguucguuccauccauuaagaguggcaaugauaucgcuaacugucuccgaaagaaugggaaaagagugauacagcugagccggaagaccuuugacaccgaauaucagaaaacuaagaacaacgauugggacuacgucgugacaaccgacauuucggagaugggagcgaauuucagggccgaucgcguuaucgacccucguagaugccuuaaacccgugauccuaaaggaugguccagaacgggucauucuggcaggcccgaugccugugacaguagcuucugccgcacaaaggcgcgggcgaaucggaagaaaccauaauaaggagggcgaccaguacauuuauaugggucagcccuugaacaaugaugaggaccacgcccacuggacugaagcuaaaauguuacuggauaacauaaauacgccagaggggaucauucccgcccucuucgaaccugagcgggaaaaguccgcggcaaucgacggcgaguacaggcugcgcggagaggccagaaaaaccuuuguggaacuuaugaggcggggcgaucugccaguuuggcucagcuauaaggucgcuucagagggguuccaguacagugaccgucgcuggugcuuugauggagaacgaaacaaucaaguguuggaggaaaacauggacguggagaucuggacaaaagagggugaaagaaagaaacugaggccccgguggcuagaugcccgcacuuauucugacccucuggcucucagagaguucaaggaauuugcagccggcaggcgguccgucagcggggaccuuauucuggagauaggaaaguuaccgcagcauuugacccagcgagcucagaaugcccuggauaaccucguuaugcugcacaauucagaacaaggcgguagagcauaccgccaugcgauggaggagcuuccagacacaaucgaaacccugaugcucuuggcccugauugcuguguuaacugggggcguaacgcuauucuuucugaguggaaggggccucgggaaaaccagcaucggacuucugugugugauggccuccucugucuugcuguggauggcaagcguggagccccacuggauugcugccuccaucauacucgaguucuuucugaugguucuucucaucccugagcccgaucggcagcguacaccacaggacaaccagcuggcauauguggucauugguuugcuguucaucauuuuaacuguagccgcuaaugagaugggccuacuggaaaccacaaagaaagaucucgggaucggacacguggcgguugagaaccaucaccaugccaccaugcuugacguggaucugcacccugcaucagcuuggacuuuguacgccgucgccacaacgauaauuacccccaugaugagacauacuaucgaaaacacaaccgcaaauauuucucugaccgcuaucgccaaccaagcggcuauacucaugggccuggacaaggguuggccaaucaguaaaauggauauuggggugccucuuuuagcccugggcugcuacucgcaggucaauccgcucacauugacugcagccgugcugaugcuaguugcucacuaugcaaucauuggacccggccugcaggccaaggcgacgagggaggcucaaaagcgcaccgccgcagggaucaugaaaaacccaacaguggacggaauaguagccauugaucucgacccuguggucuacgaugcuaaguuugaaaaacagcuuggccagaucaugcuguugauccuguguacuagccagauucuccugaugcggaccacaugggccuuaugcgaguccaucacccuugcaacugguccccugacgacacucugggaggggucuccaggaaaguucuggaauaccacuauagcuguuucaauggccaacauuuuucgaggcagcuaucuagcgggugccggccuggcauucuccuugaugaaaagucuagggggaggcagaagggggaccggagcucaaggcgaaacacucggugagaaguggaagcgccagcuuaaucagcugucuaaaagcgaguucaacaucuacaagcggucagggauuauggagguggacagauccgaagccaaagagggauugaagcguggcgagacuaccaggcacgcagucagucgggguacagcuaaacugcgcugguuuguggaacgaaaucucguaaagccugagggcaaggugaucgacuuaggguguggaagaggcggguggagcuauuacugcgccggacugaaaaagguuacggaagugaaaggcuauaccaagggugggcccggacaugaggaaccgauaccaauggccacuuacggcuggaaccuugucaaacugcacucuggcaaggauguguucuuuacaccucccgagaaaugugacacccuacucugcgauaucggggaguccucaccaaaucccacuauugaagagggaaggacacugcgggucuugaagaugguggaaccuuggcugcgcgguaaccaguucuguaucaagauucucaauccguacaugcccagcguuguagagacccuugagcaaaugcagagaaaacauggcgggaugcuggugaggaacccauuaucgcgaaauucuacgcacgaaauguauugggucaguugcggaaccggcaacaucguguccgcgguuaauaugacaagccggaugcuguugaaccguuuuacuauggcucacagaaagccuaccuacgagcgcgacguggaucucggugcagggacaaggcaugucgccguggaacccgagguagcuaaccuggacauuaucggacagcggauagaaaauauuaaacacgagcauaagucaacuuggcacuaugaugaggacaacccuuacaaaaccugggccuaucauggcuccuacgaagugaagccaucuggcagcgcaaguuccaugguuaauggggucgugaagcuacuuacaaaacccugggaugugaucccuauggucacccagaucgccaugacugacacgacaccauucggacaacagagaguuuuuaaggagaaaguggauacccgcacucccaaggcuaaaagggguaccgcgcagauuauggaaguaacagcccgauggcuguggggcuuccucagccggaacaagaagccgagaauauguacgagggaggaauuuacccgcaaagugcguucuaaugcagcuaucggggccgucuucguggacgagaaccaauggaacucagcaaaggaggccguugaagacgagcgguuuugggaucuggugcagaaagaaagagaguugcacaagcagggaaaaugcgcuacuugcgucuauaacaugaugggcaagagggaaaagaaacugggugaguucgggaaggccaaaggaagucgcgcgauuugguacauguggcucggcgcacgauuucuugaguucgaagcccugggcuucaugaaugaggaccacugguuuucccgggaaaacagcuuaucugggguggagggagagggucugcauaaguugggcuacauccucagagauauuucgaaaaucccugggggaaauauguaugcugacgauacagccggcugggacaccaggauaacugaagaugaccugcagaacgaggcaaagaucacagauauuauggaaccagagcacgcucuacuugccaccucaaucuucaaacugacauaccaaaauaagguaguucgcgugcagagacccgcuaagaacgguacugucauggacgugauuagccggagggaucagcguggguccggacaggugggcaccuauggccucaauacguuuaccaacauggaagcccaacugauccgacagauggagagugaggggauauucuugccuucugaauuagagacaccaaaccuggcagaacgcguccucgacuggcuugagaaauacggaguugaaagacugaagcggauggcgauuagcggugaugacugugugguaaaacccaucgacgauagguuugccacugcucuaaccgcccugaaugacaugggcaaggugcgcaaagauaucccgcagugggagccuuccaagggguggaacgacuggcagcaaguccccuucugcucacaucacuuucaccagcucauuaugaaggauggaagagagauagugguuccaugucggaaucaggacgaauuggugggcagggcacgagucagucagggugcuggguggucucugcgugagacagccugccuuggaaaaagcuaugcacaaauguggcagcugauguacuuccauagacgcgaucuccgguuagccgcgaacgcuaucuguuccgccgugccuguagacuggguucccacuucaaggaccacguggagcauucacgcacaucaccaguggaugacaaccgaagauaugcugucuguguggaauagagucuggaucgaggaaaacccauggauggaggacaagacucauguguccaguuggggcgauguucccuauuugggcaaacgcgaggaccaauggugcgggagccugauuggacucacagcccgggcuaccugggccucgaauauccagguggcaauaaaccaggucaggcgacuuaucgguaaugaaaacuaccuggacuacaugacuuccaugaagagauuuaaaaaugagggcgauccugaaggggcucuaugguga

SEQ ID NO: 13832 - RNA, 9879 nt, Artificial Sequence
  derived and/or modified CDS sequence (opt3) from DENV-1__FJ898397__SS-prME
agcgugaccaugcugcucaugcuuaugcccacagcccuggcuuuccacuugacuaucagaggcggggagccucauaugauugucuccaagcaggaaaggggaaaaucuuuacuguuuaagacgucagcagguguuaacaugugcacccuaauagccauggaccucggcgaguucugugaagauacaaugacuuacaaaugcccacggaucaccgaggcggaaccggacgauguggacuguuggugcaaugcuacagauaccuggguaacuuaugggacauguagucaaaccggagagcaccgccgagacaagcguagcguggcccuggcaccccaugucggccuuggucuggagacgagaacugaaaccuggauguccucugagggggccuggaaacagauucagaggguggaaacaugggcuuugcggcacccuggauuuacuguuaucgcacucuuccuggcccaugcuauuggcaccucgaucacacagaagggcauaaucuuuauucugcucauguuagugaccccaucaauggccaugcgcugcgucgggaucggaagcagagauuucguggagggucugaguggcgcgacguggguagacguugugcuugagcacggguccugugucacuacaauggcaaaggauaaacccaccuuggacauugaacugcuaaagacugaggugacaaacccugccgugcucaggaaacugugcaucgaagcuaagauaucuaauaccacgaccgauagccgguguccaacacaaggagaggccacucuugucgaagagcaggacgcaaacuuuguuugccgccgaaccuucguggauagaggcugggguaauggguguggacuguuuggcaaaggcuccuugauuacaugcgcuaaguucaagugcguaacuaaacucgaggggaagaucgugcaguacgaaaaccugaaauauucagucauugugaccguucacacaggagaccagcaucaaguggguaaugagaguaccgaacacggcacuacggccacaaucaccccccaggcgccuagcacugagauccaguuaaccgacuacggggcccugacacucgauuguucuccaaggaccggacuugacuuuaacgaaaugguccuguugacuaugaaggagaaauccuggcuagugcauaagcagugguuccuggaucucccgcugcccuggacaucaggcgcaagcacgagucaagagaccuggaaucggaaagaccuucugguaacuuuuaagacagcucacgccaagaaacaggaaguuguggucuuggguucucaggagggggcuaugcacaccgcccucacaggcgcaacugaaauucaaaccuccggaacgaccacaauauucgccggccaucugaagugccguuuaaaaauggauaagcugacucuaaaagggaugagcuaugugauguguaccggaucguucaagcucgagaaggaagucgcugagacacagcacgguacugugcugguucagaucaaauacgagggcaccgacgcgccuugcaagauuccauuuucuacgcaggaugaaaaaggggugacacaaaacggacgccuuaucaccgcaaaucccauaguaacugacaaggagaaaccugucaacauugaagccgagccacccuucggcgaguccuauaucgugaucggugcuggggaaaaggccuugaagcugucaugguuuaaaaagggcaguagcauuggaaaaauguucgaggcaacagccagaggcgcuaggcggauggccauccucggggauaccgcaugggacuuuggauccauugguggcguuuucacuucuguggggaagcugguccaucagauauuuggaaccgcguacggcgugcuuuucagcgguguaucauggacaaugaaaaucgggauuggcgugcuguugacguggcucggacugaauagucgauccaccagcuuaucuaugacuuguaucgcuguuggccuggucacacuauaccucggggugauggugcaggccgauucaggaugcgucaucaacuggaagggccgcgaacugaagugugguagugggauuuuuguuaccaaugaggugcacacauggacugaacaguauaaauuccaagcagacagcccgaagagacuuuccgccgcuauaggaaaagccugggaggagggcgugugcgguaucaggucugcaacccgguuggaaaacauuauguggaagcagaucucgaacgagcugaaucauauucuccuggaaaacgacaugaaauuuacgguagucgugggcgauguugcugggaucuuagcccagggaaagaaaaugauacgcccucagcccauggaguacaaguauagcuggaaguccuggggcaaagcgaagaucauuggggccgacgugcaaaauacaaccuucaucauugauggaccaaacacuccugaaugucccgacgaucagagagcuuggaauaucugggaggucgaggacuacggcuuugguauauucaccacaaacauuuggcugaaacuuagggauucauauacucaggugugcgaccaccguuugaugagugcagccaucaaggauucuaaagcuguucacgccgacaugggguacuggauugaaagcgagaagaaugaaaccuggaagcucgcacgggcguccuucaucgaggugaaaacauguauauggccaaagucacauacgcuguggagcaacggaguacuagaaucugagaugaucauucccaaaaucuauggcgguccuauuucccagcacaauuaccgaccaggcuacuuuacccaaacugccgggccguggcaucugggaaagcucgagcuggauuucgaccuuugcgaaggcacaaccgucgugguggaugagcacugcgggaacagaggacccaguuugaggacuacaaccgucacgggcaaaaucauacacgaaugguguugccgcagcuguacucugccuccauuacgguuuaagggugaggacgggugcugguauggaauggagauuagacccguuaaggaaaaagaggaaaaucucgugaagucuaugguauccgcuggcucaggugagguggacaguuucagccugggccuucuguguaucucgaucaugauugaagaggucaugaggucccgcuggucucgaaaaauguugaugaccgggacacucgccguguuuuuccugcuaaucaugggacagcugaccuggaacgaucucauucggcugugcauaaugguuggcgcaaaugcuagcgaccguauggggaugggaacuacauaccuugccuugauggcaaccuuuaagaugagaccuauguucgccgugggccuguuauuuaggcgccucacaucacgggagguccugcuucugacuaucggucuaagucucguggcuuccguugaacugccaaacucuuuggaggaacugggggauggauuagcgaugggcauuaugauccucaaacugcuuaccgacuuccagagccaucaacugugggccacguugcucucccugacauuuauuaagaccacuuucucacuacacuaugcauggaagaccauggcuauggugcugagcaucgucagucuuuuuccccucugucugucuacaacuucccagaaaaccacgugguugccgguacuguuaggcagccucgggugcaagccucugacaauguuccuuauagccgagaauaaaaucuggggaagaaagucguggccacugaacgaagguauuauggccgugggcaucguuucaauuuugcucucuagucugcuaaaaaacgaugugccccuggcugggccucuuaucgcaggaggcaugcucauagccuguuacgucauuuccgguagcucugcggaccugagcuuggagaaggcugccgagguguccugggaagaggaagcagagcauucaggggccagucacaauaucuuaguagaagugcaggaugacggaaccaugaaaaucaaggaugaggagagggacgauacucugacaauucuccugaaggcuacccuucuggcagucagcggcguuuaucccuugucuauaccagccacucuauucgugugguacuuuuggcagaaaaagaaacaacgauccggcgugcugugggacacaccuucacccccagaagucgagcgcgcggugcucgaugacgggaucuaucggauuaugcagagaggacugcuugguaggagucagguuggcguagggguguuccaggaaaacgucuuucauaccauguggcacgugacgcguggagcuguuuuaauguaccaaggcaagcgccuggagccgagcugggccuccgugaaaaaggaccucaucucuuacggugggggauggcgguugcagggcucguggaauacuggcgaggaaguccaggugauugcaguagagccugggaagaaccccaaaaauguccagaccgccccaggaacauucaagaccagcgaaggugaggugggcgcuaucgcccuggauuuuaaacccgggacaucaggauccccuauaguuaacagagaaggcaagaucgugggucucuaugggaauggagucgugacuaccaguggcacguacguuucugcaauugcucaagccaaagcgagccaggagggcccacugcccgagaucgaagacgagguguucaggaagcgaaaccuuacaauuauggaucugcacccuggguccggaaagacucggcgcuauuugccggccaucgucagagaagcaauaaaaaggaagcuacggacccugauucucgcuccaacacgagugguagccucagagauggcugaagcauuaaaagguaugcccaucagauaccagaccacugccgugaagucugagcauaccggcaaagagaucguugaccugaugugccacgccacauuuacgaugcgccuucugagcccugucagggugccaaauuauaacaugauuaucauggaugaagcucauuucacugaccccaguuccauagcggcacguggguacauuagcacccgggugggaaugggcgaggccgcugccaucuuuaugacagcaaccccuccggguucugucgaagccuucccccaaucaaaugcuguaauucaggaugaggaaagagacaucccagagagguccuggaacaguggguaugaguggauaacugauuuuccuggaaagacagugugguucguucccagcauuaagucgggcaaugacaucgcgaacugucuccgcaaaaauggcaagcgagugauccaguugucuagaaaaaccuucgauacggaauaccagaagacuaaaaacaacgacugggacuacgucgugacaaccgauauuuccgagaugggggccaauuuucgggcagacaggguuaucgauccacgccguugccugaagccugugauucucaaggacggacccgaaagagucauacuggcugguccaaugccggugaccguagccagcgcagcccaacggaggggccgcaucgggcgaaaccacaauaaagagggagaucaguauauuuacaugggccagccucuuaacaaugacgaggaucaugcucacuggacugaagccaagaugcuacuggacaacaucaauacacccgaggguaucauuccagcguuguucgaacccgagagagaaaaaucagcagccauagauggggaguaucgguuaaggggcgaggcucgcaagaccuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagaucuggacaaaggagggagaacgaaaaaagcugagaccaagguggcucgacgcucggacuuacagcgaccccuuggcacugcgcgaguucaaggaauuugccgcugguagaaggucagucaguggcgaucuaauucuggagaucgggaaacucccucagcaccuuacgcagcgggcccagaaugcacuggacaacuuaguuauguugcauaauagcgaacaaggaggccgagcguauagacacgccauggaggagcugccggauaccauugaaacacucaugcugcuugcucugaucgccgugcucacuggugggguaaccuuguucuuucuguccggccgcggauuaggcaagacaucuauagggcuacugugugugauggcaagcuccguccuccuuuggauggcuucaguggagccacauuggaucgccgcaucuauuauccuggaauucuuuuugaugguucugcucauucccgagccugacaggcagcggaccccccaggauaaccagcuggccuacguggucaucggacuucucuucaugauacugacuguagcugcgaaugagauggguuugcuggaaacgaccaaaaaggacuuaggcauugggcacguggccguugagaaccaccaucacgcagcuaugcuagauguggaccugcauccagccagugccuggacacucuacgcagucgcuacuaccaucauuacaccuaugaugcgucacaccaucgaaaacacuacagccaauauaucgcuuacggcgaucgcuaaccaagccgcaauucugaugggauuggauaaaggcuggcccaucagcaagauggacauuggugugccacugcucgcccuggggugcuauucccaggucaauccucuuaccuuaacugcugcagugcugaugcucguugcccauuacgcgaucauaggcccgggauugcaggcuaaggccacaagagaggcacaaaaaaggaccgccgcuggcauuaugaagaaccccaccguggaugggaucguagccaucgaccuggauccaguggucuaugacgcaaaauuugaaaagcagcuaggacagauuaugcugcucauccuuuguacaucucagauacuguugaugcgcacuacgugggcucugugcgagucaauuacccucgccacaggcccucugacuaccuuaugggaggguagccccgggaaauucuggaauacaaccaucgcgguuuccauggccaacauuuuccggggaaguuaccuugcaggcgcuggucuggccuuuucucucaugaagagccuaggcgggggacgaagaggcacuggggcacaaggagaaacgcugggcgagaaguggaaaaggcaguugaaucagcugucaaaguccgaauucaacacauauaaacgcagugguaucauggagguggaccggagcgaagcuaaggaggggcucaaaagaggagagaccacuaagcacgccgucucucguggcaccgccaagcuuaggugguuuguggaacggaaucugguaaaaccagaggguaaggugauagauuugggcugugggcgcggaggcugguccuacuauugcgcggggcugaaaaagguuacagaagugaaaggauacacuaagggcgguccugggcacgaggaacccaucccgauggcuaccuacggauggaaccucgucaaauuacauucaggcaaggacguguucuuuauuccaccugagaagugugauacacugcuuugcgacaucggcgagagcucgcccaauccaacgauugaagaggggcgaacccugagaguccuaaaaaugguggaacccuggcucaggggaaaccaguucuguaucaagauucugaauccuuauaugccgucuguuguagagacuuuggagcaaaugcagcggaaacacgguggcaugcuggugcgcaacccccucaguagaaauuccacacaugaaauguacugggucagcugcgggaccggaaacaucgugucagcaguuaauaugacuuccaggaugcuucugaaccgauuuacaauggcccaccggaagccaaccuaugagcgugauguggacuuaggcgcugguacgagacacgucgccguggaaccugagguagcaaaccuggauauaauugggcagcgcaucgaaaauaucaaacaugagcacaagucuaccuggcauuacgacgaggauaaccccuauaagacaugggccuaccacggaagcuaugaagugaaaccuaguggcuccgcuagcucuaugguuaauggcgucgugaaguugcucacuaaaccaugggacgugauucccauggucacccagauagcgaugacagauacuaccccuuucgggcaacagaggguuuuuaaggagaaaguggacacacggaccccaaaggccaagagaggaacugcacagaucauggaaguaacggcuaaauggcugugggguuuccuaucacgcaacaagaaacccaggauuuguacacgagaggaauuuacccggaaggugagaaguaaugccgcaaucggcgccgucuucguggacgagaaccaauggaauuccgcuaaagaggccguugaagaugagagguuuugggaccuugugcaucgcgaacgugagcugcacaagcaggggaagugcgcgacuugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauaagcaaaaucccgggcgggaauauguacgcagaugacaccgcuggaugggauacacggauuacggaagacgaucugcagaacgaggccaagaucaccgacauuauggaaccugagcacgcuuugcucgccacuuccaucuucaagcugacauaucagaauaaaguaguuagagugcaaaggccagcaaagaacggcaccgucauggaugugauaagucgcagagaccagcgggguucugggcaggugggaacuuacggccuaaauacauuuaccaacauggaagcgcagcuuauuaggcaaauggagagcgagggcaucuucucccccucagaacuggagacaccuaaccucgccgggcguguccuggauugguuggaaaaacauggaguugagcgauuaaagcgcauggcuaucaguggugacgacugugugguaaaaccaauugaugacagauuugccacugcacugaccgcucucaaugauaugggcaaggugcggaaggacauaccccagugggaaccgucuaaaggguggaacgauuggcagcaggucccuuucugcagccaccacuuucaucaacuuaucaugaaggacggaagggagauugugguucccugucgcaaucaggaugagcuggugggcagagcccgggucucccagggugcaggguggucacuaagggaaacggccugccugggaaaaagcuaugcgcagauguggcaacucauguacuuccaccgacgugacuugagacuggcugccaacgcaaucuguucugccgugccaguagauuggguuccuaccucccgcacaacuuggaguauucaugcucaccaucaguggaugaccacagaggacaugcuuagcguguggaaucgggucuggaucgaagagaaccccuggauggaagauaagacucacauaucguccuggggcgacgugccauaucugggcaaaagggaggaccaguggugcgggucucucaucggauuaaccgccagagcaacgugggcuacaaauauucaaguugccaucaaccaggugcgccggcugauugguaaugagaacuacuuggauuacaugaccucaaugaagagguuuaagaaugaaagcgaccccgagggcgcgcugugguga

SEQ ID NO: 13833 - RNA, 9879 nt, Artificial Sequence
  derived and/or modified CDS sequence (opt3) from DENV-1__FJ898398__SS-prME
uccgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggcaagaagaugauccgcccucaacccauggaguacaaauauagcuggaagauauggggcaaggcgaaaaucauuggggccgacgugcagaauaccacuuuuaucauugauggaccaaacaccccugaaugucccgacgaucagagagcuuggaauaucugggaggucgaggacuacggcuucgguauauuuacaacuaacauuuggcuuaaguugagggauuccuauacccaggugugcgaccaccgucucaugucagcagccaucaaagauaguaaggcuguucacgccgacaugggguacuggauugaaucugagaaaaaugaaacauggaagcuggcacgggcgagcuucaucgaggugaagacguguauauggccaaaaucccauacccuauggucaaacggaguacuggaaagcgagaugaucauucccaagaucuauggcgguccuauuucucaacacaauuaccgaccaggcuacuucacucagacagccgggccguggcaucucggaaaacuggagcuugauuuugacuugugcgaaggcaccacugucgugguggaugagcacugcgggaacagaggacccucccugaggacaaccacggucacuggcaagaucauacacgaaugguguugccgcaguuguaccuuaccuccacuccgguucaaaggugaggacgggugcugguauggaauggagauuagacccguuaaggaaaaggaggaaaaucuggugaaaagcaugguaucugcuggcuccggugagguggacucauuuagucuuggccuguuguguaucagcaucaugauugaagaggucaugaggucgcgcuggucccgaaagaugcucaugacagggacccuggccguguucuuucuacugaucaugggacagcucacuuggaacgaucugauucggcuuugcauaaugguuggcgcaaaugcuucugaccguauggggaugggaacaaccuacuuggcccugauggcaacauucaaaaugagaccuauguuugccgugggcuuacucuucaggcgccugacuagccgggagguccuucugcuaaccaucggucucucacugguggcuaguguugaauugccaaacucccuggaggaauuaggggauggacucgcgaugggcauuaugauccugaaacuucugacggacuuucaaucucaucaguugugggccacacuccugagccuaaccuucauuagaacuaccuuuucccugcacuaugcauggaaaacaauggcuauggugcuuucaaucgucagccucuucccccuguguuugaguacuaccucucagaagacgacauggcugccgguauuacucggcucccuggggugcaagccucuuaccauguuucugauagccgagaauaaaaucuggggaagaaagagcuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcauuccggggccucacacaauauccugguagaagugcaggaugacggaacuaugaaaaucaaggaugaggagcgagacgauacacucaccauucugcuuaaagcuacucuguuggcagucaguggcguuuauccccuaagcauaccagccacacuguucgugugguacuucuggcaaaagaagaaacagcgcucuggcgugcucugggacaccccuucacccccagaagucgagcgggcggugcuggaugacgggaucuauagaauuaugcagaggggacuuuuaggucguagccagguuggcguagggguguuucaagaaaacgucuuccauacgauguggcacgugacucgcggagcuguucugauguaccagggcaagcggcucgagccgaguugggccagcgugaaaaaggacuugaucuccuacggugggggauggagacugcagggcucuuggaauaccggcgaggaaguccaggugauugcaguagagccugggaaaaaccccaagaauguccaaacagccccaggaaccuuuaagacaucggaaggugaggugggcgcuaucgcccucgauuucaaacccgggacuagcggaucaccuauaguuaacagggaaggcaagaucgugggucuguaugggaauggagucgugaccacguccggcacauacguuagugcaauugcucaggccaaagcgucucaggagggcccacuucccgagaucgaagacgagguguuucgaaagcggaaccugacuauuauggauuugcacccugggagcggaaaaacccgcagauaucuaccggccaucgucagggaagcaauaaagcggcgacugagaacacucauuuuagcuccaacccgcgugguagccuccgagauggcugaagcacugaaggguaugcccaucagguaccaaacuaccgccgugaaaucagagcauacaggcaaggagaucguugaccuuaugugccacgccacguucacuaugcgucugcucucuccuguccgggugccaaauuauaacaugauuaucauggaugaagcucauuuuaccgaccccagcaguauagcggcaagaggguacauuuccacaagggugggaaugggcgaggccgcugccaucuucaugaccgcaacuccuccggguagcgucgaagccuuuccccagucuaaugcuguaauucaggaugaggaacgcgacaucccagagcgaucauggaacuccggguaugaguggauaacagauuucccuggaaaaaccgugugguuuguucccaguauuaagagcggcaaugacaucgcgaacuguuugaggaaaaauggcaagcgggugauccagcugucgaggaagacguucgauacugaauaccagaaaacaaagaacaacgacugggacuacgucgugaccaccgauauuucugagaugggggccaauuuccgcgcagaccguguuaucgauccaagacggugccucaaaccugugauucugaaggacggacccgaaagggucauacuugcugguccaaugccggugacuguagccuccgcagcccagcgccgaggcagaaucgggcggaaccacaauaaagagggagaucaguauauuuacaugggccagccucuaaacaaugacgaggaucaugcucacuggacagaagccaagaugcuguuggacaacaucaauacccccgaggguaucauuccagcguuauuugaacccgagagggaaaagagcgcagccauagauggggaguaucgccugagaggcgaggcuaggaaaacauucguggaacucaugcggcguggagaccugccuguuuggcuuucauacaaggucgccagugagggcuuucaauauucugaucgccgauggugcuucgacggggaaagaaacaaucaggugcuggaggaauccauggauguggagaucuggacuaaagagggagaaaggaagaaacuccggccacgcugguuggacgcuagaacguacagcgacccccuggcacuaagggaguuuaaggaguucgccgcuggucggcgaucagucaguggcgaucugauucucgagaucgggaaacuuccucagcaccugacccagagagcccaaaacgcauuagacaauuugguuaugcugcauaacagcgaacagggaggccgcgcguauaggcacgccauggaggagcucccggauacaauugaaacucugaugcuucuggcucucaucgccguguugaccggugggguaacacuguuuuucuuauccggccggggacuaggcaagaccucuauagggcugcucugugugauggcaagcuccguccuucuguggauggcuucaguggagccacauuggaucgccgcaucuauuaucuuggaauuuuuccugaugguucuccugauucccgagccugaccgucagagaacuccccaggauaaucaacuugccuacguggucaucggacuccuguuuaugauauugacgguagcugcgaacgagaugggucuguuagaaaccacaaagaaagaccuaggcauugggcacguggccguugagaaucaccaucacgcagcuaugcuggauguggaccuccauccagccagugccuggacucuuuacgcagucgcuaccacaaucauuaccccuaugaugaggcacacuaucgaaaacacaacggccaacauaucgcugaccgcgaucgcuaaucaggccgcaauuuugaugggacuggauaagggcuggcccaucagcaaaauggacauuggugugccacuccuggcccuugggugcuauucccaggucaacccuuuaacucugacagcugcagugcucauguugguugcccauuacgcgaucauaggcccgggacugcaagcuaaggccacccgcgaggcacagaaacggaccgccgcuggcauuaugaagaaucccacaguggaugggaucguagccaucgaccuagauccaguggucuaugacgcaaaguucgaaaaacagcugggacagauuaugcuccuuauccuguguacuucucaaauauugcugaugcgaacgaccugggcucucugcgagucaauuacacuggccacuggcccuuuaaccacacuuugggaggguagccccgggaaguuuuggaacaccacuaucgcgguuuccauggccaauauuuucagaggaaguuaccuggcaggcgcuggucucgccuucucucuaaugaaaagccugggcgggggaaggcgcggcacgggggcacagggagaaacauugggcgagaaguggaaacggcagcugaaccagcucucaaaguccgaauuuaauaccuauaagagaagugguaucauggagguggaccguagcgaagcuaaagaggggcuuaagaggggagagacuaccaaacacgccgucucucggggcacagccaagcugcgcugguucguggaacgaaacuugguaaaaccagaggguaaggugauagaucugggcugugggagaggaggcugguccuacuauugcgcggggcucaagaaaguuacugaagugaagggauacaccaaaggcgguccugggcacgaggaacccaucccgauggcuacauacggauggaauuuagucaagcugcauucaggcaaagacguguuuuucauuccaccugagaagugugauacgcuucugugcgacaucggcgagagcucgcccaacccaaccauugaagaggggaggacucuacggguccucaaaaugguggaacccuggcugcgcggaaaucaauuuuguaucaagauuuugaacccuuauaugccgucuguuguagagacacuggagcagaugcagagaaagcacgguggcaugcucgugaggaauccccuuagucgaaacuccacccaugaaauguacugggucagcugcgggacuggaaauaucgugucagcaguuaacaugacaucccggaugcuguuaaaucguuucaccauggcccacagaaaaccaacguaugagcgcgauguggaccugggcgcugguaccaggcacgucgccguggaaccugagguagcaaacuuggauauaauugggcagcggaucgaaaacaucaagcaugagcacaaaucuacauggcauuacgacgaggauaaucccuauaagacuugggccuaccacggaagcuaugaagugaaaccuaguggcuccgcuagcucuaugguuaacggcgucgugaagcuccugaccaagccaugggacgugauucccauggucacacaaauagcgaugacugauaccacaccuuuugggcagcagagaguuuucaaagagaagguggacacccgcacuccaaaagccaagaggggaacggcacaaaucauggaaguaacagcuaaauggcuaugggguuuucuuucacgaaauaagaagccccggauuuguaccagagaggaguucacuaggaaagugcgcaguaacgccgcaaucggcgccgucuuuguggacgagaaucaguggaacuccgcuaaggaggccguugaagaugagcguuucugggaccuggugcaucgggaaagagagcuccacaaacaggggaagugcgcgaccugcgucuacaauaugaugggaaaaagggaaaagaagcugggcgaguuugguaaagcaaaggggagccgcgccauuugguacaugugguugggagcucgauuccuggaguucgaagcccucggcuuuaugaacgaggaucacugguucucucgggaaaauucgcuuucaggcguggagggggagggacugcauaaauuagguuauauccugagagacauaagcaagaucccgggcgggaacauguacgcagaugacacagcuggaugggauacgaggauuaccgaagacgauuugcagaaugaggccaaaaucacugacauuauggaaccugagcacgcucuccuggccaaguccaucuuuaaacuaacauaucaaaacaagguaguucgcgugcagagaccagcaaagaauggcaccgucauggaugugauaagucggagggaccagcgugguucuggacaggugggaacuuacggccuuaacacauucaccaauauggaagcgcaacugauucgacagauggagagcgagggcaucuuuucccccucagaacucgagacaccuaaccuggccgggcgcgucuugaacugguuagaaaaacauggaguugagagacugaagcggauggcuaucaguggugaugacugugugguaaaaccaauugacgauagguucgccacugcacucaccgcucuuaaugacaugggcaaggugcgcaaagauauaccccagugggaaccgucuaagggguggaacgacuggcagcaagucccuuuuugcagccaccacuuccaucagcugaucaugaaggauggaagagagauugugguucccugucggaaucaggacgagcuagugggcagggcccgagucucccagggugcaggguggucacugcgugaaacggccugccucggaaaaagcuaugcgcaaauguggcaguugauguacuuucacagacgcgaucugcggcuugcugccaacgcaaucuguucugccgugccaguagacuggguuccuaccuccaggacaacuuggaguauucaugcucaccaucaguggaugaccacagaggauaugcugagcguguggaauagagucuggaucgaagagaaccccuggauggaagacaagacucacgugucguccuggggcgauguuccauaucucggcaaacgcgaggaccaauggugcgggucuuuaauaggacugaccgcccgggcaacgugggcuacaaauauccagguggccauuaaccaggucaggcgauugcuggguaaugagaacuaccucgacuacaugaccucaaugaagagauucaaaaaugaaagcgaucccgagggcgcgcuuugguga

SEQ ID NO: 13834 - RNA, 9879 nt, Artificial Sequence
  derived and/or modified CDS sequence (opt3) from DENV-1__FJ898399__SS-prME
agcgugacaaugcugcucaugcuuaugcccacagcacuggcuuuccacuugacuacgcgaggcggggaaccucauaugaucgucuccaagcaggaaaggggaaaaucuuuacuguuuaagacaucagccgguguuaacaugugcacacugauugcaauggaccucggcgaguucugugaagauacuaugaccuacaaaugcccgcggauuacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagggauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuaacaguagucgugggcgauguugcugggauucugggacagggcaagaaaaugauccgcccucagcccauggaguacaaguauagcuggaaguccugggggaaagccaagauaaucggagcggacgcccaaaauaccacuuuuauuaucgauggcccaaacaccccugaaugucccgacgaucagagagcuuggaauauuugggagguggaggacuacgguuucgggaucuuuacaacuaacauauggcuuaaauugagggauucauauacccaggucugcgaccaccgucucaugagugcagccauuaaggauucuaaagcugugcacgccgacaugggauacuggaucgaaagcgagaagaaugaaacauggaagcuggcacgggcguccuucauugagguuaaaacguguaucuggccaaagucacauacccuauggagcaacggcgugcuggaaucugagaugauaauccccaaaauuuaugguggcccuaucucccagcacaauuaccgaccaggguacuucacucaaacagccggaccguggcaucucggcaagcuggagcuugauuuugacuugugcgaagggaccacuguagucguggaugagcacugcggaaacagaggccccagucugaggacaaccacggugacugguaaaauuauccacgaaugguguugccgcagcuguaccuuaccuccacuccgguucaagggggaggacggaugcugguauggcauggagauaagacccgucaaggaaaaagaggaaaaucugguuaagucuaugguguccgcugguucaggcgagguagacaguuuuagccuugggcuguuguguauuucgaucaugaucgaagaggugaugaggucccgcuggucucgaaaaaugcucaugacaggaacccuggccgucuucuuucuacugauuaugggccagcucacuuggaacgaucugauccggcuuugcauuauggugggggcaaaugcuagcgaccguaugggaaugggcacaaccuacuuggcccugauggcaacauucaagaugagaccuauguuugccguugguuuacucuucaggcgccugacuucacgggaggugcuucugcuaaccauagggcucagucuggucgcuuccguggaauugccaaacucucuggaggaauuaggagauggccucgcgaugggcaucaugauucugaaacuucugacggacuuucagagccaucaauugugggccacacuccugucccuaaccuucaucaagacuaccuuuucacugcacuaugcauggaagacaauggcuaugguucuuagcauugugagucucuucccccuguguuugucuacuaccucccagaaaacgacauggcugccggucuuacucgggagccugggaugcaagccucuuaccauguuucugaucgccgagaauaaaauaugggguagaaagucguggccauugaacgaaggcaucauggccguagggauugugucaauccuccugucuagucuacugaaaaacgauguuccccuugcuggaccucucauugcaggcgguaugcugaucgccuguuacgugauauccgggagcucugcggacuugagcuuagagaaggcugccgaggucuccugggaagaggaagcagagcauucaggagccagucacaauauucugguggaaguacaggaugacggcacuaugaaaaucaaggaugaggagagggacgauacacucaccauccugcuuaaggcuacucuguuggcagugagcggcgucuauccccuaucuauuccagccacacuguucguuugguacuucuggcagaaaaagaaacaacgauccggggugcucugggacaccccuucacccccagaaguggagcgcgcgguccuggaugacggaauauaucggaucaugcagagaggucuuuuaggcaggagucagguggggguuggaguauuucaggaaaacguguuccauacgauguggcacgucacucguggcgcugugcugauguaccaagguaagcgccucgagccgagcugggccuccguuaaaaaggacuugauuucuuacgggggaggcuggcggcugcagggcucguggaauaccggggaggaagugcaggucaucgcaguggagccuggaaagaaccccaaaaauguacagacagccccagguaccuuuaagacaagcgaaggcgaggucggggcuauugcccucgauuucaaacccggaacuucaggcuccccuaucgugaacagagaagguaagauaguugggcuguauggaaauggcguggucaccacgaguggcacauacgugucugcaaucgcucaagccaaagcgagccaggaggggccacuucccgagauugaagacgagguuuuuaggaagcgaaaccugacuaucauggauuugcacccuggauccgguaagacccggcgcuaucuaccggccauugugagagaagcaaucaaaaggaagcugcggacacucauauuagcuccaacccgagucguggccucagagauggcugaagcacugaaaggcaugcccauuagauaccagacuaccgccguaaagucugagcauacagggaaagagaucguggaccuuaugugccacgccacguucacuaugcgccugcucagcccuguuagggucccaaauuauaacaugaucauuauggaugaagcucauuuuaccgaccccaguuccaucgcggcacguggauacauaagcacacgggugggcaugggugaggccgcugccauuuucaugaccgcaacuccuccggggucuguggaagccuuuccccaaucaaaugcugucauccaggaugaggaaagagacauuccagagagguccuggaacaguggauaugaguggaucacagauuucccuggcaagaccguaugguuugugcccagcauaaagucgggcaaugacauugcgaacuguuugcgcaaaaaugggaagcgaguuauccagcugucuagaaaaacguucgauacugaauaccagaagaccaagaauaacgacugggacuacguggucaccaccgauaucuccgagaugggagccaauuuccgggcagacagggugauugauccacgccguugccucaagccuguuauccugaaggacggucccgaaagagugauucuugcuggcccaaugccggucacuguggccagcgcagcccaacggagggggcgcauaggacgaaaccacaauaaagagggcgaucaguauaucuacaugggucagccucuaaacaaugacgaggaucaugcucacuggacagaagccaagaugcuguuggacaacauuaauacccccgaggggaucaucccagcguuauuugaacccgagagagaaaaaucagcagccauugauggcgaguaucggcugaggggagaggcucgcaagacauucguagaacucaugagaaggggcgaccugccuguguggcuuaguuacaaaguugccucugagggguuucaguauuccgaucggcguuggugcuucgacggagaacgcaacaaucaaguccuggaggaaaacauggauguggagauauggacuaaggagggugaaaggaaaaagcucagaccaagaugguuggacgcucggacguacagcgacccccuggcacuacgcgaguuuaaggaguucgccgcuggcagaaggucagugaguggggaucugauccucgagauuggaaaacuuccucagcaccugacccagcgggcccagaaugcauuagacaacuuggucaugcugcauaauagcgaacaaggcggucgagcguauagacacgccauggaggagcucccggauacaaucgaaacucugaugcuucuggcucucauugccguuuugaccgggggcgugacacuguuuuucuuauccggacgcggccuagggaagaccucuaucggacugcucuguguaauggcaagcuccgugcuucuguggauggcuucagucgagccacauuggauagccgcaucuaucauuuuggaauuuuuccugauggugcuccugauccccgagccugacaggcagcggacuccccaggauaaccagcuugccuacguugugauuggucuccuguuuaugaucuugacggucgcugcgaaugagaugggccuguuagaaaccaccaaaaaggaccuagggauaggacacguagccguggagaaccaccaucacgcagcuaugcuggauguugaccuccauccagccagugccuggacucuuuacgcaguggcuaccacaauuaucaccccuaugaugcgucacacuauugaaaacacaacggccaauaucucgcugaccgcgauagcuaaccaagccgcaaucuugaugggccuggauaaagguuggcccauuagcaagauggacaucggggucccacuccuggcccuuggcugcuauucccaggugaauccuuuaacucugacagcugcaguccucauguugguggcccauuacgcgauuaucggaccgggccugcaggcuaaggccaccagagaggcacagaaaaggaccgccgcugggauaaugaagaaccccacaguugauggaauuguggccaucgaccuagauccaguaguguaugacgcaaaauucgaaaagcagcugggccagaucaugcuccuuauucuguguacuucucagaucuugcugaugcgcacgaccugggcucucugcgagucaauaacacuggccacugguccuuuaaccacacuuugggaggggagccccggaaaauuuuggaauaccacuauugcggucuccauggccaacaucuuccggggcaguuaccuggccggugcuggccucgccuucucucuaaugaaaagccuagggggaggccgaagagggacgggagcacaaggcgaaacauugggugagaaguggaaaaggcagcugaaucagcucucaaaguccgaauuuaacaccuauaaacgcagugggauuauggagguugaccggagcgaagcuaaggagggacuuaaaagaggcgagacuaccaagcacgccgugucucgugguacagccaagcugaggugguucgucgaacggaauuuggugaaaccagagggcaagguaaucgaucugggguguggacgcggcgggugguccuacuauugcgcgggacucaaaaaggugacugaaguuaaaggcuacaccaagggugggccuggacacgaggaacccauaccgauggcuacauacggcuggaacuuagugaaacugcauucaggcaaggacgucuuuuucaucccaccugagaagugugauacgcuucugugcgacauuggggagagcucgcccaauccaaccaucgaagagggacgaacucuaagagugcucaaaauggucgaacccuggcugagggguaaccaguuuuguauuaagaucuugaauccuuauaugccgucugugguugagacacuggagcaaaugcagcggcgccacggcgggaugcucguaagaaacccccuuaguagaaauuccacccaugaaauguacugggugagcugcggaacuggcaacauugucucagcagugaauaugacaucccgaaugcuguuaaaccgguucaccauggcccaccguaaaccaacguaugagagagauguugaccugggugcugggacccgccacguggccgucgaaccugagguggcaaacuuggauaucauaggacagaggauugaaaauaucaagcaugagcacaaaucuacauggcauuacgacgaggauaaccccuauaagacuugggccuaccacggcagcuaugaaguaaagccuaguggcuccgcuagcucuauggugaaugggguugucaaacuccugaccaagccaugggacgugauccccauggugacacagauugcgaugacugauaccacaccuuuuggacaacagcgggucuucaaagagaagguugacaccagaacuccaaaagccaagcgcgguacggcacagauaauggaagugacagcuaaguggcuauggggcuuucuuucaaggaacaaaaagccccgaaucuguacccgggaggaguucacuagaaaaguaaggaguaaugccgcaauuggggccguguuugucgacgagaaccaauggaacuccgcuaaggaggccguggaagaugagcgcuucugggaccugguucaucgugaacgggagcuccacaaacagggaaagugcgcgaccugcguguacaacaugaugggcaagagagagaaaaagcugggugaguuugggaaagcaaagggaagcagggccaucugguacaugugguugggcgcucgcuuccuggaguucgaagcccucggcuuuaugaaugaggaucacugguucucucgagaaaacucgcuuucaggggucgagggagagggucugcauaaauuaggcuauauucugcgggacaucagcaagauaccagggggaaauauguacgcagaugacacagcuggcugggauacgagaaucaccgaagacgauuugcagaacgaggccaaaauuacugacaucauggaaccugagcacgcucuccuggccaaguccauuuuuaagcuaacauaucagaauaaagugguaaggguucaacgcccagcaaagaacgguaccgugauggaugucaucaguagacgggaccagagggggucuggacaggugggcacuuacggccuuaauacauucaccaacauggaagcgcagcugauacgucaaauggagagcgaggggauauuuucccccucagaacucgagacaccuaaccuggccggacgaguguuggauugguuagaaaaacauggugucgagcgccugaagagaauggcuaucaguggcgacgacuguguugugaaaccaaucgaugaccgguucgccacugcacucaccgcucuuaaugauauggggaagguaaggaaggacauuccccagugggaaccgucuaaaggauggaacgauuggcaacaggugccuuuuugcagccaccacuuccaucaacugauaaugaaggacggccgcgagaucgucgugcccuguagaaaucaggaugagcuaguuggucgggccagggugucccagggggcaggauggucacugcgagaaacggccugccucggcaaaagcuaugcgcagauguggcaauugauguacuuucaccguagagaccugcgccuugcugccaacgcaauuuguucugccgucccaguggauuggguaccuaccucccggacaacuuggaguauccaugcucaccaucaguggaugaccacagaggacaugcugagcguuuggaauaggguguggauugaagagaaccccuggauggaagauaagacucacaucucguccuggggcgacgucccauaucucgggaaaagagaggaccaguggugcggaucuuuaauaggucugaccgcccgcgcaacgugggcuacaaauauccaaguggccauuaaccagguucggagguugaucggcaaugagaacuaccuggauuacaugaccucaaugaagcgauucaagaaugaaagcgaccccgagggggcgcucugguga

SEQ ID NO: 13835 - RNA, 9879 nt, Artificial Sequence
  derived and/or modified CDS sequence (opt3) from DENV-1__FJ898401__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugggcacugcggaaacagaggccccaguuugaggacaaccacggucacugguaaaauuauccacgagugguguugccgcagcuguacccugccuccauuacgguuuaagggggaagacggaugcugguauggcauggagauaagacccguuaaggagaaagaagagaaucucgugaagucuaugguauccgcugguucaggcgaaguggacaguuucagccuggggcuucuguguauuucgaucaugaucgaggaagucaugaggucccgcuggucucgaaaaauguugaugacaggaacccucgccguguuuuuccugcuaauuaugggccagcugacuuggaacgaucucauccggcugugcauuaugguuggggcaaaugcuagcgaccguaugggaaugggcacaaccuaccuugccuugauggcaacauuuaagaugagaccuauguucgccgugggucuguuauuuaggcgccucacuucacgggagguccugcuucugaccauagggcuaagucucguggcuuccguugagcugccaaacucuuuggaagagcugggagauggcuuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuagggagccucggaugcaagccucugaccauguuccuuaucgccgaaaauaaaauaugggguagaaagucguggccacugaacgagggcaucauggccguggggauuguuucaaucuugcucucuagucugcuaaaaaacgaugugccccuggcuggaccucuuauugcaggcgguaugcucaucgccuguuacgucauauccgggagcucugcggaccugagcuuggaaaaggcugccgagguguccugggagaaagaagcagagcauucaggagccagucacaauauuuuaguagaagugcaggaugacggcacuaugaagaucaaggaugaggaaagggacgauacacugaccauccuccugaaagcuacucuucuggcagucagcggcguuuaucccuugucuauuccagccacacuauucguguggcauuuuuggcagaagaaaaagcaacgauccggggugcugugggacaccccuucacccccagaggucgagcgcgcggugcucgaugacggaauauaccggaucaugcagagaggucugcuuggcaggagucagguugggguaggaguguuccaggaaaacgucuuucacacgauguggcacgugacucguggcgcuguuuuaauguaucaagguaaacgccuggagccgagcugggccuccgugaagaaggaccucauuucuuacgggggaggcuggcgguugcagggcucguggaauaccggggaagagguccaggugaucgcaguagagccuggaaaaaaccccaagaauguccagacagccccagguaccuucaaaacaagcgaaggcgaggugggggcuauugcccuggauuuuaagcccggaacuucaggcuccccuaucguuaacagagaagguaaaauaguggggcucuacggaaauggcgucgugaccacgaguggcacauauguuucugcaaucgcucaagccaaggcgagccaggaggggccacugcccgaaauugaggacgagguguucaggaagcgaaaccuuacuaucauggaucugcauccuggauccgguaaaacccggcgcuacuugccggccauugucagagaagcaaucaagaggaaacuacggacacugauacucgcuccaacccgagugguagccucagagauggcugaagcauuaaagggcaugcccauuagauaucagacuaccgccgugaaaucugagcacacagggaaggaaaucguugaccugaugugccaugccacguuuacuaugcgccuucugagcccugucagggugccaaauuacaacaugaucauuauggaugaggcucacuucaccgaccccaguuccaucgcggcacguggauauauaagcacacgggugggcaugggugaggccgcugccauuuuuaugaccgcaacuccuccggggucugucgaagccuucccccaaucaaaugcuguaauccaggaugaggaaagagacauuccagagagguccuggaacaguggauacgaauggaucacagauuuuccuggcaagaccgugugguucguucccagcauaaaaucgggcaaugacauugcgaacugucuccgcaagaaugggaaacgagugauccaguugucuagaaagacguucgauacugaguaucagaaaacaaagaacaacgacugggacuacgucgugaccaccgauaucuccgagaugggagccaauuuucgggcagacaggguuauugauccacgccguugccugaagccugugauccucaaagacggucccgaaagagucauucuggcuggcccaaugccggugacuguagccagcgcagcccaacggagggggcgcauaggacgaaaccauaauaaggagggcgaucaguacaucuauaugggucagccucuuaacaaugacgaagaucacgcucacuggacagaggccaaaaugcuacuggacaacauuaauacccccgaggggaucaucccagcguuguucgaacccgagagagaaaagucagcagccauugauggcgaguaccgguuaaggggagaagcucgcaaaacauuuguggagcugaugagaaggggcgaccucccuguuuggcugaguuauaaggucgccucugagggguuccaguacuccgaucggcguuggugcuuugacggagaacgcaacaaucaagugcuugaggaaaacauggauguggagauauggacuaaagaaggugagcgaaagaagcugagaccaagguggcucgacgcucggacguauagcgaccccuuggcacugcgcgaguucaaagaauuugccgcuggcagaaggucagucaguggggaucuaauccuggagauuggaaagcucccucagcaucuuacccagcgggcccagaaugcacuggacaacuuaguuauguugcacaauagcgaacaaggcggucgagcguacagacaugccauggaggaacugccggauacaaucgagacucucaugcugcuugcucugauugccgugcucaccgggggcguaacauuguucuuucuguccggacgcggcuuagggaaaaccucuaucggacuacugugugugauggcaagcuccguccuccuuuggauggcuucaguggagccacacuggauagccgcaucuaucauucuggaauucuuuuugaugguucugcucauccccgagccugacaggcagcggacuccccaggauaaccagcuggccuauguggucauuggucuucucuucaugauccugacgguagcugcgaaugaaaugggcuugcuggagaccacaaagaaagacuuagggauaggacacguggccguugagaaccaucaccaugcagcuaugcuagauguggaccugcacccagccagugccuggacucucuacgcagucgcuaccacaauuaucaccccuaugaugcgucauacuauugaaaacacaacggccaauaucucgcuuaccgcgauagcuaaccaagccgcaauccugaugggcuuggauaaggguuggcccauuagcaagauggacaucggggugccacugcucgcccugggcugcuacucccaggucaauccucuuacuuuaacagcugcagugcugaugcucguugcccacuaugcgauuaucggaccgggcuugcaggcuaaagccaccagagaggcacaaaagaggaccgccgcugggauaaugaaaaaccccacaguggauggaauuguagccaucgaccuggauccaguggucuacgacgcaaaguuugaaaaacagcuaggccagaucaugcugcucauucuuuguacuucucagauccuguugaugcgcacgaccugggcucugugcgagucaauaacacucgccacugguccucugaccacauuaugggaagggagccccggaaaguucuggaauaccacuauugcgguuuccauggccaacaucuuccggggcaguuaucuugcaggugcuggccuggccuuuucucucaugaagagccuagggggaggccgaagagggacgggagcacacggcgagacacugggugagaaauggaagaggcaauugaaucagcugucaaaauccgaauucaacaccuacaagcgcagugggauuauggagguggaccggagcgaagcuaaagagggacucaagagaggcgaaacuaccaagcaugccgucucucgugguacagccaaacuuaggugguuuguggagcggaaucugguaaagccagagggcaaagugaucgauuugggguguggacgcggcgggugguccuauuacugcgcgggacugaagaaaguuacugaagugaagggcuauaccaaaggugggccuggacacgaggaacccauaccgauggcuacauacggcuggaaccucgucaaguuacauucaggcaaggacguguucuuuaucccaccugagaaaugugauacgcugcuuugcgacauuggggaaagcucgcccaauccaaccaucgaggagggacgaacucugagaguccuaaagaugguggaacccuggcucagggguaaccaguucuguauuaaaauccugaauccuuacaugccgucuguuguagagacauuggaacagaugcaacggaagcacggcgggaugcuggugcgcaacccccucaguagaaauuccacccacgagauguauugggucagcugcggaacuggcaacauugugucagcaguuaauaugacauccaggaugcuucugaaccgauuuaccauggcccaucggaaaccaacguacgagcgugauguggacuuaggugcugggaccagacacgucgccguggaaccugagguagcaaaccuggauaucauaggacagcgcauugaaaauaucaagcaugagcacaagucuacauggcauuaugacgaagauaaccccuacaaaacuugggccuaucacggcagcuacgaggugaagccuaguggcuccgcuagcucuaugguuaauggggucgugaaauugcucaccaagccaugggacgugauccccauggucacacagauugcgaugacugauaccacaccuuucggacagcaaaggguuuuuaaagagaagguggacacccggacuccaaaggccaaaagagguacggcacagauaauggaaguaacagcuaaguggcuguggggcuuccuaucacgcaacaaaaagcccaggaucuguacccgagaggaauuuacucggaaagugagaaguaaugccgcaauuggggccgucuucguggacgagaaccaguggaauuccgcuaaggaagccguugaggaugagagguuuugggaccuugugcaccgcgaacgugagcugcauaagcaaggaaaaugcgcgaccugcgucuauaacaugaugggcaagcgggaaaaaaagcucggugaguucgggaaagcaaagggaagcagagccaucugguacauguggcugggcgcuagguucuuggaauuugaggcccugggcuucaugaaugaggaucacugguuuucucgcgaaaacucgcucucagggguggagggagaaggucuucauaaacugggcuacauuuuacgagacaucagcaagauaccggggggaaauauguaugcagaugacacagcuggcugggauacgcggaucaccgaggacgaucugcagaacgaggccaagauuacugacaucauggaaccugagcacgcuuugcucgccaaauccauuuucaagcugacauaccagaauaaaguaguuagagugcagaggccagcaaagaacgguaccgucauggaugugaucagucgcagagaccaacgggggucuggacaggugggcacuuauggccuaaauacauuuaccaacauggaagcgcagcuuauaaggcagauggagagcgaagggauuuucucccccucagagcuggagacaccuaaccucgccggacguguccuggauugguuggaaaaacacgguguugagcgauuaaagcgcauggcuaucaguggcgacgacugugugguaaagccaaucgaugacagauuugccacugcacugaccgcucucaaugauauggggaaagugcggaaggacauuccccaaugggaaccgucuaaaggauggaacgauuggcagcaggucccuuucugcagccaucacuuucaucagcuuauaaugaaggacggcagggagaucgugguucccugucgcaaucaagaugaacugguggguagagcccgggucucccagggggcaggauggucacuaagggagacggccugccugggcaaaagcuacgcgcagauguggcagcucauguauuuccaccgacgugacuugagacuggcugccaacgcaauuuguucugccgugccaguagauuggguuccuaccucccgcacaacuuggaguauccaugcucaccaccaauggaugaccacagaggacaugcuuagcguguggaaucgggucuggauugaagagaaccccuggauggaagauaagacucauaucucguccuggggcgacgugccauaccuggggaagagggaggaccaguggugcggaucucucauagguuuaaccgccagagcaacgugggcuacaaauauccagguugccauuaaccaagugcgccggcugaucggcaaugaaaacuauuuggauuacaugaccucaaugaaaagguuuaagaaugagagcgaccccgagggggcgcugugguga

SEQ ID NO: 13836 - RNA, 9879 nt, Artificial Sequence
  derived and/or modified CDS sequence (opt3) from DENV-1__FJ898402__SS-prME
agcgugacaaugcugcuaaugcuuaugcccacagcacuggcuuuccacuugacuacgcgaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaauuacauccuccuggaaaacgacaugaaauuuacaguagucgugggcgauguugcugggauuuuagcccagggaaagaaaaugauccgcccucagcccauggaguauaaguacagcuggaaguccuggggcaaagcgaagauaaucggggccgacgugcaaaauaccacuuucauuaucgauggaccaaacaccccugaaugucccgacgaucagagagcuuggaauauuugggaggucgaggacuauggcuuugguaucuucacaacuaacauauggcugaaacuuagggauucauacacccaggugugcgaccaucguuugaugagugcagccauuaaggauucuaaagcuguucacgccgacaugggguauuggaucgaaagcgagaagaaugaaacauggaagcucgcacgggcguccuucauugaggugaaaacguguaucuggccaaagucacacacccuguggagcaacggaguacuagaaucugagaugauaauccccaaaauuuacggcgguccuaucucccagcauaauuaccgaccaggcuauuuuacucaaacagccgggccguggcaccugggaaagcucgagcuggauuucgaccuuugcgaaggcaccacugucgugguggaugagcauugcgggaacagaggacccaguuugaggacaaccacggucacuggcaaaauuauccacgaaugguguugccgcagcuguacccugccuccauuacgguuuaagggugaggacgggugcugguacggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaucuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaccaacugugggccacauugcucucccugaccuuuaucaagacuaccuucucacuacauuacgcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucuagucugcucaagaaugaugugccccuggcugggccucuuauugcaggaggcaugcucaucgccuguuaugucauauccgguagcucugcggaccugagcuuggagaaggcugccgagguguccugggaagaggaagcagagcacucaggggccagucauaauauuuuaguagaagugcaggaugacggaacuaugaaaaucaaggaugaggagagggacgauacacugaccauccuccugaaggcuacucuucuggcagucagcggcguuuaccccuugucuauuccagccacacuauucgugugguauuuuuggcagaaaaagaaacaacgauccggcgugcugugggacaccccuucacccccagaagucgagcgcgcggugcucgaugacgggauauaccggaucaugcagagaggacugcuugguaggagucagguuggcguagggguguuccaggaaaacgucuuucacacgauguggcaugugacucguggagcuguuuuaauguaccaaggcaagcgccuggagccgagcugggccuccgugaaaaaggaccucauuucuuauggugggggauggcgguugcagggcucguggaauaccggcgaggaaguccaggugaucgcaguagagccugggaagaaccccaaaaauguccagacagccccaggaaccuucaagacaagcgaaggugaggugggcgcuauugcccuggauuuuaaacccgggacuucaggauccccuaucguuaacagagaaggcaagauagugggucucuacgggaauggagucgugaccacgaguggcacauauguuucugcaaucgcucaagccaaagcgagccaggagggcccacugcccgagauugaagacgagguguucaggaagcgaaaccuuacuaucauggaucugcacccuggguccggaaagacccggcgcuacuugccggccauugucagagaagcaaucaaaaggaagcuacggacacugauacucgcuccaacccgagugguagccucagagauggcugaagcauuaaaagguaugcccauuagauaucagacuaccgccgugaagucugagcacacaggcaaagagaucguugaccugaugugccaugccacguuuacuaugcgccuucugagcccugucagggugccaaauuacaacaugaucauuauggaugaagcucacuucaccgaccccaguuccaucgcggcacguggguauauaagcacacgggugggaaugggcgaggccgcugccauuuuuaugaccgcaacuccuccggguucugucgaagccuucccccaaucaaaugcuguaauccaggaugaggaaagagacauuccagagagguccuggaacaguggguacgaguggaucacagauuuuccuggaaagaccgugugguucguucccagcauaaagucgggcaaugacauugcgaacugucuccgcaaaaauggcaagcgagugauccaguugucuagaaaaacguucgauacugaauaccagaagaccaagaacaacgacugggacuaugucgugaccaccgauaucuccgagaugggggccaauuuucgggcagacaggguuauugauccacgccguugccugaagccugugauccucaaggacggacccgaaagagucauucuggcugguccaaugccggugacuguagccagcgcagcccaacggaggggccgcauagggcgaaaccauaauaaagagggagaucaguacaucuauaugggccagccucuuaacaaugacgaggaucacgcucauuggacagaagccaagaugcuacuggacaacauuaauacccccgaggguaucaucccagcguuguucgaacccgagagagaaaaaucagcagccauugauggggaguaccgguuaaggggcgaggcucgcaagacauuuguggaacugaugagaaggggagaccucccuguuuggcugaguuauaaagucgccucugagggcuuccaguacuccgaucggcguuggugcuuugacggggaacgcaacaaucaagugcuugaggaaaacauggauguggagauauggacuaaggagggagaaaggaaaaagcugagaccaagauggcucgacgcucggacguauagcgaccccuuggcacugcgcgaguucaaggaauuugccgcugguagaaggucagucaguggcgaucuaauccuggagauugggaaacucccucagcaccuuacccagcgggcccagaaugcacuggacaacuuaguuauguugcacaauagcgaacaaggaggccgagcguacagacaugccauggaggagcugccggauacaaucgaaacucucaugcugcuugcucugauugccgugcucaccggugggguaacauuguucuuucuguccggccgcggauuaggcaagaccucuaucgggcuacugugugugauggcaagcuccguccuccuuuggacugcuucaguggagccacacuggauagccgcaucuaucauucuggaguucuuuuugaugguucugcucauccccgagccugacaggcagcggacgccccaggauaaccagcuggccuacguggucauuggacuucucuucaugauccugaccguagcugcgaaugagauggguuugcuggaaacaacuaaaaaggacuuaggcauagggcauguggccguugagaaccaccaccaugcagcuaugcuagauguggaccugcacccagccagugccuggacccucuaugcagucgcuacaaccauuaucacuccuaugaugcgucauacaauugaaaacacgaccgccaauaucucgcuuacugcgauagcuaaccaagccgcaauccugaugggauuggauaaaggcuggcccauuagcaagauggacaucggugugccacugcucgcccuggggugcuacucccaggucaauccucuuacauuaaccgcugcagugcugaugcucguugcccacuaugcgauuaucggcccgggauugcaggcuaaggccaccagagaggcacagaaaaggacagccgcuggcauaaugaagaaccccacuguggaugggauuguagccaucgaccuggauccaguggucuacgacgcaaaauuugaaaagcagcuaggacagaucaugcugcucauucuuuguacgucucagauccuguugaugcgcaccacaugggcucugugcgagucaauaacucucgccaccggcccucugacaaccuuaugggaggguagccccgggaaauucuggaauacuacgauugcgguuuccauggccaacaucuuccggggaaguuaucuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuacaaacgcagugguauuauggagguggaccggagcgaagcuaaggaggggcucaaaagaggagagaccacaaagcaugccgucucucguggcacugccaaacuuaggugguuuguggaacggaaucugguaaaaccagaggguaaggugaucgauuugggcugugggcgcggaggcugguccuauuacugcgcggggcugaaaaagguuaccgaagugaaaggauacacaaagggcgguccugggcacgaggaacccauaccgauggcuacguauggauggaaccucgucaaauuacacucaggcaaggacguguucuuuaucccaccugagaagugugauacccugcuuugcgacauuggcgagagcucgcccaauccaacuaucgaagaggggcgaacacugagaguccuaaaaaugguggaacccuggcucaggggaaaccaguucuguauuaagauccugaauccuuacaugccgucuguuguagagaccuuggagcaaaugcagcggaaacaugguggcaugcuggugcgcaacccccucaguagaaauuccacucacgaaauguauugggucagcugcgggacaggaaacauugugucagcaguuaauaugaccuccaggaugcuucugaaccgauuuacgauggcccaucggaagccaaccuacgagcgugauguggacuuaggcgcugguacaagacacgucgccguggaaccugagguagcaaaccuggauaucauagggcagcgcauugaaaauaucaaacacgagcauaagucuacuuggcacuaugacgaggauaaccccuacaagaccugggccuaucauggaagcuacgaagugaaaccuaguggcuccgcuagcucuaugguuaauggcgucgugaaguugcucacaaaaccaugggacgugauccccauggucacucagauugcgaugaccgauacaaccccuuucgggcaacagaggguuuuuaaggagaaaguggacacucggacgccaaaggccaagagaggaacagcacagauaauggaaguaaccgcuaaauggcugugggguuuccuaucacgcaacaagaaacccaggaucuguacucgagaggaauuuacccggaaggugagaaguaaugccgcaauuggcgccgucuucguggacgagaaccaauggaacuccgcuaaagaggccguugaagaugagagguuuugggaccuugugcaccgcgaacgugagcugcauaagcaggggaagugcgcgacaugcgucuacaacaugaugggaaaacgggaaaagaaacucggcgaguucgguaaggcaaaagggagcagagccaucugguauauguggcugggagcuagguucuuggaguuugaagcccugggcuucaugaaugaggaucacugguuuucucgcgaaaacucgcucucaggcguggagggggagggacuucacaagcuggguuacauuuuacgagacaucagcaaaauaccgggcgggaauauguaugcagaugacacggcuggaugggauacccggaucacugaagacgaucugcagaacgaggccaagauuacagacaucauggaaccugagcaugcuuugcucgccaaguccauuuucaaacugaccuaccagaauaagguaguuagagugcaaaggccagccaaaaacggcacugucauggaugugaucagucgcagagaccagcgggguucuggacaggugggaacauauggccuaaauaccuuuacaaacauggaagcgcagcuuauaaggcaaauggagagcgagggcauuuucucccccucagaacuggagacuccuaaccucgccgggcguguccuggauugguuggaaaagcacggaguugagcgauuaaaacgcauggcuaucaguggugacgacugugugguaaagccaaucgaugacagauuugccaccgcacugacggcucucaaugauaugggcaaggugcggaaagacauuccccagugggaaccgucuaagggguggaacgauuggcagcaggucccuuucugcagccaucacuuucaccaacuuauaaugaaagacggaagggagaucgugguucccugucgcaaucaggaugagcuggugggcagagcccgggucucccagggugcaggguggucacuaagggaaaccgccugccugggaaagagcuacgcgcagauguggcaacucauguauuuccaucgacgugacuugagacuggcugccaacgcaauuuguucugccgugccaguagauuggguuccuacaucccgcacuaccuggaguauccacgcucaucaccaguggaugacaacugaggacaugcuuagcguguggaaucgggucuggauugaagagaaccccuggauggaagauaaaacccauaucucguccuggggcgacgugccauaccugggcaagagggaggaccaguggugcgggucucucauaggauuaacggccagagcaacaugggcuaccaauauccaaguugccauuaaccaggugcgccggcugaucgguaaugagaacuacuuggauuauaugacuucaaugaagagguuuaaaaaugaaagcgaccccgagggcgcgcugugguga

SEQ ID NO: 13837 - RNA, 9879 nt, Artificial Sequence
  derived and/or modified CDS sequence (opt3) from DENV-1__FJ898403__SS-prME
agcgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucuagucugcucaagaaugaugugccccuggcugggccucuuauugcaggaggcaugcucaucgccuguuacgucauauccgguagcucugcggaccugagcuuggagaaggcugccgagguguccugggaagaggaagcagagcauucaggggccagucacaauauuuuaguagaagugcaggaugacggaacuaugaaaaucaaggaugaggagagggacgauacacugaccauccuccugaaggcuacucuucuggcagucagcggcguuuaucccuugucuauuccagccacacuauucgugugguacuuuuggcagaaaaagaaacaacgauccggcgugcugugggacaccccuucacccccagaagucgagcgcgcggugcucgaugacgggauauaucggaucaugcagagaggacugcuugguaggagucagguuggcguagggguguuccaggaaaacgucuuucauacgauguggcacgugacucguggagcuguuuuaauguaccaaggcaagcgccuggagccgagcugggccuccgugaaaaaggaccucauuucuuacggugggggauggcgguugcagggcucguggaauaccggcgaggaaguccaggugaucgcaguagagccugggaagaaccccaaaaauguccagacagccccaggaaccuucaagacaagcgaaggugaggugggcgcuauugcccuggauuuuaaacccgggacuucaggauccccuaucguuaacagagaaggcaagauagugggucucuaugggaauggagucgugaccacgaguggcacauacguuucugcaaucgcucaagccaaagcgagccaggagggcccacugcccgagauugaagacgagguguucaggaagcgaaaccuuacuaucauggaucugcacccuggguccggaaagacccggcgcuauuugccggccauugucagagaagcaaucaaaaggaagcuacggacacugauacucgcuccaacccgagugguagccucagagauggcugaagcauuaaaagguaugcccauuagauaccagacuaccgccgugaagucugagcauacaggcaaagagaucguugaccugaugugccacgccacguuuacuaugcgccuucugagcccugucagggugccaaauuauaacaugaucauuauggaugaagcucauuucaccgaccccaguuccaucgcggcacguggguacauaagcacacgggugggaaugggcgaggccgcugccauuuuuaugaccgcaacuccuccggguucugucgaagccuucccccaaucaaaugcuguaauccaggaugaggaaagagacauuccagagagguccuggaacaguggguaugaguggaucacagauuuuccuggaaagaccgugugguucguucccagcauaaagucgggcaaugacauugcgaacugucuccgcaaaaauggcaagcgagugauccaguugucuagaaaaacguucgauacugaauaccagaagaccaagaacaacgacugggacuacgucgugaccaccgauaucuccgagaugggggccaauuuucgggcagacaggguuauugauccacgccguugccugaagccugugauccucaaggacggacccgaaagagucauucuggcugguccaaugccggugacuguagccagcgcagcccaacggaggggccgcauagggcgaaaccacaauaaagagggagaucaguauaucuacaugggccagccucuuaacaaugacgaggaucaugcucacuggacagaagccaagaugcuacuggacaacauuaauacccccgaggguaucaucccagcguuguucgaacccgagagagaaaaaucagcagccauugauggggaguaucgguuaaggggcgaggcucgcaagacauuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauauggacuaaggagggagaaaggaaaaagcugagaccaagauggcucgacgcucggacguacagcgaccccuuggcacugcgcgaguucaaggaauuugccgcugguagaaggucagucaguggcgaucuaauccuggagauugggaaacucccucagcaccuuacccagcgggcccagaaugcacuggacaacuuaguuauguugcauaauagcgaacaaggaggccgagcguauagacacgccauggaggagcugccggauacaaucgaaacucucaugcugcuugcucugauugccgugcucaccggugggguaacauuguucuuucuguccggccgcggauuaggcaagaccucuaucgggcuacugugugugauggcaagcuccguccuccuuuggauggcuucaguggagccacauuggauagccgcaucuaucauucuggaguucuuuuugaugguucugcucauccccgagccugacaggcagcggacuccccaggauaaccagcuggccuacguggucauuggacuucucuucaugauccugacgguagcugcgaaugagauggguuugcuggaaaccaccaaaaaggacuuaggcauagggcacguggccguugagaaccaccaucacgcagcuaugcuagauguggaccugcauccagccagugccuggacucucuacgcagucgcuaccacaauuaucaccccuaugaugcgucacacuauugaaaacacaacggccaauaucucgcuuaccgcgauagcuaaccaagccgcaauccugaugggauuggauaaaggcuggcccauuagcaagauggacaucggugugccacugcucgcccuggggugcuauucccaggucaauccucuuacuuuaacagcugcagugcugaugcucguugcccauuacgcgauuaucggcccgggauugcaggcuaaggccaccagagaggcacagaaaaggaccgccgcuggcauaaugaagaaccccacaguggaugggauuguagccaucgaccuggauccaguggucuaugacgcaaaauuugaaaagcagcuaggacagaucaugcugcucauucuuuguacuucucagauccuguugaugcgcacgaccugggcucugugcgagucaauaacacucgccacuggcccucugaccacauuaugggaggguagccccgggaaauucuggaauaccacuauugcgguuuccauggccaacaucuuccggggaaguuaccuugcaggcgcuggucuggccuuuucucucaugaaaagccuaggcgggggacgaagaggcacgggggcacaaggagaaacacugggcgagaaguggaaaaggcaguugaaucagcugucaaaguccgaguucaacaccuauaaacgcagugguauuauggagguggaccggagcgaagcuaaggaggggcucaaaagaggagagacuaccaagcacgccgucucucguggcacagccaaacuuaggugguuuguggaacggaaucugguaaaaccagaggguaaggugaucgauuugggcugugggcgcggaggcugguccuacuauugcgcggggcugaaaaagguuacugaagugaaaggauacaccaagggcgguccugggcacgaggaacccauaccgauggcuacauacggauggaaccucgucaaauuacauucaggcaaggacguguucuuuaucccaccugagaagugugauacgcugcuuugcgacauuggcgagagcucgcccaauccaaccaucgaagaggggcgaacucugagaguccuaaaaaugguggaacccuggcucaggggaaaccaguucuguauuaagauccugaauccuuauaugccgucuguuguagagacauuggagcaaaugcagcggaaacacgguggcaugcuggugcgcaacccccucaguagaaauuccacccaugaaauguacugggucagcugcgggacuggaaacauugugucagcaguuaauaugacauccaggaugcuucugaaccgauuuaccauggcccaccggaagccaacguaugagcgugauguggacuuaggcgcugguaccagacacgucgccguggaaccugagguagcaaaccuggauaucauagggcagcgcauugaaaauaucaaacaugagcacaagucuacauggcauuacgacgaggauaaccccuauaagacuugggccuaccacggaagcuaugaagugaaaccuaguggcuccgcuagcucuaugguuaauggcgucgugaaguugcucaccaaaccaugggacgugauccccauggucacacagauugcgaugacugauaccacaccuuucgggcaacagaggguuuuuaaggagaaaguggacacccggacuccaaaggccaagagaggaacggcacagauaauggaaguaacagcuaaauggcugugggguuuccuaucacgcaacaagaaacccaggaucuguacccgagaggaauuuacucggaaggugagaaguaaugccgcaauuggcgccgucuucguggacgagaaccaauggaacuccgcuaaagaggccguugaagaugagagguuuugggaccuugugcaucgcgaacgugagcugcacaagcaggggaagugcgcgaccugcgucuacaacaugaugggaaaacgggaaaagaaacucggcgaguucgguaaggcaaaagggagcagagccaucugguacauguggcugggagcuagguucuuggaguuugaagcccugggcuucaugaaugaggaucacugguuuucucgcgaaaacucgcucucaggcguggagggggagggacuucauaagcuggguuauauuuuacgagacaucagcaaaauaccgggcgggaauauguacgcagaugacacagcuggaugggauacgcggaucaccgaagacgaucugcagaacgaggccaagauuacugacaucauggaaccugagcacgcuuugcucgccaaguccauuuucaaacugacauaucagaauaagguaguuagagugcaaaggccagccaaaaacggcaccgucauggaugugaucagucgcagagaccagcgggguucuggacaggugggaacuuacggccuaaauacauuuaccaacauggaagcgcagcuuauaaggcaaauggagagcgagggcauuuucucccccucagaacuggagacaccuaaccucgccgggcguguccuggauugguuggaaaagcauggaguugagcgauuaaaacgcauggcuaucaguggugacgacugugugguaaagccaaucgaugacagauuugccacugcacugaccgcucucaaugauaugggcaaggugcggaaagacgucccccagugggaaccgucuaagggguggaacgauuggcaacaggugccuuucugcagccaccacuuucaucaacuuauuaugaaagacggaagggagauaguugugcccugucgcaaucaggaugagcuggucggcagagcccgggugucccagggugcaggguggucacuaagggaaacggccugccugggaaagagcuaugcgcagauguggcaacucauguacuuccaccgacgugacuugagacuggcugccaacgcaaucuguucugccguaccaguugauugggugccuaccucccgcacaacuuggaguauucaugcucaccaucaguggaugaccacagaggacaugcuuagcgucuggaaucggguguggaucgaagagaaccccuggauggaagauaaaacucacauuucguccuggggcgacguuccauaucugggcaagagggaggaccaguggugcgggucucucaucggauuaaccgccagagcaacgugggcuacaaauauacaaguggccaucaaccagguccgccggcugauugguaaugagaacuacuuggauuacaugaccucaaugaagagguuuaaaaaugaaagcgaccccgagggcgcgcugugguga

SEQ ID NO: 13838 - RNA, 9879 nt, Artificial Sequence
  derived and/or modified CDS sequence (opt3) from DENV-1__FJ898404__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgcuagcuuguucccccuguguuuaaguaccacgucucagaagacaaccuggcucccgguacugcuuggcucccuggggugcaaaccuuugacuauguuucucauuacagagaccaagaucuggggaagaaaaagcuggccacugaaugaagguauaauggccgugggcguugugucgauccuacugucaucucuucucaagaacgaugucccccuggccgggccuuugauugcuggaggcauguuaaucgcauguuaugugauuagugguuccagcgccgaccugucucucgagaaagcggcugagguaagcugggaagaggaagccgagcacuccggggcaucacauaacauccugguggucguucaggaugacggaacuaugaagauaaaagaugaagagagggacgauacacuuaccauucuguugaaggccacgcuacuggcugugaguggcguguacccccucagcaucccagcaacucuguucgucugguauuuuuggcaaaagaaaaagcagcgaucuggcgugcuuugggacaccccuucacccccagagguugaacgcgccguauuagaugacgggaucuaccggauuaugcagagaggacugcucgguaggagccaggugggcgucgggguguuccaagagaauguuuuccacacaauguggcacgugacccguggagcggucuugauguaucagggcaaacgccuggaaccgaguugggcuagcgugaagaaagaccucauauccuacggugggggauggcggcugcagggcucuuggaacacaggcgaggagguacaggucaucgccguggaaccugggaagaaucccaagaacguucaaacugcaccaggaaccuuuaaaacgcccgagggugaagugggcgccauugcucuugauuucaagccugggacaucgggaagcccaaucgucaauagagagggcaaaauugugggucuguacgggaacggaguugugacuaccucaggcacauaugucuccgccaucgcacaggcuaaggccagucaggaaggccccuugccugagauagaggacgaaguguuuaggaaacgaaaucuaaccaucauggaucugcauccggggucuggaaagacucggcgcuaccucccagcgauuguaagagaggccaucaagaggaaauuacggacccugauucuugcacccacacgagugguugcuagcgaaauggccgaggcucugaaggguaugccuaucagauaucaaacgacugcagucaaauccgaacacaccggcaaggagauaguggaccucaugugccaugccacauucaccaugcgcuugcugucaccagugaggguccccaacuacaauaugauuaucauggaugaggcccacuuuacugacccuucuagcaucgcugcgcguggguauauuaguacacggguaggaaugggcgaagcagccgcuaucuucaugaccgccacgccgcccgguuccguggaggcauuuccacagagcaacgccguuauacaggaugaagagagagacauuccugaaaggucuuggaacucaggguacgaguggaucacugauuuccccggaaaaacagugugguuugucccauccauuaagaguggcaacgacaucgcuaauugucuccgcaagaacggcaaacgagugauacagcugagcagaaagaccuucgauaccgaguaucagaaaacuaagaauaacgacugggacuacguugugacaaccgauauuucggaaaugggggcgaacuuucgggccgacagggucaucgauccucgccguugccuuaaacccgugauccuaaaggacggaccagagagaguaauucuggcagguccgaugccugugacaguugcuucugccgcacagcggaggggccgcaucgggcgaaaucauaacaaggaaggagaucaguacauuuauaugggccagcccuugaauaacgacgaggaucacgcccacuggacugaggcuaaaauguuacuggacaauauaaacacgccagaagguaucauucccgcccucuucgagccugaaagagagaaguccgcggcaaucgauggggaauaccggcugaggggcgaggcccgcaaaaccuucgucgagcuuaugagaaggggagaccugccaguguggcucagcuauaagguggcuucagaaggcuuucaauacagugaucggcguuggugcuucgacggggagcgcaauaaccaggucuuggaagagaauauggauguugaaaucuggacaaaagagggagagcgaaagaaacugagacccagguggcuagacgcccggacuuauucugacccucuggcucuccgcgaauuuaaggaguucgcagccgguagaagguccgugagcggcgaucuuauucuggaaauagggaaguuaccgcagcauuugacccagcgggcucaaaacgcccuggacaaucucguaaugcugcacaacucagagcagggaggccgagcauacagacaugcgauggaggaacuuccagauacaaucgagacccugaugcucuuggcccugauugcuguguuaacugguggggucacgcuauuuuuccugaguggccgcggacucggcaaaaccagcaucgggcuucugugugugauggccuccucuguuuugcuguggauggcaagcguggaaccccacuggauugcugccuccaucauacucgaguuuuuccugaugguccuucucaucccugaacccgacaggcagcggacaccacaggauaaucaacuggcauauguagugauuggauugcuguuuaugaucuuaacuguugccgcuaacgagaugggucuacuggagaccacaaagaaagaccucggcauugggcacguggcggucgaaaaucaucaccaugccaccaugcuugauguggaccugcacccugcaucagcuuggacuuuguacgccgucgccacaacgaucauaacccccaugaugcgucauacuauugagaacacaaccgcaaacaucucucugaccgcuauugccaaucaggcggcuauccucaugggacuggauaagggcuggccaauaaguaaaauggacaucggugugccucuuuuagcccuggggugcuacucgcagguuaacccgcucacauugacugcagccgugcugaugcuaguagcucacuaugcaauuaucggccccggacugcaagccaaggcgacgagagaagcucagaagaggaccgccgcaggcauuaugaaaaauccaacaguggaugggaucgucgccauagaccucgauccuguuguguacgacgcuaaguucgagaaacagcuuggacagauuaugcuguugauccuguguacuagccaaauccuccugaugcgcaccacaugggccuuaugcgaauccauuacccuugcaacuggcccccugacgacacucugggaggguucuccagggaaguuuuggaacaccacuaucgcugucucaauggccaauauauuccggggaagcuaucuagcgggcgccggucuggcauuuuccuugaugaaaagucugggcgggggacgaagaggcaccggggcucagggagagacacucggcgaaaaguggaagaggcagcuuaaccagcugucuaaaagcgaguucaauauuuacaagcgcucagguaucauggaaguggaccgguccgaggccaaagaaggguugaagagaggagagacuacccgucacgcaguaaguaggggcacagcuaaacugcggugguucguggagcgcaaccucguuaagccugaagguaaggugauugauuuaggcugugggcgaggaggcuggagcuauuacugcgccgggcugaaaaaggucacggaggugaaaggauauaccaagggcggucccgggcaugaggagccgaucccaauggccacuuacggauggaaucuugucaaacugcacucuggcaaggacguguuuuucacaccucccgaaaaaugugauacccuacucugcgacauaggcgaguccucaccaaaccccacuaucgaggaagggagaacacugaggguuuugaagaugguagagccuuggcugcggggaaaucaauuuuguauuaagauccucaacccguacaugcccagcguggucgaaacccuugagcagaugcagcgcaaacaugguggcaugcuggugagaaauccauuaucgaggaacucuacgcacgagauguauuggguuaguugcgggaccggaaauauuguguccgcggucaacaugacaagccgaaugcuguugaaucgguucacuauggcucaccguaagccuaccuacgaaagagauguggaccucggcgcagguacacgccauguagccguggagcccgaaguugcuaaccuggauaucauugggcagaggaucgagaacauaaaacacgaacauaagucaacuuggcacuaugacgaggauaauccuuacaaaaccugggccuaucauggauccuacgaggucaagccaucuggcagcgcaaguuccauggugaacggcguggucaagcuacuuacaaaacccugggacguuauuccuauggugacccaaaucgccaugacugauacgacaccauuugggcagcagcggguauucaaggaaaaaguggacaccagaacucccaaggcuaaacgcggaaccgcgcaaaucauggaggucacagccagguggcugugggguuuucucagccgaaauaagaagccgcggauuuguacgagagaagaguucaccaggaaagugcgcucuaacgcagcuauaggcgccguuuuuguggacgaaaaucaguggaacucagcaaaggaggccgucgaggaugaacguuucugggaccuggugcagaaagagcgggaauugcacaagcaggggaaaugcgcuacuugcguauauaauaugaugggaaagagagagaagaaacugggcgaauuugguaaggccaaagggaguagggcgaucugguacauguggcucggagcacgcuuccuugaguuugaggcccugggcuucaugaacgaagaucacugguucucccgagagaauagcuuaucuggcguugaaggggagggacugcauaaguuggguuacauucuccgggacaucucgaaaauuccuggcgggaacauguaugcugaugacacagccggaugggauaccagaaucacugaggacgaucugcaaaaugaagcaaagauaacagacaucauggagccagaacacgcucuacuugccaccucaauuuuuaaacugacauaccagaacaagguggucagggugcagcgccccgcuaagaauggcacugugauggaugucaucagcagacgggaccagagggguuccgggcaaguuggaaccuauggccucaacacguucaccaauauggaggcccagcugauucgucagauggaaagugagggcaucuuuuugccuucugaguuagaaacaccaaaccuggcagagcgagugcucgauuggcuugaaaaauacgggguagagcgccugaagagaauggcgauaagcggagacgacuguguggucaaacccauugaugaccgguucgccacugcucuaaccgcccugaacgauauggguaaggugaggaaagacaucccgcagugggaaccuuccaagggcuggaaugauuggcaacagguucccuuuugcucacaucacuuccaccagcucaucaugaaggacgggcgcgagauuguggucccauguagaaaccaggaugaguuggugggacgggcaaggguaagucaaggcgcugguuggucucugcgagaaacagccugccuugggaaaagcuaugcacagauguggcagcugauguacuuucaucguagagaccuccgcuuagccgcgaaugcuauauguuccgccguuccuguggauuggguccccacuucacggaccacguggagcauccacgcacaucaccaauggaugacaaccgaggacaugcugucuguguggaacaggguuuggauugaagagaauccauggauggaagauaagacucauguguccaguuggggagacguccccuauuugggcaaaagagaggaccaguggugcggcagccugaucgggcucacagcccgcgcuaccugggccucgaacauucagguggcaaucaaucagguacggaggcuuauaggaaacgagaauuaccuggauuacaugacuuccaugaagcgauucaaaaacgaaggugacccugagggcgcucuaugguga

SEQ ID NO: 13839 - RNA, 9879 nt, Artificial Sequence
  derived and/or modified CDS sequence (opt3) from DENV-1__GQ199840__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuuacaguagucgugggcgauguugcugggauuuuagcccagggcaagaagaugauccgcccucaacccauggaguacaaauauagcuggaaguccuggggcaaggcgaaaauaaucggggccgacgugcagaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaagauucuaaggcuguucacgccgacaugggguacuggaucgaaagcgagaaaaaugaaacauggaagcucgcacgggcguccuucauugaggugaagacguguaucuggccaaaaucacauacccuguggagcaacggaguacuagaaucugagaugauaauccccaagauuuauggcgguccuaucucccaacacaauuaccgaccaggcuacuuuacucagacagccgggccguggcaucugggaaaacucgagcuggauuucgaccuuugcgaaggcaccacugucgugguggaugagcacugcgggaacagaggacccaguuugaggacaaccacggucacuggcaagauuauccacgaaugguguugccgcagcuguacccugccuccauuacgguuuaaaggugaggacgggugcugguauggaauggagauaagacccguuaaggaaaaggaggaaaaucucgugaaaucuaugguauccgcuggcucaggugagguggacaguuucagccugggccuucuguguauuucgaucaugaucgaagaggucaugaggucccgcuggucucgaaagauguugaugacagggacccucgccguguuuuuccugcuaauuacuggacagcugacauggaacgaucucauccggcugugcauuaugguuggcgcaaaugcuagcgaccguauggggaugggaaccacauaccuugccuugauggcaacuuuuaaaaugagaccuauguucgccgugggccuguuauuuaggcgccucaccucacgggagguccugcuucugacgauaggucuaagucucguggcuuccguugaacugccaaacucuuuggaggaacugggggauggauuagcgaugggcaucaugauucucaagcugcuuacagacuuccaaagccaucagcugugggccaccuugcucucccugacuuuuaucaaaaccacauucucacuacacuaugcauggaagacuauggcuauggugcugagcauugucagucuuuuuccccucugucugucuaccacgucccagaagacaaccugguugccgguacuguuaggcagccucgggugcaaaccucugacuauguuccuuaucgccgagaauaagauauggggaagaaaaucguggccacugaacgaagguaucauggccgugggcauuguuucaaucuugcucucuagucugcuaaagaacgaugugccccuggcugggccucuuauugcaggaggcaugcucaucgccuguuacgucauauccgguagcucugcggaccugagcuuggagaaagcugccgagguguccugggaagaggaagcagagcauucaggggccagucacaauauuuuaguagaagugcaggaugacggaacaaugaagaucaaagaugaggagagggacgauacccugacuauccuccugaaggcuacacuucuggcagucagcggcguuuaucccuugucuauuccagccacccuauucgugugguacuuuuggcaaaagaaaaagcagcgauccggcgugcugugggacauaccuucacccccagaagucgagcgcgcggugcucgaugacgggaucuaucggauuaugcagagaggacugcuugguaggagucagguuggcguagggguguuccaagaaaacgucuuucauacgauguggcacgugacucguggagcuguuuuaauguaccagggcaaacgccuggagccgagcugggccuccgugaagaaagaccucaucucuuacggugggggauggcgguugcagggcucguggaauaccggcgaggaaguccaggugauugcaguagagccugggaagaaccccaagaauguccaaacagccccaggaaccuucaaaacaagcgaaggugaggugggcgcuaucgcccuggauuuuaagcccgggacuucaggauccccuauaguuaacagagaaggcaaaaucgugggucucuaugggaauggagucgugaccacgaguggcacauacguuucugcaauugcucaggccaaggcgagccaggagggcccacugcccgagaucgaagacgagguguucaggaaacgaaaccuuacuauuauggaucugcacccuggguccggaaagacccggcgcuauuugccggccaucgucagagaagcaauaaagaggaaacuacggacacugauucucgcuccaacccgagugguagccucagagauggcugaagcauuaaaggguaugcccaucagauaccaaacuaccgccgugaaaucugagcauacaggcaaggagaucguugaccugaugugccacgccacguuuacuaugcgccuucugagcccugucagggugccaaauuauaacaugauuaucauggaugaagcucauuucaccgaccccaguuccauagcggcacguggguacauuagcacacgggugggaaugggcgaggccgcugccaucuuuaugaccgcaacuccuccggguucugucgaagccuucccccagucaaaugcuguaauucaggaugaggaaagagacaucccagagagguccuggaacaguggguaugaguggauaacagauuuuccuggaaaaaccgugugguucguucccagcauuaagucgggcaaugacaucgcgaacugucuccgcaagaauggcaaacgagugauccaguugucuagaaagacguucgauacugaauaccagaagacaaagaacaacgacugggacuacgucgugaccaccgauauuuccgagaugggggccaauuuucgggcagacaggguuaucgauccacgccguugccugaaaccugugauucucaaggacggacccgaaagagucauacuggcugguccaaugccggugacuguagccagcgcagcccagcggaggggccgcaucgggcgaaaccacaauaaggagggagaucaguauauuuacaugggccagccucuuaacaaugacgaggaucaugcucacuggacagaagccaaaaugcuacuggacaacaucaauacccccgaggguaucauuccagcguuguucgaacccgagagagaaaagucagcagccauagauggggaguaucgguuaaggggcgaggcucgcaaaacauuuguggaacugaugagaaggggagaccucccuguuuggcugaguuacaaggucgccucugagggcuuccaauauuccgaucggcguuggugcuuugacggggaacgcaacaaucaggugcuugaggaaaacauggauguggagaucuggacuaaagagggagaacgaaagaaacugagaccaagguggcucgacgcucggacguacagcgaccccuuggcacugcgcgaguucaaggaauuugccgcugguagaaggucagucaguggcgaucuaauucuggagaucgggaagcucccucagcaccuuacccagcgggcccaaaaugcacuggacaacuuaguuauguugcauaauagcgaacagggaggccgagcguauagacacgccauggaggagcugccggauacaauugaaacucucaugcugcuugcucugaucgccgugcucaccggugggguaacauuguucuuucuguccggccgcggauuaggcaaaaccucuauagggcuacugugugugauggcaagcuccguccuccuuuggauggcuucaguggagccacauuggaucgccgcaucuauuauccuggaguucuuuuugaugguucugcucauucccgagccugacaggcagcggacuccccaggauaaccaacuggccuacguggucaucggacuucucuucaugauacugacgguagcugcgaaugagauggguuugcuggaaaccacaaagaaagacuuaggcauugggcacguggccgcagagaaccaccaucacgcugccaugcuagauguugaccugcauccagccagugcauggacucucuacgcuguggccaccacaaucauuaccccuaugaugcgucacacuaucgaaaacacaacggcgaauauaucgcuuaccgcuaucgccaaccaggcagccauucugaugggauuggauaagggcuggcccaucagcaaaauggacauuggugucccacugcucgcucuggggugcuauucccaggugaauccucuuacuuuaacagcagccguccugaugcucguggcgcauuacgcuaucauaggcccgggauugcaagccaaggcaaccagagaggcccagaagaggaccgcugccggcauuaugaaaaaccccacaguugaugggaucguggcaaucgaccuggauccaguaguguaugacgcuaaguuugaaaaacagcuaggacagauuaugcugcucauccuuuguacuucucaaauacuguugaugcgcacgaccugggcccugugcgagucaauuacacucgcgacuggcccucugaccacauuaugggaggguagccccgggaaguucuggaauaccacuaucgccgucuccauggcaaacauuuuccggggaaguuaccuugcuggcgccggucuggcauuuucucucaugaaaagccuaggcgggggacgaagaggcacgggggcucagggagaaacacugggcgagaaguggaagaggcaguugaaucagcugucaaaauccgaguucaacaccuauaagcgcagugguaucauggagguugaccggagcgaagccaaagaggggcucaagagaggagagacuaccaaacacgccgugucucguggcacagcgaaacuuaggugguuugucgaacggaaucuggugaagccagaggguaaaguaauagauuugggcugugggcgcggaggcugguccuacuauugcgcugggcugaagaaagugacugaaguuaagggauacaccaaaggcgguccugggcacgaggaacccaucccgauggcaacauacggauggaaccucgugaaguuacauucaggcaaagacgucuucuuuauuccaccugagaagugugauacgcugcuuugcgacaucggcgagagcucgcccaauccaaccauugaagaggggcgaacucugagagugcuaaagauggucgaacccuggcucaggggaaaccaauucuguaucaaaauucugaauccuuauaugccgucugugguugagacauuggagcagaugcagcggaagcacgguggcaugcugguacgcaacccccucaguagaaauuccacccaugaaauguacugggugagcugcgggacuggaaacaucgucucagccgugaauaugacauccaggaugcuucugaaccgauuuaccauggcucaccggaaaccaacguaugagcgugauguugacuuaggcgccgguaccagacacguggcagucgaaccugagguggccaaccuggauauaauugggcagcgcaucgaaaauaucaagcaugagcacaaaucuacauggcauuacgacgaggauaaccccuauaagacuugggcuuaccacggaagcuaugaaguaaagccuaguggcuccgcgagcucuauggugaauggcguugucaaauugcucaccaagccaugggacgugauucccauggugacacaaauagccaugacugauaccacaccuuucgggcagcagagggucuuuaaagagaagguugacacccggacuccaaaagcaaagagaggaacggcucaaaucauggaagugacagccaaguggcugugggguuuccuaucacgcaacaaaaagcccaggauuuguacccgagaggaauuuacucggaaaguaagaaguaaugcagccaucggcgcuguguucgucgacgagaaccaguggaacuccgccaaggaggcgguggaagaugagagguuuugggaccuuguucaucgcgaacgugagcugcacaaacaggggaagugcgcaaccugcguguacaacaugaugggaaagcgggagaaaaagcucggcgaguucgguaaagccaaggggagcagagcuauuugguacauguggcugggagccagguucuuggaguuugaagcacugggcuucaugaaugaggaucacugguuuucucgcgaaaacucgcucucaggcgucgagggggagggacuucauaaacuggguuauaucuuacgagacauaagcaagaucccgggcgggaauauguacgcugaugacacagccggaugggauacgcggauuaccgaagacgaucugcagaacgaggcuaaaaucacugacauuauggaaccugagcacgccuugcucgcaaaguccaucuucaagcugacauaucaaaauaaagugguaagaguucagaggccagcgaagaacggcaccgugauggaugucauaagucgcagagaccagcgggguucuggacaggugggaacuuacggccuaaauacauuuaccaacauggaagcccaacuuauuaggcagauggagagcgagggcaucuucucccccucagaacuggagacaccuaaccucgcugggcgugugcuggauugguuggaaaaauauggagucgagcgauuaaagcgcauggccaucaguggugacgacuguguugugaaaccaauugaugacagauuugcaacugcucugaccgcccucaaugauaugggcaagguacggaaggacauaccccagugggaaccgucuaaaggguggaacgauuggcagcaagugccuuucugcagccaucacuuucaccagcuuaucaugaaggacggaagggagauugucgugcccugucgcaaucaggaugagcugguuggcagagcacgggugucccagggugccggguggucacuaagggaaacggcgugccugggaaaaagcuacgcucaaauguggcagcucauguauuuccaucgacgugacuugagacuggccgcaaacgccaucuguucugcugucccaguggauuggguaccuaccucccgcacaacuuggaguauucacgcccaucaccaguggaugaccacagaggacaugcuuagcguuuggaaucggguguggaucgaagagaaccccuggauggaagauaagacucauauaucguccuggggcgacgucccauaccugggcaaaagggaggaccaauggugcgggucucucaucggauuaaccgcaagagcuacgugggccacaaauauucagguggcgaucaaccagguucgccggcugauugguaaugagaacuacuuggauuauaugaccucaaugaagagguuuaagaaugaaagcgaccccgagggcgcucugugguga

SEQ ID NO: 13840 - RNA, 9879 nt, Artificial Sequence
  derived and/or modified CDS sequence (opt3) from DENV-1__FJ898405__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaauaucggaaagauguuugaggcaacugccagaggcgcuaggcggauggccauucugggggauaccgcaugggacuucggaaguaucgguggcguguuuacaagcguugggaaacuugugcaucagauuuucggaacggcguacggcguccuguuuuccggugugucuuggaccaugaagauagggaucggcguauugcucacuuggcugggauuaaacagccgaucaacaagucuguccaugaccuguauugcugugggccuaguuacacucuaccugggggucauggugcaggccgauagcggaugcgugaucaauuggaaaggccgcgaacuuaagugugguucugggaucuucgucacuaacgagguucacaccuggacggaacaauauaaguuucaggcagacucaccgaaaagauugagugccgcuauuggaaaggccugggaggagggcgugugcgguauaaggagcgcaacacggcuggaaaacaucauguggaaacagauuuccaaugagcucaaccauauccuguuagaaaaugacaugaaguucaccgugguagucggcgaugugguugggauucuggcucagggaaaaaagaugauccgcccucaacccauggagcacaaauacucuuggaagucguggggcaaggccaaaauaaucggggcggacgugcagaacacuaccuuuauuaucgauggaccaaauacaccugaaugucccgacgaucagagagccuggaacauuugggaggucgaggacuauggcuucgguaucuuuacuaccaauauauggcuuaaguugagggauagcuacacacaggugugcgaccaccgucucauguccgcugcaauuaaagauucaaaggccguucaugcugacaugggguauuggaucgaaagugagaaaaacgaaacguggaagcuggcccgggcaucuuucauugaggugaagaccuguaucuggccaaaaagccacacucuaugguccaauggaguacuggaaucagagaugauaauccccaagauuuacggcgguccuaucagccaacauaacuaucgaccaggcuacuucacacagaccgcggggccguggcaccucggaaaacuggagcuugauuuugacuugugcgaaggcacuacagucgugguggaugagcacugcgggaauagaggacccucucugaggaccacgacugucaccggcaagauuauccaugaaugguguugccgcuccuguacauuaccuccacuccgguucaaaggugaggacgggugcugguacggaauggagauaagacccguuaaggaaaaggaggaaaaccuggugaaaaguaugguaagcgccggcucuggugagguggacuccuuuucacuuggccuguuguguauuaguaucaugaucgaagaggucaugaggagccgcuggucgcgaaagaugcucaugaccgggacucuggcuguguuccuacugcucauuaugggacagcugacauggaaugaucuuauccgguugugcauuaugguuggcgccaacgcauccgaccguauggggaugggaaccacauaucuggcuuuaauggccacuuuuaaaaugagaccuauguucgcagugggccuccuguuuaggcgccuuaccucucgggagguccugcuacucacgauaggucugagcuugguggccucaguugaacugccaaauaguuuagaggaacucggggauggacuggcuaugggcaucaugauucuuaagcuguugacagacuuccaaucccaccagcucugggcgacccugcuaucucugacuuuuaucaaaaccacacuuagccuccauuacgccuggaagacuauggcaauggugcuguccauugucucauuguucccccuguguuuaagcaccacgagucagaagacaaccuggcucccgguacugcuuggcucucuggggugcaaaccuuugacuauguuucucaucgcugagaacaagauauggggaagaaaauccuggccacugaacgaagguaucauggccgugggcguugugagcauucuacugucgucacuucucaagaaugaugucccccuggccgggccuuugaucgcuggaggcauguuaauugcauguuaugugaucucugguaguuccgccgaccugagccucgagaaagcggcugagguaucuugggaagaggaagccgagcacagcggggcaucccauaacauacugguggaaguccaggaugacggaacaaugaagauuaaagaugaggagagggacgauacccuuacuauccuguugaaggccacacuacuggcuguuucaggcguguacccccucaguaucccagcaacccuguucgugugguauuuuuggcaaaagaaaaagcagcgaagcggcguccuuugggacacgccuucucccccagaaguggagcgcgccguuuuagaugacgggauuuaccggauaaugcagagaggacugcucgguaggucccagguaggcgugggggucuuccaagaaaauguguuccacacuauguggcacguuacccguggagcgguguugauguaucagggcaaacgccuggagccgucaugggcuagugucaagaaagaccucaucagcuacggugggggauggcggcugcagggcuccuggaacacaggcgaggaagugcagguaauugccgucgagccugggaagaaucccaagaacgugcaaaccgcaccaggaacauuuaaaacucccgaaggugagguuggcgccaucgcucuugauuucaagccugggaccucuggaucgccaauugugaauagagaaggcaaaaucgucggucuguacgggaacggagugguuacgacaagcggcacuuaugugucagccauagcacaggcuaaggccucccaggagggccccuugccugagaucgaagacgaggucuuuaggaaacgaaaucuaaccauuauggaucugcauccggggaguggaaagacacggcgcuaccucccagcgaucgugagagaagccauuaagaggaaauuacggacccugauccuugcacccacucgaguaguggcuucugagauggccgaagcucugaaggguaugccuauaagauaucaaaccacagcaguuaaaagcgagcacacgggcaaggagauugucgaccucaugugccaugccacuuucaccaugcgcuugcuguccccagugagggugcccaacuacaauaugaucaucauggaugaagcccacuuuacagacccuucaucuauugcugcgcguggguauaucagcacccgggucggaaugggcgaggcagccgcuauauucaugacugccacaccgcccgguaguguagaagcauuuccacaguccaacgccgugauucaggaugaggaaagagacaucccugagaggagcuggaauucuggguacgaguggauuaccgauuuccccggaaaaacgguuugguuugugccaucaaucaaguccggcaacgacauagcuaauugucuccgcaagaacggcaaacgagucauucagcugaguagaaagacuuucgauacagaauaucaaaaaaccaagaacaaugacugggacuacgugguuaccacugauaucagcgagaugggggcgaacuuucgggccgacagggugaucgauccucgccguugccuuaaacccgucauucuaaaggacggaccagaaagagugauccuggcagguccgaugccuguaacaguggcuucggccgcacagcggaggggccgcauugggcgaaaucauaacaaggagggagaucaguacauauauaugggccagcccuugaauaacgacgaggaucacgcccacuggaccgaagcuaaaauguuacuggacaauaucaacacaccagaggguauuauccccgcccucuucgaaccugagagagaaaagucugcggcaaucgauggggaguaccggcugaggggcgaggcccgcaaaacuuucguugaacuuaugagaaggggagaccugccagucuggcucuccuauaagguggcuagcgagggcuuucaauacucagaucggcguuggugcuucgacggggaacgcaauaaccagguguuggaggaaaauauggaugucgagauuuggacgaaagagggagaacgaaagaaacugagacccagguggcuagacgcccggaccuauagugacccucuggcucuccgcgaguuuaaggaauucgcagccgguagaaggucuguuuccggcgaucuuauacuggagaucgggaaguuaccgcagcauuugacacagcgggcucaaaacgcccuggacaaucucgugaugcugcacaacagcgaacagggaggccgagcauacagacaugcgauggaggagcuuccagauacuauugaaacccugaugcucuuggcccugaucgcuguauuaacagguggggugacccuauuuuuccugucaggccgcggacucggcaaaacuaguauugggcuucugugugucauggccagcuccguguugcuguggauggcaucuguugagccccacuggaucgcugccagcauaauccucgaauuuuuccugauggugcuucucauuccugagcccgacaggcagcggacgccacaggauaaucaacuggcauaugucguaaucggauugcuguuuaugauuuuaaccguggccgcuaacgagaugggucuacuggaaacaacuaagaaagaccucggcaucgggcacguugcgguggagaaccaucaccaugccaccaugcuugaugucgaccugcacccugcauccgcuuggacauuguacgccguggccaccacuauaauuacacccaugaugcgucauacgaucgaaaauaccacugcaaacauuucacugacagcuaucgccaaucaggcggcuauacucaugggacuggauaagggcuggccaaucucuaaaauggacauuggugucccucuuuuagcccuggggugcuacagucaggugaacccgcucaccuugaccgcagccguucugaugcuaguggcucacuaugcaaucauuggccccggacugcaagccaaggcgacaagagaggcucagaagaggacugccgcaggcaucaugaaaaauccaacgguagaugggauaguggccauugaccucgauccugucguuuacgacgcuaaguucgaaaaacagcuuggacagaucaugcuguugauccuguguaccucgcaaauucuccugaugcgcacaacuugggccuuaugcgagagcaucacccuugcaacaggcccccugaccacucucugggaggguuccccagggaaguuuuggaacacgacaauagcugugucuauggccaauauuuuccggggaucauaucuagcgggcgccggucuggcauuuagcuugaugaaaucccugggcgggggacgaagaggcaccggggcucagggagaaacucucggcgagaaguggaagaggcagcuuaaccagcugaguaaaucugaauucaauaucuacaagcgcagcgguauuauggaggucgaccggucagaagccaaagagggguugaagagaggagagaccacacgucacgcaguguccaggggcacugcuaaacugcggugguucguagaacgcaaccucgugaagccugaggguaagguuaucgauuuaggcugugggcgaggaggcuggaguuauuacugcgccgggcugaaaaaggugaccgaagucaaaggauauacaaagggcggucccgggcaugaggaaccgauaccaauggccacguacggauggaaucuugugaaacugcacagcggcaaggacgucuuuuucaccccucccgagaaaugugauacucuacucugcgacaucggcgagucuuccccaaaccccacaauugaagaggggagaacccugaggguguugaagaugguugaaccuuggcugcggggaaaucaauuuuguaucaagauucucaacccguacaugcccucaguaguggagacucuugagcagaugcagcgcaaacaugguggcaugcuggucagaaauccauuaagcaggaacucgacacacgaaauguauugggugucuugcgggaccggaaauaucguuagugcggugaacaugacgucccgaaugcuguugaaccgguucaccauggcucaccguaagccuacauacgagagagaugucgaccucggcgcagguacucgccauguggccguagaacccgagguggcuaaucuggauauuaucgggcagaggauagaaaacauuaaacacgagcauaagagcaccuggcacuaugacgaggauaauccuuacaaaacaugggccuaucauggaucauacgaaguuaagccauccggcucugcaagcaguauggucaacggcguggugaagcuacuuacuaaacccugggacgucaucccuaugguuacccaaaucgccaugacagauaccacuccauuugggcagcagcggguguucaaggagaaaguagacacgagaacacccaaggcuaaacgcggaaccgcgcaaauuauggaagugacugccagguggcugugggguuuucucucccgaaauaagaagccgcggauauguaccagagaggaauucacaaggaaaguccgcagcaacgcagcuaucggcgccguguuuguugacgagaaucaguggaacucugcaaaggaggccguggaagaugagcguuucugggaccugguccagaaagaacgggaguugcacaagcaggggaaaugcgcuacgugcguguauaauaugaugggaaagagagaaaagaaacugggcgaguuugguaaggccaaagggucaagggcgauuugguacauguggcucggagcacgcuuccuugaguuugaagcccugggcuucaugaacgaggaucacugguucagucgagaaaauuccuuaagcggcguagagggggagggacugcauaaguuggguuacauccuccgggacauuucuaaaaucccuggcgggaacauguaugcugaugacaccgccggaugggauacuagaauaacagaagacgaucugcaaaaugaggcaaagaucaccgacauuauggaaccagagcacgcucuacuugccacuucgaucuuuaaacugacauaccagaacaagguugugaggguccagcgccccgcuaagaauggcaccgugauggaugugauuucaagacgggaccagagggguagcgggcaagucggaacauauggccucaacacuuucaccaacauggaagcccagcugauccgucagauggaguccgagggcauauuuaguccuucugaauuggagauuccaaauuuagcagaacgaguucuggauuggcucgagaaauacgggguggaacgccuuaagagaauggcgaucagcggagacgacuguguagugaaacccaucgaugaccgguucgccacggcucugaccgcccuaaacgauauggguaaggucaggaaagacgugccgcagugggagccuuccaagggcuggaaugauuggcaacagguucccuuuugcucacaucacuuccaccagcugauuaugaaggacgggcgcgagauaguggucccauguagaaaccaggaugaacucgugggacgggcaaggguaagucaaggcgcugguuggucuuugcgagagacagccugccuggggaaaagcuaugcacagauguggcagcuuauguacuuucaucguagagaccugcgccucgccgcgaaugcuaucuguuccgccguuccuguggauuggguccccacuucacggaccacauggagcauucacgcacaucaccaauggaugacuaccgaagacauguuaucuguguggaacaggguuuggaucgaggaaaauccauggauggaggauaagacgcauguguccaguuggggagacguccccuaucugggcaaaagagaggaccaguggugcggcagcuugauugggcugacagcccgcgcuaccugggccucgaacauccagguggcaauaaaucagguacggaggcucaucggaaacgaaaauuaccuugauuacaugacuuccaugaagcgauucaaaaacgagggugacccugaaggcgcucugugguga

SEQ ID NO: 13841 - RNA, 9879 nt, Artificial Sequence
  derived and/or modified CDS sequence (opt3) from DENV-1__FJ898406__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaauaucggaaagauguuugaggcaacugccagaggcgcuaggcggauggccauucugggggauaccgcaugggacuucggaaguaucgguggcguguuuacaagcguugggaaacuugugcaucagauuuucggaacggcguacggcguccuguuuuccggugugucuuggaccaugaagauagggaucggcguauugcucacuuggcugggauuaaacagccgaucaacaagucuguccaugaccuguauugcugugggccuaguuacacucuaccugggggucauggugcaggccgauagcggaugcgugaucaauuggaaaggccgcgaacuuaagugugguucugggaucuucgucacuaacgagguucacaccuggacggaacaauauaaguuucaggcagacucaccgaaaagauugagugccgcuauuggaaaggccugggaggagggcgugugcgguauaaggagcgcaacacggcuggaaaacaucauguggaaacagauuuccaaugagcucaaccauauccuguuagaaaaugacaugaaguucaccgugguagucggcgaugugguugggauucuggcucagggaaaaaagaugauccgcccucaacccauggagcacaaauacucuuggaagucguggggcaaggccaaaauaaucggggcggacgugcagaacacuaccuuuauuaucgauggaccaaauacaccugaaugucccgacgaucagagagccuggaacauuugggaggucgaggacuauggcuucgguaucuuuacuaccaauauauggcuuaaguugagggauagcuacacacaggugugcgaccaccgucucauguccgcugcaauuaaagauucaaaggccguucaugcugacaugggguauuggaucgaaagugagaaaaacgaaacguggaagcuggcccgggcaucuuucauugaggugaagaccuguaucuggccaaaaagccacacucuaugguccaauggaguacuggaaucagagaugauaauccccaagauuuacggcgguccuaucagccaacauaacuaucgaccaggcuacuucacacagaccgcggggccguggcaccucggaaaacuggagcuugauuuugacuugugcgaaggcacuacagucgugguggaugagcacugcgggaauagaggacccucucugaggaccacgacugucaccggcaagauuauccaugaaugguguugccgcuccuguacauuaccuccacuccgguucaaaggugaggacgggugcugguacggaauggagauaagacccguuaaggaaaaggaggaaaaccuggugaaaaguaugguaagcgccggcucuggugagguggacuccuuuucacuuggccuguuguguauuaguaucaugaucgaagaggucaugaggagccgcuggucgcgaaagaugcucaugaccgggacucuggcuguguuccuacugcucauuaugggacagcugacauggaaugaucuuauccgguugugcauuaugguuggcgccaacgcauccgaccguauggggaugggaaccacauaucuggcuuuaauggccacuuuuaaaaugagaccuauguucgcagugggccuccuguuuaggcgccuuaccucucgggagguccugcuacucacgauaggucugagcuugguggccucaguugaacugccaaauaguuuagaggaacucggggauggacuggcuaugggcaucaugauucuuaagcuguugacagacuuccaaucccaccagcucugggcgacccugcuaucucugacuuuuaucaaaaccacacuuagccuccauuacgccuggaagacuauggcaauggugcuguccauugucucauuguucccccuguguuuaagcaccacgagucagaagacaaccuggcucccgguacugcuuggcucucuggggugcaaaccuuugacuauguuucucaucgcugagaacaagauauggggaagaaaauccuggccacugaacgaagguaucauggccgugggcguugugagcauucuacugucgucacuucucaagaaugaugucccccuggccgggccuuugaucgcuggaggcauguuaauugcauguuaugugaucucugguaguuccgccgaccugagccucgagaaagcggcugagguaucuugggaagaggaagccgagcacagcggggcaucccauaacauacugguggaaguccaggaugacggaacaaugaagauuaaagaugaggagagggacgauacccuuacuauccuguugaaggccacacuacuggcuguuucaggcguguacccccucaguaucccagcaacccuguucgugugguauuuuuggcaaaagaaaaagcagcgaagcggcguccuuugggacacgccuucucccccagaaguggagcgcgccguuuuagaugacgggauuuaccggauaaugcagagaggacugcucgguaggucccagguaggcgugggggucuuccaagaaaauguguuccacacuauguggcacguuacccguggagcgguguugauguaucagggcaaacgccuggagccgucaugggcuagugucaagaaagaccucaucagcuacggugggggauggcggcugcagggcuccuggaacacaggcgaggaagugcagguaauugccgucgagccugggaagaaucccaagaacgugcaaaccgcaccaggaacauuuaaaacucccgaaggugagguuggcgccaucgcucuugauuucaagccugggaccucuggaucgccaauugugaauagagaaggcaaaaucgucggucuguacgggaacggagugguuacgacaagcggcacuuaugugucagccauagcacaggcuaaggccucccaggagggccccuugccugagaucgaagacgaggucuuuaggaaacgaaaucuaaccauuauggaucugcauccggggaguggaaagacacggcgcuaccucccagcgaucgugagagaagccauuaagaggaaauuacggacccugauccuugcacccacucgaguaguggcuucugagauggccgaagcucugaaggguaugccuauaagauaucaaaccacagcaguuaaaagcgagcacacgggcaaggagauugucgaccucaugugccaugccacuuucaccaugcgcuugcuguccccagugagggugcccaacuacaauaugaucaucauggaugaagcccacuuuacagacccuucaucuauugcugcgcguggguauaucagcacccgggucggaaugggcgaggcagccgcuauauucaugacugccacaccgcccgguaguguagaagcauuuccacaguccaacgccgugauucaggaugaggaaagagacaucccugagaggagcuggaauucuggguacgaguggauuaccgauuuccccggaaaaacgguuugguuugugccaucaaucaaguccggcaacgacauagcuaauugucuccgcaagaacggcaaacgagucauucagcugaguagaaagacuuucgauacagaauaucaaaaaaccaagaacaaugacugggacuacgugguuaccacugauaucagcgagaugggggcgaacuuucgggccgacagggugaucgauccucgccguugccuuaaacccgucauucuaaaggacggaccagaaagagugauccuggcagguccgaugccuguaacaguggcuucggccgcacagcggaggggccgcauugggcgaaaucauaacaaggagggagaucaguacauauauaugggccagcccuugaauaacgacgaggaucacgcccacuggaccgaagcuaaaauguuacuggacaauaucaacacaccagaggguauuauccccgcccucuucgaaccugagagagaaaagucugcggcaaucgauggggaguaccggcugaggggcgaggcccgcaaaacuuucguugaacuuaugagaaggggagaccugccagucuggcucuccuauaagguggcuagcgagggcuuucaauacucagaucggcguuggugcuucgacggggaacgcaauaaccagguguuggaggaaaauauggaugucgagauuuggacgaaagagggagaacgaaagaaacugagacccagguggcuagacgcccggaccuauagugacccucuggcucuccgcgaguuuaaggaauucgcagccgguagaaggucuguuuccggcgaucuuauacuggagaucgggaaguuaccgcagcauuugacacagcgggcucaaaacgcccuggacaaucucgugaugcugcacaacagcgaacagggaggccgagcauacagacaugcgauggaggagcuuccagauacuauugaaacccugaugcucuuggcccugaucgcuguauuaacagguggggugacccuauuuuuccugucaggccgcggacucggcaaaacuaguauugggcuucugugugucauggccagcuccguguugcuguggauggcaucuguugagccccacuggaucgcugccagcauaauccucgaauuuuuccugauggugcuucucauuccugagcccgacaggcagcggacgccacaggauaaucaacuggcauaugucguaaucggauugcuguuuaugauuuuaaccguggccgcuaacgagaugggucuacuggaaacaacuaagaaagaccucggcaucgggcacguugcgguggagaaccaucaccaugccaccaugcuugaugucgaccugcacccugcauccgcuuggacauuguacgccguggccaccacuauaauuacacccaugaugcgucauacgaucgaaaauaccacugcaaacauuucacugacagcuaucgccaaucaggcggcuauacucaugggacuggauaagggcuggccaaucucuaaaauggacauuggugucccucuuuuagcccuggggugcuacagucaggugaacccgcucaccuugaccgcagccguucugaugcuaguggcucacuaugcaaucauuggccccggacugcaagccaaggcgacaagagaggcucagaagaggacugccgcaggcaucaugaaaaauccaacgguagaugggauaguggccauugaccucgauccugucguuuacgacgcuaaguucgaaaaacagcuuggacagaucaugcuguugauccuguguaccucgcaaauucuccugaugcgcacaacuugggccuuaugcgagagcaucacccuugcaacaggcccccugaccacucucugggaggguuccccagggaaguuuuggaacacgacaauagcugugucuauggccaauauuuuccggggaucauaucuagcgggcgccggucuggcauuuagcuugaugaaaucccugggcgggggacgaagaggcaccggggcucagggagaaacucucggcgagaaguggaagaggcagcuuaaccagcugaguaaaucugaauucaauaucuacaagcgcagcgguauuauggaggucgaccggucagaagccaaagagggguugaagagaggagagaccacacgucacgcaguguccaggggcacugcuaaacugcggugguucguagaacgcaaccucgugaagccugaggguaagguuaucgauuuaggcugugggcgaggaggcuggaguuauuacugcgccgggcugaaaaaggugaccgaagucaaaggauauacaaagggcggucccgggcaugaggaaccgauaccaauggccacguacggauggaaucuugugaaacugcacagcggcaaggacgucuuuuucaccccucccgagaaaugugauacucuacucugcgacaucggcgagucuuccccaaaccccacaauugaagaggggagaacccugaggguguugaagaugguugaaccuuggcugcggggaaaucaauuuuguaucaagauucucaacccguacaugcccucaguaguggagacucuugagcagaugcagcgcaaacaugguggcaugcuggucagaaauccauuaagcaggaacucgacacacgaaauguauugggugucuugcgggaccggaaauaucguuagugcggugaacaugacgucccgaaugcuguugaaccgguucaccauggcucaccguaagccuacauacgagagagaugucgaccucggcgcagguacucgccauguggccguagaacccgagguggcuaaucuggauauuaucgggcagaggauagaaaacauuaaacacgagcauaagagcaccuggcacuaugacgaggauaauccuuacaaaacaugggccuaucauggaucauacgaaguuaagccauccggcucugcaagcaguauggucaacggcguggugaagcuacuuacuaaacccugggacgucaucccuaugguuacccaaaucgccaugacagauaccacuccauuugggcagcagcggguguucaaggagaaaguagacacgagaacacccaaggcuaaacgcggaaccgcgcaaauuauggaagugacugccagguggcugugggguuuucucucccgaaauaagaagccgcggauauguaccagagaggaauucacaaggaaaguccgcagcaacgcagcuaucggcgccguguuuguugacgagaaucaguggaacucugcaaaggaggccguggaagaugagcguuucugggaccugguccagaaagaacgggaguugcacaagcaggggaaaugcgcuacgugcguguauaauaugaugggaaagagagaaaagaaacugggcgaguuugguaaggccaaagggucaagggcgauuugguacauguggcucggagcacgcuuccuugaguuugaagcccugggcuucaugaacgaggaucacugguucagucgagaaaauuccuuaagcggcguagagggggagggacugcauaaguuggguuacauccuccgggacauuucuaaaaucccuggcgggaacauguaugcugaugacaccgccggaugggauacuagaauaacagaagacgaucugcaaaaugaggcaaagaucaccgacauuauggaaccagagcacgcucuacuugccacuucgaucuuuaaacugacauaccagaacaagguugugaggguccagcgccccgcuaagaauggcaccgugauggaugugauuucaagacgggaccagagggguagcgggcaagucggaacauauggccucaacacuuucaccaacauggaagcccagcugauccgucagauggaguccgagggcauauuuaguccuucugaauuggagauuccaaauuuagcagaacgaguucuggauuggcucgagaaauacgggguggaacgccuuaagagaauggcgaucagcggagacgacuguguagugaaacccaucgaugaccgguucgccacggcucugaccgcccuaaacgauauggguaaggucaggaaagacgugccgcagugggagccuuccaagggcuggaaugauuggcaacagguucccuuuugcucacaucacuuccaccagcugauuaugaaggacgggcgcgagauaguggucccauguagaaaccaggaugaacucgugggacgggcaaggguaagucaaggcgcugguuggucuuugcgagagacagccugccuggggaaaagcuaugcacagauguggcagcuuauguacuuucaucguagagaccugcgccucgccgcgaaugcuaucuguuccgccguuccuguggauuggguccccacuucacggaccacauggagcauucacgcacaucaccaauggaugacuaccgaagacauguuaucuguguggaacaggguuuggaucgaggaaaauccauggauggaggauaagacgcauguguccaguuggggagacguccccuaucugggcaaaagagaggaccaguggugcggcagcuugauugggcugacagcccgcgcuaccugggccucgaacauccagguggcaauaaaucagguacggaggcucaucggaaacgaaaauuaccuugauuacauggcuuccaugaagcgauucaaaaacgagggugacccugaaggcgcccugugguga

SEQ ID NO: 13842 - RNA, 9879 nt, Artificial Sequence
  derived and/or modified CDS sequence (opt3) from DENV-1__GQ199841__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccgcucuccuuuggauggccucagucgagccacauuggaucgcagccucuauaauccuggaguucuuuuugauggugcugcucauucccgagccugacaggcagcggacgccccaggauaaccagcuggcuuacguugugaucggacuucucuucaugauucugaccgucgcggccaaugagauggguuugcuggaaacaacuaaaaaggacuuaggcaucgggcacguagcaguggagaaccaccaucacgcugccaugcuagauguugaccugcauccagccagugcauggacccucuacgcuguggccacaaccauaauuacuccuaugaugcgucacacaaucgaaaacacgaccgcgaauauuucgcuuacugcuaucgccaaccaagcagccauacugaugggauuggauaaaggcuggcccaucagcaagauggacauuggugucccacugcucgcucuggggugcuauucccaggugaauccucuuacauuaaccgcagccguccugaugcucguggcgcauuacgcuaucauuggcccgggauugcaggccaaggcaaccagagaggcccagaagaggacagcugccggcaucaugaagaaccccacuguugaugggauaguggcaauugaccuggauccaguaguguaugacgcuaaauuugaaaagcagcuaggacagaucaugcugcucauccuuuguacgucucagauucuguugaugcgcaccacaugggcccugugcgagucaaucacucucgcgaccggcccucugacaaccuuaugggaggguagccccgggaaauucuggaauacuacgauagccgucuccauggcaaacauuuuccggggaaguuaccuugcuggcgccggucuggcauuuucucucaugaaaagccuaggcgggggacgaagaggcacaggggcucaaggagaaacccugggcgagaaguggaaaaggcaguugaaucagcugucaaaguccgaguucaacacuuauaaacgcagugguaucauggagguugaccggagcgaagccaaggaggggcucaaaagaggagagaccacaaagcacgccgugucucguggcacugcgaaacuuaggugguuugucgaacggaaucuggugaaaccagaggguaagguaauugauuugggcugugggcgcggaggcugguccuacuauugcgcugggcugaaaaaggugaccgaaguuaaaggauacacaaagggcgguccugggcacgaggaacccaucccgauggcaacguacggauggaaccucgugaaauuacauucaggcaaggacgucuucuuuauaccaccugagaagugugauacccugcuuugcgacaucggcgagagcucgcccaauccaacuauugaagaggggcgaacacugagagugcuaaaaauggucgaacccuggcucaggggaaaccaguucuguaucaagauucugaauccuuauaugccgucugugguugagaccuuggagcaaaugcagcggaaacacgguggcaugcugguacgcaacccccucaguagaaauuccacucaugaaauguacugggugagcugcgggacaggaaacaucgucucagccgugaauaugaccuccaggaugcuucugaaccgauuuacgauggcucaccggaagccaaccuaugagcgugauguugacuuaggcgccgguacaagacacguggcagucgaaccugagguggccaaccuggauauuaucgggcagcgcauagaaaauauuaaacaugagcacaagucuacuuggcauuacgacgaggauaaccccuauaagaccugggcuuaccacggaagcuaugaaguaaaaccuaguggcuccgcgagcucuauggugaauggcguugucaaguugcucacaaaaccaugggacgugauccccauggugacucagaucgccaugaccgauacaaccccuuucgggcaacagagggucuuuaaggagaaaguugacacucggacgccaaaggcaaagagaggaacagcucagauuauggaagugaccgccaaauggcugugggguuuccuaucacgcaacaagaaacccaggauauguacucgagaggaauuuacccggaagguaagaaguaaugcagccaucggcgcuguguucgucgacgagaaccaauggaacuccgccaaagaggcgguggaagaugagagguuuugggaccuuguucaucgcgaacgugagcugcacaagcaggggaagugcgcaacaugcguguacaacaugaugggaaaacgggaaaagaaacucggcgaguucgguaaggccaaagggagcagagcuauuugguacauguggcugggagccagguucuuggaguuugaagcacugggcuucaugaaugaggaucacugguuuucucgcgaaaacucgcucucaggcgucgagggggagggacuucauaagcuggguuauaucuuacgagacauuagcaaaaucccgggcgggaauauguacgcugaugacacggccggaugggauacccggauaacugaagacgaucugcagaacgaggcuaagaucacagacauuauggaaccugagcacgccuugcucgcaaaguccaucuucaaacugaccuaucagaauaaggugguaagaguucaaaggccagcgaaaaacggcacugugauggaugucauuagucgcagagaccagcgggguucuggacaggugggaacauacggccuaaauaccuuuacaaacauggaagcccagcuuaucaggcaaauggagagcgagggcauauucucccccucagaacuggagacuccuaaccucgcugggcgugugcuggauugguuggaaaagcauggagucgagcgauuaaaacgcauggccauuaguggugacgacuguguugugaagccaaucgaugacagauuugcaaccgcucugacggcccucaaugauaugggcaagguacggaaagacaucccccagugggaaccgucuaagggguggaacgauuggcaacaggugccuuucugcagccaccacuuucaucaacuuauuaugaaagacggaagggagauagucgugcccugucgcaaucaggaugagcugguuggcagagcacgggugucccagggugccggguggucacuaagggaaaccgcgugccugggaaagagcuaugcucagauguggcaacucauguacuuccaccgacgugacuugagacuggccgcaaacgccaucuguucugcugucccaguggauuggguaccuacaucccgcacuaccuggaguauucaugcccaccaucaguggaugacaacugaggacaugcuuagcguuuggaaucggguguggaucgaagagaaccccuggauggaagauaaaacccacauuucguccuggggcgacgucccauaucugggcaagagggaggaccaguggugcgggucucucaucggauuaacggcaagagcuacaugggccaccaauauacaaguggcgaucaaccagguucgccggcugauugguaaugagaacuacuuggauuacaugacuucaaugaagagguuuaaaaaugaaagcgaccccgagggcgcucugugguga

SEQ ID NO: 13843 - RNA, 9879 nt, Artificial Sequence
  derived and/or modified CDS sequence (opt3) from DENV-1__FJ898407__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccagacuaaggcaagccaggagggcccccuuccugagauugaagacgagguguucaggaaacgaaaccugaccaucauggauuugcacccgggguccggaaagacacggcgcuaucuaccagcuauuguaagagaagccaucaagaggaaacugcggacccucauauuagcgcccacucgagugguugccucagagauggcagaagcucugaaggguaugccuauuagauaccaaaccacagccgucaaaucugagcauacgggccgcgagaucguggaccuuaugugccacgcuacuuuuaccaugaggcugcucagcccagugcguguccccaauuauaacaugaucauuauggaugaagcacauuucacagacccuaguuccaucgccgcccggggguacauaagcaccagaguaggaaugggcgaggcugcggcaauuuuuaugacugccacaccgcccgguucuguggaagcuuucccacagucaaaugccguuauccaggaugaggaaagggacauuccugagcgcuccuggaacaguggguaugaguggaucaccgauuuucccggaaagacggugugguucgucccaagcauaaaaucgggcaaugacauugcaaacuguuugcgaaagaauggcaagagagugauccagcugucucggaaaacuuuugauacagaauaccaaaagaccaaaaacaacgacugggacuacguugugaccacugauaucuccgagaugggggccaauuucagggcugaccgcgucauugauccucguagaugccucaagcccgugauccugaaagacggaccagaacggguaauucuugcggguccgaugccugugacaguugccagcgcagcucagaggcgcggccgaauagggagaaaccacaauaaggagggagaucaguauaucuacaugggccagccccuaaacaaugacgaggaucaugcccacuggaccgaagcaaagaugcuguuggacaacauuaauacaccagaggguaucauccccgccuuauucgaaccugagcgggaaaaaucagcugccauugauggggaguauaggcugcgcggcgaggcgagaaagacuuuugucgaacucaugaggcggggagaccugccaguguggcuuaguuacaaaguggcaucugagggcuuccaauauuccgaucgucgcuggugcuuugacggggaacgaaacaaucagguccuggaggaaaacauggauguugagauauggacgaaggagggagaaagaaaaaagcucaggccccggugguuggacgcccgcaccuacagcgacccucuggcucuaagagaguucaaagaauuugccgcugguaggcggucagugaguggcgaucugauccucgagauugggaagcuuccgcagcaccugacacagcgagcacaaaaugccuuagacaacuugguaaugcugcauaauagcgaacagggaggcagagcuuaucgccacgccauggaggagcucccagauacuaucgaaacccugaugcuucuggcacucauugcgguguugacagguggggucacccuguucuuuuuauccggcaggggacuaggcaagacuucuaucgggcugcucugugugauggccagcuccgcucuucuguggauggccucaguugagccccauuggauagcagcuucuaucauuuuggaauucuuucugauggugcuccugaucccugagcccgaccggcagcguacgccacaggauaaccaacuugccuacgucguaauuggacuccuguucaugaucuugaccguggcagccaaugagaugggucuguuagaaacaacuaaaaaggaccuaggcauagggcacguugcuguggagaaccaccaucacgcgaccaugcuggaugucgaccuccauccugccagugcauggacacuuuacgcuguggccaccacuauuaucacacccaugaugagacacacgauugaaaacaccacugccaauaucucgcugacagcaauagcuaaccaggccgcgaucuugaugggacuggauaaaggcuggccaauuagcaagauggacaucggugucccucuccuggcucuugggugcuauucccaggugaauccguuaacccugaccgccgcaguucucauguugguggcccauuacgcuauuaucggccccggacugcaagcaaaagccacaagggaggcgcagaagcgcacugcugccggcauaaugaagaacccaacgguagaugggauuguggcaaucgaccuagauccugucguuuaugacgccaaauuugaaaagcagcugggacagaucaugcuccuuauucuguguaccucucaaaucuugcugaugcggacaacuugggcucucugcgagucaauaacccuggccacaggccccuuaaccacucuuugggaggguagcccagggaaauucuggaauacgacaauugcaguguccauggcuaacaucuuucgaggaaguuaccuggccggcgcgggucucgccuucucucuaaugaagagccugggcgggggaagaaggggcaccggggcacagggagaaacuuugggcgagaaauggaagcgccagcugaaucagcucucaaaguccgaauucaacaccuauaaacggagugguauuauggaggucgacagaagcgaagcuaaggaggggcuucguaggggagagacaacuaaacacgccgugucucggggcaccgcaaagcugcgcugguuuguagaacgaaauuuggugaaaccugaggguaagguuaucgaucugggcugugggagaggaggcugguccuacuauugcgcugggcucaagaaagugacagaagucaagggauacacgaaaggcggucccgggcacgaggaaccgauaccaauggccaccuacggauggaacuuagugaagcugcauucaggcaaagacgucuucuuuaucccucccgagaagugugauacucuucugugcgacauuggcgagagcucgccaaaucccacaaucgaagaggggaggacccuacgggugcucaaaaugguugaaccuuggcugcgcggaaaccaauucuguauuaagaucuugaauccguauaugcccucuguaguggagacucuggagcagaugcagagaaagcacgguggcaugcucgucaggaacccacuuagucgaaauuccacacaugaaauguacugggugagcugcgggaccggaaacauuguuucagccgugaauaugacgucccggaugcuguuaaaccguuuuaccauggcgcacagaaaaccuacauaugagcgcgaugucgaccugggcgcugguacuaggcacguggcaguagaacccgagguggccaacuuggauaucauagggcagcggauugaaaauaucaagcaugagcacaaaucuaccuggcauuacgacgaggauaacccuuauaagacaugggcuuaccacggaagcuaugaaguuaaaccaaguggcuccgccagcucuauggucaauggcguggugaagcuccugacuaagcccugggacgucaucccuaugguuacccaaauugcaaugacagauaccacuccauucgggcagcagagaguguuuaaagagaagguagacacgcgcacacccaaagccaagaggggaaccgcucaaauaauggaagugacugcgcgauggcuaugggguuuccuuucacggaacaaaaagccgagaaucuguaccagggaggaauuuacacgcaagguccguaguaaugccgcaauuggcgcuguguucguugacgagaaccaguggaauuccgccaaagaggcaguggaagaugagcgguuuugggaccugguccauagagaaagggagcuccacaagcaggggaaaugcgccacgugcguguacaacaugaugggaaagcgcgaaaaaaagcugggcgaguucgguaaggcuaaagggagccgagccaucugguacaugugguugggagcgcgguuucuggaguucgaagcacucggcuucaugaaugaggaucacugguuuucuagagaaaacucgcuuucaggcguagagggggagggacugcauaaguuagguuauauucugagggacaucagcaaaauaccuggcgggaauauguacgccgaugacaccgcuggaugggauacucgcaucacagaagacgauuugcagaacgaggccaagauuaccgacaucauggaaccagagcacgcacuccuggcuacuuccauuuucaaacuaacauaucaaaauaagguugugagaguccagcggcccgccaggaacggcaccgugauggaugugaucagucgucgagaccagcgcgguucugggcaggucggaacauacggccuuaauacuuuuaccaacauggaagcucaacugauaagacagauggagagcgagggcauuuucuccccuucagaacucgagacgccaaaccuggccgaacggguuuuggauugguuagagaaacaugggguggaaaggcugaagcgcauggcaaucaguggagacgacuguguagugaagcccaucgaugacagauuugcgaccgcccucucugcucuuaaugauauggguaaaguccggaaggacauuccgcagugggagccuagcaaaggcuggaacgauuggcagcaagugcccuucugcucccaccacuuucaucagcugauaaugaaggacgggagggagaucguugugccaugucgaaaucaggaugaacuagucggacgugccagagugucacagggcgcagguuggagccugcgcgagacagcuugccucgggaaaucuuaugcccaaauguggcaguugauguacuuccaccggagggaccugagacuugcagccaacgcgauuuguuccgcuguaccuguugauugggugcccacuagucgcaccacauggagcauccaugcccaccaucaguggaugacuaccgaagacaugcugucggucuggaaucggguguggauugaggaaaacccauggauggaggauaagacgcacaucuccucuuggggagacguucccuaucucggcaagagggaggaccaauggugcggcucauuaauagggcugacagcacgagccaccugggcuacuaauauccagguggccauuaaccaggucagacgguugaucggaaaugaaaacuaccuggauuacaugacaagcaugaaaagguuuaagaaugagagugacccugaaggugcacucugguga

SEQ ID NO: 13844 - RNA, 9879 nt, Artificial Sequence
  derived and/or modified CDS sequence (opt3) from DENV-1__FJ898408__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaaaagcuggccacugaacgaaggcauaauggccguggggguugugucgauccuacugucaucucuucucaagaacgacgucccccuggccggaccuuugauugcuggcgguauguuaaucgcauguuaugugauuaguggguccagcgccgaucugucucucgagaaagcggcugagguaagcugggaagaggaagccgagcacuccggagcaucacauaauauccugguggaaguccaggacgauggcaccaugaagauaaaagacgaggagagggaugacacucuuacaauucuguugaaggccacccuacuggcuguuaguggcguguacccccucagcaucccagcaacgcuguucgugugguauuuuuggcaaaagaaaaagcagcgaucugggguccuuugggauacuccuucacccccagaaguggagcgcgccguuuuagacgauggaaucuaccggauuaugcagagaggucugcucggcaggagccagguaggggugggagucuuccaagaaaacguguuccacaccauguggcacguuacacguggcgcgguguugauguaucaggguaaacgccuggagccgaguugggcuagcgucaagaaagaccucauauccuacgggggaggcuggcggcugcagggcucuuggaauaccggggaggaagugcagguaaucgccgucgagccuggaaagaaccccaagaaugugcaaacagcaccagguacuuuuaaaacccccgaaggcgagguuggggccauugcucuugacuucaagccuggaacgucgggcagcccaaucgugaacagagaagguaaaauugucgggcuguacggaaauggcgugguuacaacuucaggcaccuauguguccgccaucgcacaggcuaaggccagucaggaggggcccuugccugagauagaagaugaggucuuuaggaaacgaaaccuaacaaucauggaccugcauccgggaucugguaagacccggcgcuaccucccagcgauugugagagaagccaucaagaggaaauuacggacucugauucuugcacccacccgaguaguggcuagcgagauggccgaagcucugaagggcaugccuaucagauaucaaacaacggcaguuaaauccgagcacacugggaaggagauagucgaucucaugugccaugccaccuucacaaugcgcuugcugucaccagugagggugcccaauuacaacaugauuaucauggacgaagcccacuuuaccgauccuucuagcaucgcugcgcguggauauauuaguacucgggucggcaugggugaggcagccgcuaucuucaugacagccaccccgcccggguccguagaagcauuuccacagagcaaugccgugauacaggacgaggaaagagauauuccugagaggucuuggaacucaggauacgaguggaucacggacuuccccggcaaaacuguuugguuugugccauccauuaagaguggcaaugauaucgcuaacugucuccgcaagaaugggaaacgagucauacagcugagcagaaagacauucgacaccgaauaucagaaaaccaagaacaacgauugggacuacgugguuacuacagacauuucggagaugggagcgaauuuucgggccgauagggugaucgacccucgccguugccuuaaacccgucauccuaaaggaugguccagaaagagugauucuggcaggcccgaugccuguaaccguggcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuucgaaccugagagagaaaaguccgcggcaaucgacggcgaguaccggcugaggggagaggcccgcaaaacguucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagaucuggaccaaagagggugaacgaaagaaacugagacccagguggcuagaugcccggacauauucugacccucuggcucuccgcgaguuuaaggaguucgcagccggcagaagguccguuagcggggaccuuauucuggagauaggaaaguuaccgcagcauuugacucagcgggcucaaaaugcccuggauaaccucgugaugcugcacaauucagaacagggcggucgagcauacagacaugcgauggaggagcuuccagacaccaucgaaacacugaugcucuuggcccugauugcuguauuaaccgggggcgugacucuauuuuuccugaguggacgcggccucgggaaaacgagcaucggacuucugugugucauggccuccucuguguugcuguggauggcaagcguugagccccacuggauugcugccuccaucauacucgaauuuuuccugauggugcuucucaucccugagcccgauaggcagcggaccccacaggacaaccaacuggcauaugucguaauugguuugcuguuuaucauuuuaacaguggccgcuaaugagaugggccuacuggaaacuaccaagaaagaucucgggaucggacacguugcgguggagaaccaucaccaugccacaaugcuugacgucgaucugcacccugcaucagcuuggaccuuguacgccguggccacuacaauaauuacgcccaugaugcgucauaccaucgaaaacacuacagcaaauauuucucugaccgcuaucgccaaccaggcggcuauacucaugggccuggacaaggguuggccaaucaguaaaauggauauuggggucccucuuuuagcccugggcugcuacagccaggugaauccgcucaccuugacagcagccguucugaugcuaguggcucacuaugcaaucauuggacccggccugcaagccaaggcgacuagagaggcucagaagaggacggccgcagggaucaugaaaaacccaaccguagacggaauaguggccauugaucucgacccugucguuuacgaugcuaaguucgaaaaacagcuuggccagaucaugcuguugauccuguguacaagccaaauucuccugaugcgcacuaccugggccuuaugcgaguccaucacacuugcaaccgguccccugacuacgcucugggaggggucuccaggaaaguuuuggaauacaaccauagcugugucaauggccaacauuuuccggggcagcuaucuagcgggugccggccuggcauuuuccuugaugaaaagucuagggggaggccgaagagggacuggagcucagggcgaaacccucggugagaaguggaagaggcagcuuaaucagcugucuaaaagcgaguucaacaucuacaagcgcucagggauuauggaggucgaccgguccgaagccaaagagggauugaagagaggcgagacaacucgucacgcagugaguagggguaccgcuaaacugcggugguucguagaacgcaaucucgugaagccugagggcaagguuaucgacuuaggguguggacgaggcggguggagcuauuacugcgccggacugaaaaaggugacagaagucaaaggcuauacgaagggugggcccggacaugaggaaccgauaccaauggccaccuacggcuggaaccuugugaaacugcacucuggcaaggaugucuuuuucacuccucccgagaaaugugacacacuacucugcgauaucggggaguccucaccaaaucccaccauugaagagggaagaacucugaggguguugaagaugguugaaccuuggcugcgggguaaccaauuuuguaucaagauucucaauccguacaugcccagcguaguggagacacuugagcagaugcagcgcaaacauggcgggaugcuggucagaaacccauuaucgagaaauucuacccacgaaauguauugggugaguugcggaacgggcaacaucguuuccgcggugaauaugaccagccgaaugcuguugaaccgguucacaauggcucaccguaagccuacuuacgagagagacgucgaucucggugcagggacccgccauguggccguagaacccgagguggcuaaccuggacauuaucggacagaggauagaaaauauuaaacacgagcauaagucaacauggcacuaugaugaggacaacccuuacaaaacuugggccuaucauggcuccuacgaaguuaagccaucuggcagcgcaaguuccauggucaaugggguggugaagcuacuuaccaaacccugggaugucaucccuaugguuacacaaaucgccaugaccgacacuacgccauuuggacagcagcggguguucaaggagaaaguagauacaagaacccccaaggcuaaacgcgguacugcgcaaauuauggaagugaccgccagguggcuguggggcuuucucagccgaaacaagaagccgcggauauguacaagagaggaguucacgaggaaaguccgcucuaaugcagcuaucggggccguguuuguugacgagaaccaguggaacucagcaaaggaggccguggaagacgagcguuucugggaucugguccagaaagaacgggaguugcacaagcagggaaaaugcgcuaccugcguguauaacaugaugggcaagagagaaaagaaacugggugaguuugggaaggccaaaggaaguagggcgauuugguacauguggcucggcgcacgcuuccuugaguuugaagcccugggcuucaugaaugaggaccacugguucucccgagaaaacagcuuaucugggguagagggagagggucugcauaaguugggcuacauccuccgggauauuucgaaaaucccugggggaaauauguaugcugacgauacugccggcugggacacaagaauaaccgaagaugaccugcaaaacgaggcaaagaucacugauauuauggaaccagagcacgcucuacuugccacaucaaucuuuaaacugaccuaccagaauaagguugugaggguccagcgccccgcuaagaacgguacagugauggacgugauuagcagacgggaucagaggggguccggacaagucggcacuuauggccucaauaccuucacgaacauggaagcccagcugauccgucagauggagagugaggggauauuuuugccuucugaauuagagaccccaaaccuggcagaacgaguucucgacuggcuugagaaauacggaguggaacgccugaagagaauggcgauuagcggugaugacuguguagugaaacccaucgacgaucgguucgccacagcucuaacugcccugaaugacaugggcaaggucaggaaagauaucccgcagugggagccuuccaagggguggaacgacuggcaacaggugcccuuuugcucacaucacuuccaccagcucauuaugaaggauggacgcgagauaguugugccauguagaaaucaggacgaauuggucggccgggcaagggugagucaaggugcuggguggucucugcgagagaccgccugccuuggaaaaagcuaugcacagauguggcagcugauguacuuucaucguagagaucuccgcuuagccgcgaacgcuaucuguuccgccgacccuggcgauuggguacccacaucacggacuaccuggagcauucacgcacaucaccaauggaugacgacagaagacaugcugucuguuuggaauaggguguggaucgaggaaaacccauggauggaggauaagacccaugucuccaguuggggcgacgugcccuauuuggggaaaagagaggaccaguggugcggaagccugauuggucucacugcccgcgcuacaugggccucgaauauccagguugcaauaaaccaggugcggaggcuuaucggcaaugaaaacuaccuggauuacaugaccuccaugaagcgauucaaaaaugagggggacccugaaggagcucuaugguga

SEQ ID NO: 13845 - RNA, 9879 nt, Artificial Sequence
  derived and/or modified CDS sequence (opt3) from DENV-1__GQ199843__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagguggaaccggacgauguagacuguuggugcaauaccacugauacaugggugaccuaugggacguguagucaaacuggagagcaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaagcuuugcauugaagccaaaaucucuaauacgaccacagauagcagguguccaacucaaggagaggcuacccugguugaagagcaggacgccaacuucgugugccggcgcacauuuguagaucgaggcugggguaauggguguggauuguucggcaagggcucccucauaacuugcgcaaaguuuaaaugcgugaccaagcuggaggggaaaauuguccaguacgaaaacuuaaaguauucagugaucguuacagugcacaccggagaccagcaucaagucgguaaugagaguacugaacacggcacgacagcuaccauuacuccccaggccccuaccagcgagauccagcugacagacuacggggcgcucacccuugauuguucuccaagaacuggacuggacuucaacgaaaugguguugcuaacaaugaaagagaaguccuggcugguacauaaacagugguuucucgaucugccgcuucccuggacgucaggcgccagcaccagucaagagacuuggaauaggcaggaccuguugguuacauucaagaccgcacacgcuaagaaacaggaaguggucgugcucgguucucaagagggggccaugcacacagcucugacuggcgccaccgaaauccagacguccggaaccacaacuauuuuugcaggccauuuaaagugccggcugaaaauggauaagcuaacccucaaagggaugagcuaugucauguguacaggaucguucaagcuggagaaggaaguggccgagacucagcacgguaccguucuugugcagauaaaauacgagggcacggacgcuccuugcaagaucccauucucuacacaagaugaaaaagggguaacccagaacggacguuugauuacugcgaaucccaucgucacagacaaggagaaaccugugaacauagaagcagagccacccuuuggcgaguccuauauuguuaucggugccggggaaaaggcucugaagcucucaugguucaaaaagggcaguagcaucggaaaaauguuugaggccaccgcacgcggcgccagaaggauggcuauucugggggauacugccugggacuucggauccaucgguggcguguuuaccucugucgggaagcuugugcaucagauuuucggaacagcauacggcguacuguuuagcggugugucauggacgaugaaaauagggaucggcguuuugcucaccuggcugggauuaaauagucgguccacuagccugucuaugacauguauugcggucggccuagugacccucuaccugggggugaugguccaggcugauucaggaugcguuaucaacuggaagggccgagaacuuaagugugguagugggaucuucgugacaaaugaggugcacacuuggaccgaacaauauaaauuucaggccgacagcccgaagcgcuuguccgcagccauuggaaaagcuugggaggagggcguaugcgguauaagaucugccacgaggcuggaaaacaucauguggcggcagauuucgaacgagcucaaucauauccuguuagaaaacgacaugaaguucacagucgugguuggcgauguggucgggauucuggcacagggaaaaaagaugauccgcccucaacccauggagcacaaauacagcuggaaguccuggggcaaggcuaaaauaaucggggccgacgugcagaauaccacuuuuauuaucgauggaccaaacaccccugaaugucccgacgaucagagagcguggaauauuugggagguugaggacuauggcuucgguaucuuuacaacuaacauauggcuuaaguugagggauucauacacccaggugugcgaccaccgucucaugagugccgcuauuaaagauucuaaggcaguacaugccgacaugggguauuggaucgaaagcgagaaaaaugaaacauggaagcuggcucgggccuccuucauugaggucaagacguguaucuggccaaaaucacacacccuauggagcaacggagugcuggaaucugagaugauaauccccaagauuuacggcgguccuaucucccaacauaauuaucgaccaggcuacuucacucagacagcagggccguggcaccucggaaaacuggagcuugauuuugacuugugcgaaggcaccacuguggucguugaugagcacugcgggaacagaggacccagucugaggacaaccacggugacuggcaagauuauccaugaaugguguugccgcagcuguaccuuaccuccacuccgguucaaaggugaggacgggugcugguacggaauggagauaagacccguaaaggaaaaggaggaaaaucuggugaaaucuauggucuccgcgggcucaggugagguggacaguuuuagccuuggccuguuguguauuucgaucaugaucgaagagguuaugaggucccgcuggucucgaaagaugcucaugacagggacccuggccguguucuuucuacugauuaugggacagcucacuuggaacgaucugauccggagcugcauuauggucggcgcuaaugccucagaccguauggggaugggaacaaccuaucuugcauugauggcuacauucaaaaugagaccuauguuugccgugggccuguuauucaggcgccucacuagucgggagguucugcuucugaccauaggucuaucccucguggcaucugucgaacugccaaacagcuuggaggaacugggggauggauuagccaugggcaucaugauucucaagcugcuuacggacuuucaauccuaccagcugugggcuacauugcucucacugaccuucaucaaaacuaccuuuagccuacacuaugcguggaagacaauggccaugguacugaguauugugucucuucucccccuguguuuguccacuaccagccagaagacgacauggcugccgguuuuacucggcucgcuggggugcaaaccucuuaccauguuccugaucgcagagaauaagauauggggaagaaaaucauggccauugaacgaagguaucauggcugugggcauugucucuauccuccugaguucccuacugaagaacgaugugccccuugccgggccucucauugccggaggcaugcugaucgcuuguuacguaauaagcgguucuagcgcagacuuguccuuagagaaagccgcggaggugucaugggaagaggaagcugagcauaguggggccagccacaauauucuggucgaaguucaggaugacggaacuaugaagaucaaagaugaggagagggacgauacacucaccauccugcuuaaggcaacucuguuggccgugucuggcguguauccccuauccauuccagcuacacuguuugucugguacuucuggcaaaagaaaaagcagcgaucaggcgugcucugggacaccccuagucccccagaaguugagcgcgcaguacuggaugacgggauauaucggaucaugcagagaggacuuuuagguaggagccaggugggcgucgggguguuccaagaaaacguuuuucauacgauguggcacgugacucguggagccguccugauguaccagggcaaacgccucgagccguccugggcgucugugaagaaagacuugauuucguacggugggggauggcggcugcagggcagcuggaauaccggcgaggaaguacaggucaucgcuguggagccugggaagaaccccaagaauguucaaacagccccaggaaccuucaaaacacccgaaggugaggugggcgcaauugcccucgauuuuaagccugggacuucaggauccccaaucgucaacagagaaggcaaaauagugggucuguaugggaauggaguugugaccacgaguggcacauacgucucugcuaucgcccaggcaaaggcuagccaggagggcccccuuccugagauugaagacgagguguucaggaaacgaaaccugacuaucauggauuugcacccgggguccggaaagacccggcgcuaucuaccagccauuguaagagaagcgaucaagaggaaacugcggacacucauauuagcccccacccgagugguugcaucagagauggcugaagcccugaaggguaugccuauuagauaccaaacuaccgcugucaaaucugagcauacaggccgcgagaucguggaccuuaugugccacgcaacguuuacuaugaggcugcucagcccagugcguguccccaauuauaacaugaucauuauggaugaagcccauuucaccgacccuaguuccaucgccgcucggggguacauaagcacaagaguaggaaugggcgaggcggcagccauuuuuaugaccgcuacuccgcccgguucuguggaagccuucccacagucaaaugcaguuauccaggaugaggaaagggacauuccugagcgcuccuggaacaguggguaugaguggaucacagauuuucccggaaagaccgugugguucgucccaagcauaaaaucgggcaaugacauugccaacuguuugcgaaagaauggcaagagagugauccagcugucucggaaaacguuugauacugaauaccaaaagacaaaaaacaacgacugggacuacguugugaccaccgauaucuccgagaugggggcuaauuucagggcggaccgcgucauugauccucguagaugccucaagcccgugauccugaaagacggaccagaacggguaauucuugccgguccgaugccugugacuguugcaagcgcugcccagaggcgcggccgaauagggagaaaccacaauaaggagggagaucaguauaucuacaugggccagccccuaaacaaugacgaggaucaugcacacuggacagaagccaagaugcuguuggacaacauuaauaccccagaggguaucauccccgcuuuauucgaaccugagcgggaaaaaucagccgcgauugauggggaguauaggcugcgcggcgaggcaagaaagacauuugucgaacucaugaggcggggagaccugccaguguggcuuaguuacaaaguggccucugagggcuuccaauauuccgaucgucgcuggugcuuugacggggaacgaaacaaucagguccuggaggaaaacauggauguugagauauggacuaaggagggagaaagaaaaaagcucaggccccggugguuggacgcucgcacguacagcgacccucuggcccuaagagaguucaaagaauuugcugcagguaggcggucagugaguggcgaucugauccucgagauugggaagcuuccgcagcaccugacccagcgagcccaaaaugcuuuagacaacuugguaaugcugcauaauagcgaacagggaggcagagccuaucgccacgcaauggaggagcucccagauacaaucgaaacucugaugcuucuggcgcucauugccguguugaccgguggggucacacuguucuuuuuauccggcaggggacuaggcaagaccucuaucgggcugcucugugugauggcuagcuccgcccuucuguggauggcaucaguugagccccauuggauagcugccucuaucauuuuggaauucuuucugauggugcuccugaucccugagcccgaccggcagcguacuccacaggauaaccaacuugcauacgucguaauuggacuccuguucaugaucuugacgguggccgcuaaugagaugggucuguuagaaaccacaaaaaaggaccuaggcauagggcacgcggccguugagaaccaccaucacgcaacuaugcuggauguggaccuccauccugcuagugccuggacccuuuacgccgucgcaacaaccauuaucacucccaugaugagacacacaauugaaaacacgaccgcuaauaucucgcugacugccauagcgaaccaggcugccaucuugaugggacuggauaaaggcuggccaauuagcaagauggacaucggugugccucuccuggcacuugggugcuauucccaggucaauccguuaacacugaccgccgcugugcucauguugguugcacauuacgccauuaucggccccggacugcaagcgaaagcuaccagggaggcccagaagcgcacagcagccggcauaaugaagaacccaacuguggaugggauuguagcuaucgaccuagauccuguggucuaugacgccaaauuugaaaagcagcugggacagaucaugcuccuuauucuguguacgucucaaaucuugcugaugcggaccacaugggcacucugcgagucaauaacucuggcuaccggccccuuaacaacccuuugggaggguagcccagggaaauucuggaauacuacgauugccguuuccauggcgaacaucuuucgaggaaguuaccuggccggcgcaggucucgcuuucucucuaaugaagagccugggcgggggaagaaggggcacaggggcccagggagaaaccuugggcgagaaauggaagcgccagcugaaucagcucucaaaguccgaauucaacacuuauaaacggagugguauuauggagguggacagaagcgaagcaaaggaggggcuucguaggggagagaccacaaaacacgcugucucucggggcacugccaagcugcgcugguuuguggaacgaaauuugguaaaaccugaggguaaggugaucgaucugggcugugggagaggaggcugguccuacuauugcgccgggcucaagaaaguuaccgaagugaagggauacacaaaaggcggucccgggcacgaggaaccgauaccaauggcgacguacggauggaacuuagucaagcugcauucaggcaaagacguguucuuuaucccucccgagaagugugauacccuucugugcgacauuggcgagagcucgccaaaucccacuaucgaagaggggaggacacuacggguccucaaaaugguggaaccuuggcugcgcggaaaccaauucuguauuaagaucuugaauccguauaugcccucuguuguagagacccuggagcagaugcagagaaagcacgguggcaugcucgugaggaacccacuuagucgaaauuccacucaugaaauguacugggucagcugcgggacaggaaacauugugucagcuguuaauaugaccucccggaugcuguuaaaccguuuuacgauggcacacagaaaaccuaccuaugagcgcgauguggaccugggcgccgguacaaggcacgucgcuguggaacccgagguagccaacuuggauaucauagggcagcggauugaaaauaucaagcaugagcacaaaucuacuuggcauuacgacgaggauaacccuuauaagaccugggcauaccacggaagcuaugaagugaaaccaaguggcuccgccagcucuaugguuaauggcgucgugaagcuccugacaaagcccugggacgugaucccuauggucacucaaauugcuaugaccgauacaaccccauucgggcagcagagaguuuuuaaagagaagguggacacucgcacgcccaaagcgaagaggggaacagcccaaauaauggaaguaaccgcacgauggcuaugggguuuccuuucacggaacaaaaagccgagaaucuguacuagggaggaauuuacccgcaaggugcguaguaaugcugccauuggcgcagucuucguggacgagaaccaguggaauuccgccaaagaggcuguugaagaugagcgguuuugggaccuggugcauagagaaagggagcuccacaagcaggggaaaugcgccacaugcgucuacaacaugaugggaaagcgcgaaaaaaagcugggcgaguucgguaaggcgaaagggagccgagcaaucugguacaugugguugggagcccgguuucuggaguucgaagcucucggcuucaugaaugaggaucacugguuuucuagagaaaacucgcuuucaggcguggagggggagggacugcauaaguuagguuauauucugagggacaucagcaaaauaccuggcgggaauauguacgccgaugacacggcaggaugggauacccgcaucacugaagacgauuugcagaacgaggcuaagauuacagacaucauggaaccagagcacgcccuccuggcuaccuccauuuucaaacuaacuuaucaaaauaagguaguuagagugcagcggcccgccaggaacggcacagucauggaugugaucagucgucgagaccagcgcgguucugggcaggugggaaccuacggccuuaauacauuuacuaacauggaagcacaacugauaagacagauggagagcgagggcauuuucuccccuucagaacucgagaccccaaaccuggcggaacgggucuuggauugguuagagaaacaugggguugaaaggcugaagcgcauggccaucaguggagacgacugugugguaaagcccaucgaugacagauuugcuacggcccucucugcacuuaaugauauggguaaagugcggaaggacauuccgcagugggagccuagcaaaggcuggaacgauuggcagcaaguccccuucugcucccaccacuuucaucagcugauaaugaaggacgggagggagaucgugguuccaugucgaaaucaggaugaacuagugggacgugcuagagucucacagggcgccgguuggagccugcgcgagaccgcaugccucgggaaaucuuaugcccaaauguggcaguugauguacuuccaccggagggaccugagacuugcggcuaacgccauuuguuccgcagugccuguagauuggguucccacaagucgcacuaccuggagcauccaugcccaccaucaguggaugacaacugaagacaugcugucgguguggaaucgggucuggauugaggaaaacccauggauggaggauaagacccacaucuccucuuggggagacgugcccuaucucggcaagagggaggaccaauggugcggcucauuaauagggcugacggcucgagccacaugggcaaccaauauccagguugcuauuaaccaggugagacgguugaucggaaaugaaaacuaccuggauuacaugacuagcaugaaaagguuuaagaaugagagugacccugaaggugcccucugguga

SEQ ID NO: 13846 - RNA, 9879 nt, Artificial Sequence
  derived and/or modified CDS sequence (opt3) from DENV-1__GQ199844__SS-prME
agcgugaccaugcugcucaugcuuaugcccacagcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaauugccaccaucacuccccaggcgccuaccagugagauccagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugucauguguacagguagcuucaaacuggagaaggaaguggcugagacucagcacggaaccguccuugugcagaucaaguacgagggcacggacgcgccuugcaaaauuccauucucgacacaagaugaaaaggggguuacccagaacggacgcuugaucacugcaaaucccauagugacagacaaagagaagccuguaaacauugaagccgagccacccuuuggcgagucuuauaucgucaucggugcuggggaaaaagcccugaagcucuccugguucaagaaaggcucaaguauuggaaagauguuugaggcaaccgccagaggcgcuaggcggauggccauccugggggauacugcaugggacuucggaagcguggguggcguuuuuaccuccguggggaaacuuguccaucagauuuucggaacagcguacggcgugcuguuuucugguguaagcuggacgaugaagauagggaucggcguguugcucaccuggcugggauuaaauucacgaaguacuucccugagcaugacauguauugcuguuggccuagucacccucuaccugggggugauggugcaggccgauucuggaugcgucaucaacuggaaaggccgcgaacuuaagugugguucagggaucuucguuacaaaugaggugcacacuuggaccgaacaauauaaguuucaggcagacaguccgaaaagauugagcgccgcuauuggaaaggccugggaggagggcgugugcgguauaagguccgcaacgcggcuggaaaacaucauguggaaacagauuucuaacgagcucaaucauauccuguuagaaaacgacaugaaguucacaguagucgugggcgauguuguggggauucuggcucagggcaaaaagaugauccgcccucaacccauggagcacaaauacucguggaaaagcuggggcaaggccaagauaaucggggcggacguccagaauaccacuuuuauuaucgauggaccaaacaccccugaaugucccgacgaucagagagccuggaauauuugggagguggaggacuauggcuucgguaucuuuacaacuaacauauggcuuaaguugagggauuccuacacccagguuugcgaccaccgucucaugucagcugcaauuaaagauaguaaggccgugcaugcugacaugggguauuggaucgaaucugagaaaaaugaaacauggaagcuggcccgggcauccuucauugagguaaagacguguaucuggccaaaaucccacacccuauggucaaacggaguccuggaaagcgagaugauaauccccaagauuuacggcgguccuaucucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagauuauccaugaaugguguugccgcaguuguaccuuaccuccacuccgguucaaaggugaggacgggugcugguacggaauggagauaagacccgugaaggaaaaggaggaaaaucugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaacgaucuuauccgguugugcauuauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguccugucaauugcuagcuuguucccccuguguuuaaguacuaccucucagaagacgacauggcucccgguacugcuuggcucccuggggugcaaaccuuugaccauguuucucaucacugagacaaagauauggggaagaaaaagcuggccacugaaugaagguaucauggccgugggcguugugucgauucuacugucaucucuucucaagaacgaugucccccuggccgggccuuugaucgcuggaggcauguuaauugcauguuaugugaucagugguuccagcgccgaccugucucucgagaaagcggcugagguaagcugggaagaggaagccgagcacuccggggcaucacauaacauacugguggucguucaggaugacggaaccaugaagauuaaagaugaagagagggacgauacucuuacaauccuguugaaggccacccuacuggcugugaguggcguguacccccucagcaucccagcaacgcuguucgucugguauuuuuggcaaaagaaaaagcagcgaucuggcgugcuuugggacacuccuucacccccagagguugaacgcgccguauuagaugacgggauuuaccggauaaugcagagaggacugcucgguaggagccaggugggcgucgggguguuccaagagaauguuuuccacaccauguggcacgugacacguggagcggucuugauguaucagggcaaacgccuggaaccgaguugggcuagcgugaagaaagaccucaucuccuacggugggggauggcggcugcagggcucuuggaacaccggcgaggagguacaggucauugccguggaaccugggaagaaucccaagaacguucaaacagcaccaggaacuuuuaaaacccccgagggugaagugggcgccaucgcucuugauuucaagccugggacgucgggaagcccaauugucaauagagagggcaaaaucgugggucuguacgggaacggaguugugacaacuucaggcaccuaugucuccgccauagcacaggcuaaggccagucaggaaggccccuugccugagaucgaggacgaaguguuuaggaaacgaaaucuaacaauuauggaucugcauccggggucuggaaagacccggcgcuaccucccagcgaucguaagagaggccauuaagaggaaauuacggacucugauccuugcacccacccgagugguugcuagcgaaauggccgaggcucugaaggguaugccuauaagauaucaaacaacggcagucaaauccgaacacacuggcaaggagauuguggaccucaugugccaugccaccuucacaaugcgcuugcugucaccagugaggguccccaacuacaauaugaucaucauggaugaggcccacuuuaccgacccuucuagcauugcugcgcguggguauaucaguacucggguaggaaugggcgaagcagccgcuauauucaugacagccaccccgcccgguuccguggaggcauuuccacagagcaacgccguuauucaggaugaagagagagacaucccugaaaggucuuggaacucaggguacgaguggauuacggauuuccccggaaaaacugugugguuugucccauccaucaagaguggcaacgacauagcuaauugucuccgcaagaacggcaaacgagugauucagcugagcagaaagacauucgauaccgaguaucagaaaaccaagaauaacgacugggacuacguugugacuacagauaucucggaaaugggggcgaacuuucgggccgacagggucaucgauccucgccguugccuuaaacccgugauucuaaaggacggaccagagagaguaauccuggcagguccgaugccugugaccguugcuucugccgcacagcggaggggccgcauugggcgaaaucauaacaaggaaggagaucaguacauauauaugggccagcccuugaauaacgacgaggaucacgcccacuggacagaggcuaaaauguuacuggacaauaucaacacuccagaagguauuauccccgcccucuucgagccugaaagagagaaguccgcggcaaucgauggggaauaccggcugaggggcgaggcccgcaaaacguucgucgagcuuaugagaaggggagaccugccaguguggcucagcuauaagguggcuucagaaggcuuucaauacagugaucggcguuggugcuucgacggggagcgcaauaaccaggucuuggaagagaauauggauguugaaauuuggaccaaagagggagagcgaaagaaacugagacccagguggcuagacgcccggacauauucugacccucuggcucuccgcgaauuuaaggaguucgcagccgguagaagguccgugagcggcgaucuuauacuggaaaucgggaaguuaccgcagcauuugacucagcgggcucaaaacgcccuggacaaucucguaaugcugcacaacucagagcagggaggccgagcauacagacaugcgauggaggaacuuccagauaccauugagacacugaugcucuuggcccugaucgcuguguuaaccgguggggucacucuauuuuuccugaguggccgcggacucggcaaaacgagcauugggcuucugugugugauggccuccucuguuuugcuguggauggcaagcguggaaccccacuggaucgcugccuccauaauccucgaguuuuuccugaugguccuucucauuccugaacccgacaggcagcggaccccacaggauaaucaacuggcauauguagugaucggauugcuguuuaugauuuuaacaguugccgcuaacgagaugggucuacuggagacuaccaagaaagaccucggcaucgggcacguggcggucgaaaaucaucaccaugccacaaugcuugauguggaccugcacccugcaucagcuuggaccuuguacgccgucgccacuacaauaauuacgcccaugaugcgucauaccaucgagaacacuacagcaaacauuucucugaccgcuaucgccaaucaggcggcuauacucaugggacuggauaagggcuggccaaucaguaaaauggacauuggugugccucuuuuagcccuggggugcuacucgcagguuaacccgcucaccuugacagcagccgugcugaugcuaguagcucacuaugcaaucauuggccccggacugcaagccaaggcgacuagagaagcucagaagaggacggccgcaggcaucaugaaaaauccaaccguggaugggauagucgccauugaccucgauccuguuguguacgacgcuaaguucgagaaacagcuuggacagaucaugcuguugauccuguguacaagccaaauucuccugaugcgcacuaccugggccuuaugcgaauccaucacacuugcaaccggcccccugacuacgcucugggaggguucuccagggaaguuuuggaacacaaccauagcugucucaauggccaauauuuuccggggaagcuaucuagcgggcgccggucuggcauuuuccuugaugaaaagucugggcgggggacgaagaggcacuggggcucagggagagacccucggcgaaaaguggaagaggcagcuuaaccagcugucuaaaagcgaguucaauaucuacaagcgcucagguauuauggaaguggaccgguccgaggccaaagaaggguugaagagaggagagacaacucgucacgcaguaaguaggggcaccgcuaaacugcggugguucguggagcgcaaccucguuaagccugaagguaaggugaucgauuuaggcugugggcgaggaggcuggagcuauuacugcgccgggcugaaaaaggucacagaggugaaaggauauacgaagggcggucccgggcaugaggagccgauaccaauggccaccuacggauggaaucuugucaaacugcacucuggcaaggacguguuuuucacuccucccgaaaaaugugauacacuacucugcgacaucggcgaguccucaccaaaccccaccauugaggaagggagaacucugaggguuuugaagaugguagagccuuggcugcggggaaaucaauuuuguaucaagauucucaacccguacaugcccagcguggucgaaacacuugagcagaugcagcgcaaacaugguggcaugcuggugagaaauccauuaucgaggaacucuacccacgagauguauuggguuaguugcgggacgggaaauaucguguccgcggucaacaugaccagccgaaugcuguugaaucgguucacaauggcucaccguaagccuacuuacgaaagagauguggaccucggcgcagguacccgccauguagccguggagcccgaaguugcuaaccuggauauuaucgggcagaggauagagaacauuaaacacgaacauaagucaacauggcacuaugacgaggauaauccuuacaaaacuugggccuaucauggauccuacgaggucaagccaucuggcagcgcaaguuccauggugaacggcguggucaagcuacuuaccaaacccugggacguuaucccuauggugacacaaaucgccaugaccgauacuacgccauuugggcagcagcggguauucaaggaaaaaguggacacaagaacccccaaggcuaaacgcggaacugcgcaaauuauggaggucaccgccagguggcugugggguuuucucagccgaaauaagaagccgcggauauguacaagagaagaguucacgaggaaagugcgcucuaacgcagcuaucggcgccguuuuuguggacgaaaaucaguggaacucagcaaaggaggccgucgaggaugaacguuucugggaccuggugcagaaagagcgggaauugcacaagcaggggaaaugcgcuaccugcguauauaauaugaugggaaagagagagaagaaacugggcgaauuugguaaggccaaagggaguagggcgauuugguacauguggcucggagcacgcuuccuugaguuugaggcccugggcuucaugaacgaagaucacugguucucccgagagaauagcuuaucuggcguugaaggggagggacugcauaaguuggguuacauccuccgggacauuucgaaaaucccuggcgggaacauguaugcugaugacacugccggaugggauacaagaauaaccgaggacgaucugcaaaaugaagcaaagaucacugacauuauggagccagaacacgcucuacuugccacaucaaucuuuaaacugaccuaccagaacaagguggucagggugcagcgccccgcuaagaauggcacagugauggaugucauuagcagacgggaccagagggguuccgggcaaguuggaacuuauggccucaacaccuucacgaauauggaggcccagcugauccgucagauggaaagugagggcauauuuuugccuucugaguuagaaaccccaaaccuggcagagcgagugcucgauuggcuugaaaaauacgggguagagcgccugaagagaauggcgauuagcggagacgacuguguggucaaacccaucgaugaccgguucgccacagcucuaacugcccugaacgauauggguaaggugaggaaagacaucccgcagugggaaccuuccaagggcuggaaugauuggcaacagguucccuuuugcucacaucacuuccaccagcucauuaugaaggacgggcgcgagauaguggucccauguagaaaccaggaugaguuggugggacgggcaaggguaagucaaggcgcugguuggucucugcgagaaaccgccugccuugggaaaagcuaugcacagauguggcagcugauguacuuucaucguagagaccuccgcuuagccgcgaaugcuaucuguuccgccguuccuguggauuggguccccacaucacggacuaccuggagcauucacgcacaucaccaauggaugacgacagaggacaugcugucuguguggaacaggguuuggaucgaagagaauccauggauggaagauaagacccauguguccaguuggggagacguccccuauuugggcaaaagagaggaccaguggugcggcagccugauugggcucacugcccgcgcuacaugggccucgaacauccagguggcaauaaaucagguacggaggcuuaucggaaacgagaauuaccuggauuacaugaccuccaugaagcgauucaaaaacgaaggugacccugagggcgcucuaugguga

SEQ ID NO: 13847 - RNA, 9879 nt, Artificial Sequence
  derived and/or modified CDS sequence (opt3) from DENV-1__GQ199845__SS-prME
uccgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcauguucaccucuguugggaaacuggugcaucagauuuuuggaacagcguacggcguccuuuucagcggugugucauggacgaugaagauagggaucggcguacuguugaccuggcucggacugaauagucgauccacuagcuuaucuaugacauguauugcugugggccugguuacccuauaccucggggucauggugcaggccgauucaggaugcgugaucaacuggaaaggccgcgaacugaagugugguagugggaucuuugucacaaaugagguucacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacagugguagucggcgauguggcugggauucuggcccagggcaagaagaugauccgcccucaacccauggaguacaaauauagcuggaagauauggggcaaggcgaaaaucauuggggccgacguucagaauaccacuuuuaucauugauggaccaaacaccccugaaugucccgacgaucagagagcuuggaauaucugggagguggaggacuacggcuucgguauauuuacaacuaacauuuggcuuaaguugagggauuccuauacccaggucugcgaccaccgucucaugucagcagccaucaaagauaguaaggcugugcacgccgacaugggguacuggauugaaucugagaaaaaugaaacauggaagcuggcacgggcgagcuucaucgagguuaagacguguauauggccaaaaucccauacccuauggucaaacggagugcuggaaagcgagaugaucauucccaagaucuauggcgguccuauuucucaacacaauuaccgaccaggcuacuucacucagacagccgggccguggcaucucggaaaacuggagcuugauuuugacuugugcgaaggcaccacuguagucguggaugagcacugcgggaacagaggacccucccugaggacaaccacggugacuggcaagaucauacacgaaugguguugccgcaguuguaccuuaccuccacuccgguucaaaggugaggacgggugcugguauggaauggagauuagacccgucaaggaaaaggaggaaaaucugguuaaaagcauggugucugcuggcuccggugagguagacucauuuagucuuggccuguuguguaucagcaucaugauugaagaggugaugaggucgcgcuggucccgaaagaugcucaugacagggacccuggccgucuucuuucuacugaucaugggacagcucacuuggaacgaucugauucggcuuugcauaauggugggcgcaaaugcuucugaccguauggggaugggaacaaccuacuuggcccugauggcaacauucaaaaugagaccuauguuugccguuggcuuacucuucaggcgccugacuagccgggaggugcuucugcuaaccaucggucucucacuggucgcuaguguggaauugccaaacucccuggaggaauuaggggauggacucgcgaugggcauuaugauccugaaacuucugacggacuuucaaucucaucaguugugggccacacuccugagccuaaccuucauuagaacuaccuuuucccugcacuaugcauggaaaacaauggcuaugguucuuucaaucgugagccucuucccccuguguuugaguacuaccucucagaagacgacauggcugccggucuuacucggcucccuggggugcaagccucuuaccauguuucugauagccgagaauaaaaucuggggaagaaagagcuggccauugaacgaagguauuauggccguaggcaucgugucgauucuccugucaucucuacugaaaaacgauguuccccuugcugggccucucaucgcaggaggcaugcugauagccuguuacgugauuagugguuccagcgcggacuugucuuuagagaaggcugccgaggucagcugggaagaggaagcagagcauuccggggccucacacaauauccugguggaaguacaggaugacggaacuaugaaaaucaaggaugaggagcgagacgauacacucaccauucugcuuaaagcuacucuguuggcagugaguggcgucuauccccuaagcauaccagccacacuguucguuugguacuucuggcaaaagaagaaacagcgcucuggcgugcucugggacaccccuucacccccagaaguggagcgggcgguccuggaugacgggaucuauagaauuaugcagaggggacuuuuaggucguagccaggugggcguugggguauuucaagaaaacguguuccauacgauguggcacgucacucgcggagcugugcugauguaccagggcaagcggcucgagccgaguugggccagcguuaaaaaggacuugaucuccuacggugggggauggagacugcagggcucuuggaauaccggcgaggaagugcaggucauugcaguggagccugggaaaaaccccaagaauguacaaacagccccaggaaccuuuaagacaucggaaggugaggucggcgcuaucgcccucgauuucaaacccgggacuagcggaucaccuauagugaacagggaaggcaagaucguuggucuguaugggaauggaguggucaccacguccggcacauacgugagugcaauugcucaggccaaagcgucucaggagggcccacuucccgagaucgaagacgagguuuuucgaaagcggaaccugacuauuauggauuugcacccugggagcggaaaaacccgcagauaucuaccggccaucgugagggaagcaacaaagcggcgacugagaacccucauauuagcuccaacucgcgucguggccuccgagauggcugaagcacugaaggguaugcccauuagguaccaaaccacagccguaaaaucagagcauacgggcaaggagaucguggaccuuaugugccacgccacuuucaccaugcgucugcucucuccuguucgggucccaaauuauaacaugaucauuauggaugaagcucauuuuacagaccccagcaguaucgcggcaagaggguacauauccaccagggugggaaugggcgaggccgcugccauuuucaugacugcaacaccuccggguagcguggaagccuuuccccagucuaaugcugucauccaggaugaggaacgcgacauuccagagcgaucauggaacuccggguaugaguggaucaccgauuucccuggaaaaacgguaugguuugugcccaguauaaagagcggcaaugacauugcgaacuguuugaggaaaaauggcaagcggguuauccagcugucgaggaagacuuucgauacagaauaccagaaaaccaagaacaacgacugggacuacguggucaccacugauaucucugagaugggggccaauuuccgcgcagaccgugugauugauccaagacggugccucaaaccuguuauccugaaggacggacccgaaagggugauucuugcugguccaaugccggucacaguggccuccgcagcccagcgccgaggcagaauagggcggaaccacaauaaagagggagaucaguauaucuacaugggccagccucuaaacaaugacgaggaucaugcucacuggaccgaagccaagaugcuguuggacaacauuaauacacccgaggguaucaucccagcguuauuugaacccgagagggaaaagagcgcagccauugauggggaguaucgccugagaggcgaggcuaggaaaacuuucguagaacucaugcggcguggagaccugccuguguggcuuucauacaagguugccagugagggcuuucaauauucugaucgccgauggugcuucgacggggaaagaaacaaucagguccuggaggaaaacauggauguggagauauggacgaaagagggagaaaggaagaaacuccggccacgcugguuggacgcuagaaccuacuccgacccccuggcacuaagggaguuuaaggaguucgccgcuggucggcgaagcgugucaggcgaucugauccucgagauugggaaacuuccucagcaccugacacagagagcccaaaaugcauuagacaacuuggucaugcugcauaauagugaacagggaggccgcgcguauaggcacgccauggaggagcucccggauacuaucgaaacccugaugcuucuggcucucauugccguuuugacagguggggugacccuguuuuucuuaagcggccggggacuaggcaagacuuccaucgggcugcucuguguaauggcaucuagcgugcuucuguggauggcuuccgucgagccacauuggauagccgcaucaaucauuuuggaauuuuuccugauggugcuccugauccccgagccugaccgucagagaacgccccaggauaaccaacuugccuacguugugauuggacuccuguuuaugaucuugaccgucgcugcgaaugagaugggucuguuagaaacaacuaagaaagaccuaggcauagggcacguagccguggagaaccaccaucacgcagcuaugcuggauguugaccuccauccagccucugccuggacccuuuacgcaguggcuacaaccauuaucacuccuaugaugaggcacacaauugaaaacacgaccgccaauaucagucugacugcgauagcuaaccaggccgcaaucuugaugggacuggauaagggcuggcccauuucgaaaauggacaucggugucccacuccuggcccuugggugcuauagccaggugaauccuuuaacacugaccgcugcaguccucauguugguggcccauuacgcgauuaucggcccgggacugcaagcuaaggccacccgcgaggcacagaaacggacagccgcuggcauaaugaagaaccccacuguugaugggauuguggccaucgaccuagauccaguaguguaugacgcaaaguucgaaaaacagcugggacagaucaugcuccuuauucuguguacgucccaaaucuugcugaugcgaaccacaugggcucucugcgagucuauaacucuggccaccggcccuuuaacaacccuuugggaggguucacccgggaaguuuuggaauacuacgauugcggucagcauggccaacaucuucagaggauccuaccuggcaggcgcuggucucgccuucagucuaaugaaaucucugggcgggggaaggcgcggcacaggggcacagggagaaaccuugggcgagaaguggaaacggcagcugaaucagcucagcaagucagaauuuaacacuuauaagagauccgguauuauggagguugaccguagugaagcuaaagaggggcuuaagaggggagagaccacaaaacacgccgugagccggggcacugccaagcugcgcugguucgucgaacgaaauuuggugaaaccagaggguaagguaaucgaucugggcugugggagaggaggcuggucuuacuauugcgcggggcucaagaaagugaccgaaguuaagggauacacaaaaggcgguccugggcacgaggaacccauaccgauggcuacguacggauggaacuuagugaagcugcauuccggcaaagacgucuuuuucaucccaccugagaagugugauacccuucugugcgacauuggcgagucaagccccaauccaacuaucgaagaggggaggacacuacgggugcucaaaauggucgaacccuggcugcgcggaaaccaauuuuguauuaagaucuugaauccuuauaugccgucggugguugagacccuggagcagaugcagagaaagcacgguggcaugcucguaaggaacccccuuucucgaaauaguacucaugaaauguacuggguguccugcgggacaggaaacauugucagcgcagugaauaugaccucacggaugcuguuaaaccguuucacgauggcccacagaaaaccaaccuaugagcgcgauguugaccugggcgcugguacaaggcacguggccgucgaaccugagguggcaaacuuggauaucauagggcagcggauugaaaauaucaagcaugagcacaaauccacuuggcauuacgacgaggauaaccccuauaagaccugggccuaccacggaucuuaugaaguaaaaccuagcggcagugcuuccagcauggugaauggcguugucaagcuccugacaaagccaugggacgugauccccauggugacucaaauugcgaugaccgauacaaccccuuuugggcagcagagagucuucaaagagaagguugacacucgcacgccaaaagccaagaggggaacagcacaaauaauggaagugaccgcuaaauggcuaugggguuuucuuucucgaaacaagaagccccggaucuguacuagagaggaguucaccaggaaaguacgcucaaaugccgcaauuggcgccguguuugucgacgagaaccaguggaauagugcuaaggaggccguggaagaugagcguuucugggaccugguucaucgggaaagagagcuccacaaacaggggaagugcgcgacaugcguguacaacaugaugggaaaaagggaaaagaagcugggcgaguuugguaaagcaaaggggucccgcgccaucugguacaugugguugggagcucgauuccuggaguucgaagcccucggcuuuaugaaugaggaucacugguucagccgggaaaacucucuuucgggcgucgagggggagggacugcauaaauuagguuauauucugagagacaucucaaagauaccgggcgggaauauguacgcagaugacacggcuggaugggauaccaggaucacugaagacgauuugcagaacgaggccaaaauuacagacaucauggaaccugagcacgcucuccuggccaagagcauuuuuaaacuaaccuaucaaaauaaggugguacgcguucagagaccagcaaagaacggcacugugauggaugucaucucccggagggaccagcgugguaguggacaggugggaacauacggccuuaauaccuucacaaacauggaagcgcaacugauacgacagauggagucugagggcauuuuuagccccuccgaacucgagacuccuaaccuggccgggcgcguguuggauugguuagaaaaacauggagucgagagacugaagcggauggcuaucucaggugacgacuguguugugaaaccaaucgaugacagguucgccaccgcacucacggcucuuaaugauaugggcaagguacgcaaagacauuccccagugggaaccgaguaagggguggaacgauuggcagcaagugccuuuuugcucucaccacuuccaucagcugauaaugaaggacggaagagagaucgucgugcccugucggaaucaggaugagcuaguuggcagggcccgagugagccagggugcaggguggucccugcgugaaaccgccugccucggaaaaucauaugcgcaaauguggcaguugauguacuuucacagacgcgaccugcggcuugcugccaacgcaauuuguagcgccgucccaguggauuggguaccuacaucuaggacuaccugguccauccaugcucaccaucaguggaugacaacugaggacaugcugaguguuuggaauagaguguggauugaagagaaccccuggauggaagauaagacccacgucagcucguggggcgacgugccauaucucggcaaacgcgaggaccaauggugcggguccuuaaucggacugacggcccgggcaacaugggcuaccaauauacagguugccaucaaccaggugaggcgauugcuggguaaugagaacuaccucgauuacaugacuucuaugaagagauucaaaaaugaaucagaccccgagggcgcgcuuugguga

SEQ ID NO: 13848 - RNA, 9879 nt, Artificial Sequence
  derived and/or modified CDS sequence (opt3) from DENV-1__GQ199846__SS-prME
agcgugaccaugcugcucaugcuuaugcccacagcacuggcuuuccacuugacuacgagaggcggggagccucauaugaucgucaccaagcaggaaaggggaaaguccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccaucauggcaagggauaagcccacucuggacauugaacuacucaaaacagaggugaccaacccugccgugcugcggaaacuuugcaucgaagcuaaaauauccaauacgaccacagauucucgcuguccaacucaaggagaggccacccugauggaggaacaggacgcaaacuucgucugccgaagaacauuuguugauaggggcugggguaauggguguggauuguucggcaagggcagccucauuacuugcgcuaaauuuaagugcgugaccaagcuggaggggaaaaucguacaguacgaaaacuuaaaguauuccgugauugucacagugcacaccggagaccagcaucaaguugguaaugagucaacugaacacggcacgacagccaccaucacuccccaggcgccuaccagugagauccagcugacagacuacggggcccucacccuugauuguagcccacggacuggacuggacuucaacgaaaugguguugcuaacaaugaaagagaagucuuggcugguccauaaacagugguuucucgaucugccgcuucccuggacguccggcgcaucaaccagccaagagacuuggaaucgucaggaccuguuggugacauucaagaccgcucacgccaaaaagcaggaaguaguugugcucgguagucaagagggggcuaugcacacagcccugacuggcgcaaccgaaauucagacgucuggaaccacaacuauauuugccggccauuuaaagugccgccugaaaauggauaagcuaacccucaaagggauguccuaugucauguguacagggagcuucaagcuggagaaagaaguggcugagacucagcacgguaccguccuugugcagaucaaguacgagggcacggacgcgccuugcaagauuccauucucgacacaagaugaaaaagggguuacccagaacggaagauugaucacugcaaaucccauagugacagacaaggagaaaccuguaaacauugaagccgagccacccuuuggcgagucuuauaucgucaucggugcuggggaaaaggcccugaaacucuccugguucaagaagggcucaaguauuggaaaaauguuugaggcaaccgccaggggcgcucggcgaauggccauccugggggauacugcaugggacuucggaagcguggguggcguuuuuaccuccguggggaaacuuguccaucagauuuucggaacagcguacggcgugcuguuuucugguguaagcuggacgaugaaaauagggaucggcguguugcucaccuggcugggauuaaauucacgcaguacuucccugagcaugacauguauugcuguuggccuagucacccucuaccugggggugauggugcaggccgauucuggaugcgucaucaacuggaagggcagagaacuuaaaugugguucagggaucuucguuacaaaugaggugcacacuuggaccgaacaauauaaguuucaggcagacaguccgaagagguugagcgccgcuauuggaaaagccugggaggagggcgugugcgguauacgguccgcaacgcgccuggaaaacaucauguggaagcagauuucuaacgagcucaaucauauccuguuagaaaacgacaugaaauucacaguagucgugggcgauguuguggggauucuggcucagggaaagaaaaugaucagaccucaacccauggagcacaaguacucguggaaaagcuggggcaaggccaagauaaucggggcggacguccagaauaccacuuuuauuaucgauggaccaaacaccccugaaugucccgacgaucagagggccuggaauauuugggagguggaggacuauggcuucgguaucuuuacaacuaacauauggcuuaaauugcgugauuccuacacccagguuugcgaccaccggcucaugucagcugcaauuaaggauaguaaagccgugcaugcugacaugggguauuggaucgaaucugagaagaaugaaacauggaaacuggcccgagcauccuucauugagguaaagacguguaucuggccaaagucccacacccuauggucaaacggaguccuggaaagcgagaugauaauccccaaaauuuacggcgguccuaucucucaacauaauuauagaccaggcuacuucacucagacagcggggccguggcaccucggaaagcuggagcuugauuuugacuugugcgaaggcaccacugugguggucgaugagcacugcgggaacaggggacccucccugcgcacaaccacgguuacuggcaaaauuauccaugaaugguguugccggaguuguaccuuaccuccacucagauucaagggugaggacgggugcugguacggaauggagauaaggcccgugaaagaaaaggaggaaaaucugguaaagagcauggugucugccggcuccggugaggucgacucauuuagucuuggccuguuguguauuagcaucaugaucgaagaggugaugcgcucgcgauggucccggaaaaugcucaugacagggacccuggcuguuuuccuacugcucauuaugggacagcugacuuggaacgaucuuauccguuugugcauuauggugggcgccaaugcaucugacagaauggggaugggaacaaccuaucuggcuuuaauggccacauuuaagaugaggccuauguucgcagucggccuccuguuucgccggcuuacuagcagagaggugcugcuacucaccauaggucugucauugguugccaguguggaacugccaaacuccuuagaggaacucggggauggacuggcuaugggcaucaugauucuuaaacuguugacggacuuccaaucucaccagcucugggcgacacugcuaagccugaccuuuaucaagacuacccuuucccuccauuacgccuggaaaacaauggcaaugguccugucaauugcuagcuuguucccccuguguuuaaguacuaccucucagaagacgacauggcucccgguacugcuuggcucccuggggugcaagccuuugaccauguuucucaucacugagacaaaaauauggggaagaaagagcuggccacugaaugaagguaucauggccgugggcguugugucgauucuacugucaucucuucucaaaaacgaugucccccuggccgggccuuugaucgcuggaggcauguuaauugcauguuaugugaucagugguuccagcgccgaccugucucucgagaaggcggcugagguaagcugggaagaggaagccgagcacuccggggcaucacauaacauacugguggucguucaggaugacggaaccaugaaaauuaaggaugaggaacgagacgauacucuuacaauccuguugaaagccacccuacuggcugugaguggcguguacccccucagcaucccagcaacgcuguucgucugguauuuuuggcaaaagaagaaacagcgcucuggcgugcuuugggacacuccuucacccccagagguugaacgggccguauuagaugacgggauuuacagaauaaugcagaggggacugcucggucguagccaggugggcgucgggguguuccaagagaauguuuuccacaccauguggcacgugacacgcggagcggucuugauguaucagggcaagcggcuggaaccgaguugggcuagcgugaaaaaggaccucaucuccuacggugggggauggagacugcagggcucuuggaacaccggcgaggagguacaggucauugccguggaaccugggaaaaaucccaagaacguucaaacagcaccaggaacuuuuaagacccccgagggugaagugggcgccaucgcucuugauuucaaaccugggacgucgggaagcccaauugucaauagggagggcaagaucgugggucuguacgggaacggaguugugacaacuucaggcaccuaugucuccgccauagcacaggcuaaagccagucaggaaggccccuugccugagaucgaggacgaaguguuucgaaagcggaaucuaacaauuauggaucugcauccggggucuggaaaaacccgcagauaccucccagcgaucguaagggaggccauuaagcggaaguuacgaacucugauccuugcacccaccagagugguugcuagcgaaauggccgaggcucugaaagguaugccuauacgcuaucaaacaacggcagucaaguccgaacacacuggcaaagagauuguggaccucaugugccaugccaccuucacaaugagguugcugucaccagugcguguccccaacuacaauaugaucaucauggaugaggcccacuuuaccgacccuucuagcauugcugcgcggggguauaucaguacuagaguaggaaugggcgaagcagccgcuauauucaugacagccaccccgcccgguuccguggaggcauuuccacagagcaacgccguuauucaggaugaagagagggacaucccugaacgcucuuggaacucaggguacgaguggauuacggauuuccccggaaagacugugugguuugucccauccaucaaaaguggcaacgacauagcuaauugucuccgaaagaacggcaagagagugauucagcugagccggaaaacauucgauaccgaguaucaaaagaccaaaaauaacgacugggacuacguugugacuacagauaucucggaaaugggggcgaacuuuagggccgaccgcgucaucgauccucguagaugccuuaagcccgugauucuaaaagacggaccagagcggguaauccuggcagguccgaugccugugaccguugcuucugccgcacagaggcgcggccgaauugggagaaaucauaacaaggaaggagaucaguacauauauaugggccagcccuugaauaacgacgaggaucacgcccacuggacagaggcuaagauguuacuggacaauaucaacacuccagaagguauuauccccgcccucuucgagccugaacgggagaaauccgcggcaaucgauggggaauacaggcugcgcggcgaggccagaaagacguucgucgagcuuaugaggcggggagaccugccaguguggcucagcuauaaaguggcuucagaaggcuuucaauacagugaucgucgcuggugcuucgacggggagcgaaauaaccaggucuuggaagagaauauggauguugaaauuuggaccaaggagggagagaggaagaagcugaggccccgguggcuagacgcccgcacauauucugacccucuggcucucagagaauuuaaagaguucgcagccgguaggcgguccgugagcggcgaucuuauacuggaaaucgggaaguuaccgcagcauuugacucagcgagcucaaaacgcccuggacaaucucguaaugcugcacaacucagagcagggaggcagagcauaccgccaugcgauggaggaacuuccagauaccauugagacacugaugcucuuggcccugaucgcuguguuaaccgguggggucacucuauuuuuccugaguggcaggggacucggcaagacgagcauugggcuucugugugugauggccuccucuguuuugcuguggauggcaagcguggaaccccacuggaucgcugccuccauaauccucgaguuuuuccugaugguccuucucauuccugaacccgaccggcagcguaccccacaggauaaucaacuggcauauguagugaucggauugcuguuuaugauuuuaacaguugccgcuaacgagaugggucuacuggagacuaccaaaaaggaccucggcaucgggcacguggcggucgaaaaucaucaccaugccacaaugcuugauguggaccugcacccugcaucagcuuggaccuuguacgccgucgccacuacaauaauuacgcccaugaugagacauaccaucgagaacacuacagcaaacauuucucugaccgcuaucgccaaucaggcggcuauacucaugggacuggauaaaggcuggccaaucaguaagauggacauuggugugccucuuuuagcccuggggugcuacucgcagguuaacccgcucaccuugacagcagccgugcugaugcuaguagcucacuaugcaaucauuggccccggacugcaagccaaagcgacuagggaagcucagaagcgcacggccgcaggcaucaugaagaauccaaccguggaugggauagucgccauugaccucgauccuguuguguacgacgcuaaauucgagaagcagcuuggacagaucaugcuguugauccuguguacaagccaaauucuccugaugcggacuaccugggccuuaugcgaauccaucacacuugcaaccggcccccugacuacgcucugggaggguucuccagggaaauuuuggaacacaaccauagcugucucaauggccaauauuuuccgaggaagcuaucuagcgggcgccggucuggcauuuuccuugaugaagagucugggcgggggaagaaggggcacuggggcucagggagagacccucggcgaaaaauggaagcgccagcuuaaccagcugucuaagagcgaguucaauaucuacaaacggucagguauuauggaaguggacagauccgaggccaaggaaggguugaaacguggagagacaacuaggcacgcaguaagucggggcaccgcuaagcugcgcugguucguggagcgaaaccucguuaaaccugaagguaaggugaucgauuuaggcugugggagaggaggcuggagcuauuacugcgccgggcugaagaaagucacagaggugaagggauauacgaaaggcggucccgggcaugaggaaccgauaccaauggccaccuacggauggaaucuugucaagcugcacucuggcaaagacguguuuuucacuccucccgaaaagugugauacacuacucugcgacaucggcgaguccucaccaaaccccaccauugaggaagggaggacucugcggguuuugaaaaugguagagccuuggcugcgcggaaaucaauuuuguaucaagauucucaacccguacaugcccagcguggucgaaacacuugagcagaugcagagaaagcaugguggcaugcuggugaggaauccauuaucgcgaaacucuacccacgagauguauuggguuaguugcgggacgggaaauaucguguccgcggucaacaugaccagccggaugcuguugaaucguuucacaauggcucacagaaaaccuacuuacgaacgcgauguggaccucggcgcagguaccaggcauguagccguggagcccgaaguugcuaaccuggauauuaucgggcagcggauagagaacauuaagcacgaacauaaaucaacauggcacuaugacgaggauaauccuuacaagacuugggccuaucauggauccuacgaggucaaaccaucuggcagcgcaaguuccauggugaacggcguggucaagcuacuuaccaagcccugggacguuaucccuauggugacacaaaucgccaugaccgauacuacgccauuugggcagcagagaguauucaaagaaaagguggacacacgcacccccaaagcuaagaggggaacugcgcaaauuauggaggucaccgcccgauggcugugggguuuucucagccggaauaaaaagccgagaauauguacaagggaagaguucacgcgcaaggugcguucuaacgcagcuaucggcgccguuuuuguggacgaaaaucaguggaacucagcaaaagaggccgucgaggaugaacgguucugggaccuggugcagaaggagagagaauugcacaaacaggggaagugcgcuaccugcguauauaauaugaugggaaaaagggagaagaagcugggcgaauuugguaaagccaaggggagucgcgcgauuugguacauguggcucggagcacgauuccuugaguuugaggcccugggcuucaugaacgaagaucacugguucucccgggagaauagcuuaucuggcguugaaggggagggacugcauaaauuggguuacauccucagagacauuucgaagaucccuggcgggaacauguaugcugaugacacugccggaugggauacaaggauaaccgaggacgaucugcaaaaugaagcaaaaaucacugacauuauggagccagaacacgcucuacuugccacaucaaucuuuaagcugaccuaccagaacaaagugguccgcgugcagagacccgcuaagaauggcacagugauggaugucauuagccggagggaccagcgugguuccgggcaaguuggaacuuauggccucaacaccuucacgaauauggaggcccagcugauccgacagauggaaagugagggcauauuuuugccuucugaguuagaaaccccaaaccuggcagagcgcgugcucgauuggcuugaaaaguacgggguagagagacugaaacggauggcgauuagcggagacgacuguguggucaagcccaucgaugacagguucgccacagcucuaacugcccugaacgauauggguaaagugcgcaaggacaucccgcagugggaaccuuccaaaggcuggaaugauuggcaacagguucccuuuugcucacaucacuuccaccagcucauuaugaaggacgggagagagauaguggucccaugucggaaccaggaugaguuggugggaagggcacgaguaagucaaggcgcugguuggucucugcgugaaaccgccugccuuggaaagagcuaugcacagauguggcagcugauguacuuucauagacgcgaccuccgguuagccgcgaaugcuaucuguuccgccguuccuguggauuggguccccacaucaaggacuaccuggagcauucacgcacaucaccaauggaugacgacagaggacaugcugucuguguggaacagaguuuggaucgaagagaauccauggauggaagauaaaacccauguguccaguuggggagacguccccuauuugggcaagcgcgaggaccaguggugcggcagccugauugggcucacugcccgggcuacaugggccucgaacauccagguggcaauaaaucagguaaggcgacuuaucggaaacgagaauuaccuggauuacaugaccuccaugaaaagauucaagaacgaaggugacccugagggcgcucuaugguga

SEQ ID NO: 13849 - RNA, 9879 nt, Artificial Sequence
  derived and/or modified CDS sequence (opt3) from DENV-1__GQ199847__SS-prME
uccgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucugcucugcucaagaacgaugugccccuggcagggccucuuauugccggaggcaugcucaucgcguguuacgucauaagugguuccagcgcugaccugucuuuggagaaggccgcagaggugagcugggaagaggaagccgagcauuccggggcuucacacaauauuuuaguagaagugcaggaugacggaacuaugaaaaucaaggaugaggagagggacgauacacugaccauccuccugaaggcaacucuucuggccgucaguggcguuuaucccuugagcauuccagcgacacuauucgugugguacuuuuggcagaaaaagaaacaacgaucuggcgugcugugggacaccccuucacccccagaagucgagcgcgcugugcucgaugacgggauauaucggaucaugcagagaggacugcuugguaggagccagguuggcguagggguguuccaggaaaacgucuuucauacgauguggcacgugacucguggagccguuuuaauguaccaaggcaagcgccuggagccgaguugggcaagcgugaaaaaggaccucauuuccuacggugggggauggcgguugcagggcucuuggaauaccggcgaggaaguccaggugaucgccguagagccugggaagaaccccaaaaauguccagacagcuccaggaaccuucaagacaucggaaggugaggugggcgccauugcacuggauuuuaaacccgggacuagcggaucaccuaucguuaacagagaaggcaagauagugggucucuaugggaauggagucgugaccacguccggcacauacguuagugcuaucgcccaagcgaaagccucucaggagggcccacugcccgagauugaagacgagguguucaggaagcgaaaccuuacuaucauggaucugcacccugggagcggaaagacccggcgcuauuugccggcaauugucagagaagcuaucaaaaggaagcuacggacacugauacucgccccaacccgagugguagcuuccgagauggcagaagccuuaaaagguaugcccauuagauaccagacuaccgccgugaagucagagcauacaggcaaagagaucguugaccugaugugccacgcuacguuuacuaugcgccuucugucuccugucagggugccaaauuauaacaugaucauuauggaugaagcgcauuucaccgaccccagcaguaucgcagcccguggguacauauccacacgggugggaaugggcgaggcugccgcaauuuuuaugaccgccacuccuccggguagcgucgaggcuuucccccaaucuaaugcgguaauccaggaugaggaaagagacauuccagagaggucauggaacuccggguaugaguggaucacagauuuuccuggaaagaccgugugguucguucccaguauaaagagcggcaaugacauugccaacugucuccgcaaaaauggcaagcgagugauccaguugucgagaaaaacguucgauacugaauaccagaagaccaaaaacaacgacugggacuacgucgugaccaccgauaucucugagaugggggcaaauuuucgggcugacaggguuauugauccacgccguugccugaagccugugauccucaaggacggacccgaaagagucauucuggccgguccaaugccggugacuguagcauccgccgcucaacggaggggccgcauagggcgaaaccacaauaaagagggagaucaguauaucuacaugggccagccucuuaacaaugacgaggaucaugcccacuggacagaagcgaagaugcuacuggacaacauuaauacccccgaggguaucaucccagcauuguucgaacccgagagagagaaaagcgccgcuauugauggggaguaucgguuaaggggcgaggcccgcaagacauuuguggaacugaugagaaggggagaccucccuguuuggcugucauacaaagucgcuagugagggcuuccaguauucugaucggcguuggugcuuugacggggaacgcaacaaucaagugcuugaggaaaacauggauguggagauauggacuaaggagggagaaaggaaaaagcugagaccaagauggcucgacgcacggacguacuccgaccccuuggcccugcgcgaguucaaggaauuugcugccgguagaaggagcgucucaggcgaucuaauccuggagauugggaaacucccucagcaccuuacccagcgggcacagaaugcgcuggacaacuuaguuauguugcauaauagugaacaaggaggccgagccuauagacacgcuauggaggagcugccggauacaaucgaaacucucaugcugcuugcccugauugcagugcucaccggugggguaacauuguucuuucugagcggccgcggauuaggcaagaccuccaucgggcuacugugugugauggcuucuagcguccuccuuuggauggccuccguggagccacauuggauagcagccucaaucauucuggaguucuuuuugaugguucugcucauccccgagccugacaggcagcggacuccccaggauaaccagcuggcuuacguggucauuggacuucucuucaugauccugacgguagcggccaaugagauggguuugcuggaaaccaccaaaaaggacuuaggcauagggcacguggcaguugagaaccaccaucacgcugccaugcuagauguggaccugcauccagccucugcauggacucucuacgcugucgccaccacaauuaucaccccuaugaugcgucacacuauugaaaacacaacggcgaauaucagucuuaccgcuauagccaaccaagcagccauccugaugggauuggauaaaggcuggcccauuucgaagauggacaucggugugccacugcucgcucuggggugcuauagccaggucaauccucuuacuuuaacagcagccgugcugaugcucguugcgcauuacgcuauuaucggcccgggauugcaggccaaggcaaccagagaggcccagaaaaggaccgcugccggcauaaugaagaaccccacaguggaugggauuguagcaaucgaccuggauccaguggucuaugacgcuaaauuugaaaagcagcuaggacagaucaugcugcucauucuuuguacuucccagauccuguugaugcgcacgaccugggcccugugcgagucuauaacacucgcgacuggcccucugaccacauuaugggaggguucacccgggaaauucuggaauaccacuauugccguuagcauggcaaacaucuuccggggauccuaccuugcuggcgccggucuggcauuuagucucaugaagucucuaggcgggggacgaagaggcacgggggcucaaggagaaacacugggcgagaaguggaaaaggcaguugaaucagcugagcaagucagaguucaacaccuauaaacgcuccgguauuauggagguggaccggagugaagccaaggaggggcucaaaagaggagagacuaccaagcacgccgucagccguggcacagcgaaacuuaggugguuuguggaacggaaucugguaaaaccagaggguaaggugaucgauuugggcugugggcgcggaggcuggucuuacuauugcgcugggcugaaaaagguuacugaagugaaaggauacaccaagggcgguccugggcacgaggaacccauaccgauggcaacauacggauggaaccucgucaaauuacauuccggcaaggacguguucuuuaucccaccugagaagugugauacgcugcuuugcgacauuggcgagucaagccccaauccaaccaucgaagaggggcgaacucugagaguccuaaaaaugguggaacccuggcucaggggaaaccaguucuguauuaagauccugaauccuuauaugccgucgguuguagagacauuggagcaaaugcagcggaaacacgguggcaugcuggugcgcaacccccucucuagaaauaguacccaugaaauguacugggucuccugcgggacuggaaacauugugagcgccguuaauaugacaucaaggaugcuucugaaccgauuuaccauggcucaccggaagccaacguaugagcgugauguggacuuaggcgccgguaccagacacgucgcaguggaaccugagguagccaaccuggauaucauagggcagcgcauugaaaauaucaaacaugagcacaaguccacauggcauuacgacgaggauaaccccuauaagacuugggcuuaccacggaucuuaugaagugaaaccuagcggcagugcguccagcaugguuaauggcgucgugaaguugcucaccaaaccaugggacgugauccccauggucacacagauugccaugacugauaccacaccuuucgggcaacagaggguuuuuaaggagaaaguggacacccggacuccaaaggcaaagagaggaacggcucagauaauggaaguaacagccaaauggcugugggguuuccuaucucgcaacaagaaacccaggaucuguacccgagaggaauuuacucggaaggugagaucaaaugcagccauuggcgcugucuucguggacgagaaccaauggaauagugccaaagaggcgguugaagaugagagguuuugggaccuugugcaucgcgaacgugagcugcacaagcaggggaagugcgcaaccugcgucuacaacaugaugggaaaacgggaaaagaaacucggcgaguucgguaaggccaaaggguccagagcuaucugguacauguggcugggagccagguucuuggaguuugaagcacugggcuucaugaaugaggaucacugguuuagccgcgaaaacucucucucgggcguggagggggagggacuucauaagcuggguuauauuuuacgagacaucucaaaaauaccgggcgggaauauguacgcugaugacacagccggaugggauacgcggaucaccgaagacgaucugcagaacgaggcuaagauuacugacaucauggaaccugagcacgccuugcucgcaaagagcauuuucaaacugacauaucagaauaagguaguuagagugcaaaggccagcgaaaaacggcaccgucauggaugugaucucccgcagagaccagcgggguaguggacaggugggaacuuacggccuaaauacauuuaccaacauggaagcccagcuuauaaggcaaauggagucugagggcauuuucagccccuccgaacuggagacaccuaaccucgcugggcguguccuggauugguuggaaaagcauggaguugagcgauuaaaacgcauggccaucucaggugacgacugugugguaaagccaaucgaugacagauuugcaacugcucugaccgcccucaaugauaugggcaaggugcggaaagacauuccccagugggaaccgaguaagggguggaacgauuggcagcaggucccuuucugcucucaccacuuucaucaacuuauaaugaaagacggaagggagaucgugguucccugucgcaaucaggaugagcuggugggcagagcacgggucagccagggugccggguggucccuaagggaaacggcgugccugggaaagucauaugcucagauguggcaacucauguacuuccaccgacgugacuugagacuggccgcaaacgccauuuguagcgcugauccagacgauugggugccuaccucucgcacaacuugguccauccaugcccaccaucaguggaugaccacagaggacaugcuuaguguauggaaucggguuuggauugaagagaaccccuggauggaagacaaaacucacaucagcucguggggcgaugugccauaucugggcaagagggaggaccaguggugcgggucccucauaggauuaaccgcaagagcuacgugggccacaaauauccaagucgcgauuaaccaggugcgccggcugaucgguaaugagaacuacuuggauuacaugaccucuaugaagagguuuaaaaaugaaucagaccccgagggcgcucugugguga

SEQ ID NO: 13850 - RNA, 9879 nt, Artificial Sequence
  derived and/or modified CDS sequence (opt3) from DENV-1__GQ199849__SS-prME
agcgugaccaugcugcucaugcuuaugcccaccgcccuggcuuuccacuugacuacgcggggaggggaaccucauaugaucgucaccaagcaggaaaggggaaaauccuuacuguuuaagacaucugcggguguuaacaugugcacucugauugccauggaccucggagagcugugugaagauaccaugacauacaaaugcccacggauaaccgaggcggaaccggacgauguggacuguuggugcaaugcuacugauacauggguaaccuaugggacguguucacgcacuggagagcaccgacgugacaagagaaguguggcccuugcaccccaugucggccuggguuuggagaccaggacagaaacuuggaugagcuccgagggggccuggaaacaaauccagcggguggaaaccugggcucuccgccacccuggauucacaguuauugcacuguuucuggcccaugcuaucggcaccucuauuacgcagaagggcaucauauucauccucuuaaugcuggugacuccaucgauggccaugagaugcgucgggauuggaucaagggauuuuguggagggucuuagcggcgcgacauggguagacguuguguuggagcacgggaguugugucaccacuauggcaaaggauaaacccacacuggacaucgaacuacucaagaccgaggugacgaacccugccgugcugcggaaacuuugcauugaagcuaagaucuccaauaccacaacugauucucgcuguccaacccagggagaggccacacugauggaagaacaagacgcaaacuucgucugccgaagaacuuuuguugauaggggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucagguugguaaugagucaacggaacacggcacaaccgccacuauuacaccccaagcgccuacaagugagauccagcugaccgacuacggggcccucacucuugauuguagcccacggacaggacuggacuucaacgaaaugguguugcuaacgaugaaggagaaaucuuggcugguccauaagcagugguuucucgaucugccgcuucccuggaccuccggcgcaucaacuagccaggagacauggaaucgucaagaccuguuggugaccuucaaaacagcucacgccaagaagcaggaaguaguugugcucgguagucaggagggggcuaugcacacugcccugaccggcgcaacggaaauccaaaccucuggaacaacuaccauuuuugccggccauuuaaaaugccgccugaagauggauaaacuagcucucaaggggauguccuaugucauguguacagguagcuucaaacuggagaaggaaguggcggagacucagcacggaaccguccuugugcagauaaaguacgagggcacggacgcaccuugcaaaaucccauucucgacacaggaugaaaaggggguuacccaaaacggaagauugauuacugccaaucccaucgugacagacaaagagaagccuguaaacauagaagcugagccacccuuuggcgagucuuauauugucaucggugccggggaaaaagcacugaagcucuccugguucaagaaaggcucaaguaucggaaagauguuugaggccaccgcuaggggcgcccggcgaauggcaauucugggggauacugcgugggacuucggaagcaucgguggcguguuuaccuccguugggaaacuugugcaucagauuuucggaacagcuuacggcguccuguuuucuggugugagcuggacgaugaagauagggaucggcguauugcucaccuggcugggauuaaauucacgcaguacuucccugagcaugacauguauugccgugggccuaguuacccucuaccugggggucauggugcaggcagauucuggaugcgugaucaacuggaaaggcagagaacuuaagugugguucagggaucuucgucacaaaugagguucacacuuggaccgaacaguauaaguuucaagccgacaguccgaaaagguugagcgcugccauuggaaaggcaugggaggagggcgugugcgguauacgguccgcuacgcgccuggaaaacaucauguggaaacagauuucuaacgagcucaaucauauccuguuagaaaacggccugaaguucacagugguagucggggacgugguuggcauucuugcccagggcaaaaagaugaucagaccucagcccauggagcacaaauacucguggaaaagcugggggaaggcgaagauaaucggagccgaugugcaaaauaccacuuuuauuaucgacggcccaaacaccccugaaugucccgaugaccagagggcuuggaauauuugggaggucgaggauuaugguuucgggaucuuuacaacuaacauaugguugaagcuccgugacuccuacacccaggugugcgaucaccggcugaugucagcagccauuaaagacaguaaggcuguucaugccgauaugggauauuggaucgaaucugagcgaaaugaaacauggaaacuagcaagagcgagcuucauugaggugaagacguguaucuggccaaagucccacacccuguggucaaacggcguacucgaaagcgagaugauaauccccaaaauuuacgguggcccuaucucucagcauaauuauaggccaggguacuucacucaaacagccggaccguggcaccugggcaaacuugaguuggacuuugaucugugcgaagggaccacugucgugguggacgagcacugcggaaaccgcggccccuccuuacggacaaccacggucacugguaaaauuauccaugaaugguguugcagaaguuguacccucccuccacugagguucaagggggaggauggaugcugguacggcauggagauacgccccguuaaagaaaaggaggaaaaucuugugaaguccaugguaucugcugguuccggcgagguggacucauuuagucugggguugcucuguacaagcauuaugaucgaagaggucaugcgaucgcgguggucccguaaaaugcugaugaccggaacucuagccguguuccugcuccugaucaugggccagcuuacauggaacgacuugauuagacugugcaucaugguuggggcaaaugcuucugauaggaugggaaugggcaccacauauuuagcccucauggcaacuuuuaagaugcgcccuauguucgccgugggucugcuuuuucggagacugaccagcagggagguccuacuccugacgauuggguugucacugguggcuaguguugaauuaccaaacucccucgaggaacugggagacggccuugcgaugggcauaaugauccugaaauugcucacagauuuccagucucaccaacugugggccacccuacugagccuuacuuuuauuaagaccacacucucccugcauuacgcauggaaaacuauggcuaugguguugucaaucgucagccuguuccccuuaugucucaguaccacgucucagaagacaaccuggcugccgguacuucugggguccuugggaugcaagccucucacuauguuucugauugccgagaauaaaaucuggggucgaaagagcuggccacuaaacgaaggcauaauggccguggggguugugucgauccugcuuucaucucuccugaaaaacgacguccccuuggcuggaccuuuaauugcaggcgguaugcugaucgccuguuaugugauuaguggguccagcgcggaucucucucuggagaaggcugccgagguaagcugggaagaggaagcagagcacuccggagccucacauaauaucuucguggaaguccaggacgauggcacaaugaaaauaaaggacgaggagcgcgaugacacccuuacuauucuguugaaagcuacacuacuggcaguuaguggcguguacccccucagcaucccagccacccuguuugugugguauuucuggcagaagaagaaacaacggucugggguccuuugggauacgccuucacccccagaaguggagagagcggcuuuagacgauggaaucuacaggauuaugcagcguggucugcucggccgcagccagguugggguaggaguguuccaggaaaacgucuuucacacuauguggcacgugacccggggcgccguuuugauguaucaagguaagagacuggagccgaguugggcaagcgugaaaaaggaccucauauccuacgggggaggcuggaggcugcagggcucuuggaauacaggggaggaaguccaggugaucgccguagagccuggcaagaaucccaagaauguccagaccgcuccagguacauucaagacucccgaaggcgaggugggggccauugcacuugacuuuaaaccuggaaccucgggcagcccaaucguuaaccgagaagguaagauuguggggcuguacggaaauggcgucgugacgacaucaggcacuuauguuuccgcuaucgcccaaaccaaagcgagucaggaggggcccuugccugagauagaagaugagguguuccggaagcgcaaccuaacaaucauggaccugcauccgggaucugguaaaaccagaagguaccucccagccauuguccgggaagcaaucaagcgaaaguuaagaacucugauucuugcucccacccgcgugguagccagcgagauggcugaagcacugaaaggcaugccuaucagguaucagacaacggccgugaaguccgagcacacugggaaagagauaguugaucucaugugccaugccaccuuuacaaugcguuugcugucaccaguccgggugcccaauuacaacaugauuaucauggacgaagcucacuucaccgauccuucuagcaucgcggcaagaggauauauuaguacuagggugggcaugggugaggccgcugccaucuuuaugacagcaaccccgcccggguccgucgaagccuucccacaaagcaaugcuguaauacaggacgaggaacgcgauauuccugagcgaucuuggaacucaggauacgaguggaucacggacuuucccggcaagacugugugguucguuccauccauuaaaaguggcaaugauaucgcgaacugucucagaaagaaugggaagcgggugauacagcugagcaggaaaacauuugacaccgaauaucagaagaccaaaaacaacgauugggacuacgucgugacuacagacauuucggagaugggagccaauuuccgcgcagaucguguuaucgacccuagacggugccuuaagcccgugauccuaaaagaugguccagaaagggucauucuggcuggcccgaugccugugaccguagccucugcagcccaacgccgagggagaaucggacggaaccauaauaaggagggcgaccaguacauuuauaugggucagcccuugaacaaugaugaggaccacgcucacuggacagaagccaagauguuacuggauaacauaaauacuccagaggggaucauucccgcacucuucgaaccugagagggaaaaauccgcagccaucgacggcgaguaccgccugagaggagaggcuaggaagacguuuguggaacuuaugcggcguggcgaucugccaguuuggcucagcuauaaagucgccucagagggguuccaguacagugaccgccgauggugcuuugauggagaaagaaacaaucaaguguuggaggaaaacauggacguggagaucuggaccaaggagggugaaaggaaaaagcugcggccccgcuggcuagaugcuagaacauauucugacccucuggcacucagggaguucaaagaauuugccgcuggccggcgauccgucagcggggaccuuauucuggagauaggaaaguuaccgcagcauuugacucagagagcccagaaugcacuggauaaccucguuaugcugcacaauucagaacaaggcggucgcgcguacaggcaugccauggaggagcuuccagacaccaucgaaacacugaugcucuuggcucugauugccguguuaaccgggggcguaacucuauucuuucugaguggacggggccucgggaagacgagcaucggacuucugugugugauggcauccucugucuugcuguggauggcuagcguggagccccacuggauugccgcauccaucauacucgaguucuuucugaugguucuucucaucccugagcccgaucgucagagaaccccacaggacaaccagcuggccuauguggucauugguuugcuguucaucauuuuaacaguagcugcgaaugagaugggccuacuggaaacuaccaaaaaggaucucgggaucggacacguggccguugagaaccaucaccaugcaacaaugcuugacguggaucugcacccugcuucagccuggaccuuguacgccgucgcaacuacaauaauuacgcccaugaugaggcauaccaucgaaaacacuacagcuaauauuucucugaccgccaucgcgaaccaagcugccauacucaugggccuggacaaagguuggccaaucaguaagauggauauuggggugccucuuuuagcacugggcugcuacucgcaggucaauccgcucaccuugacagccgcugugcugaugcuaguugcacacuaugccaucauuggacccggccugcaggcgaaagcuacucgcgaggcccaaaagcggacggcagccgggaucaugaagaacccaaccguggacggaauaguagcuauugaucucgacccuguggucuacgaugccaaauuugaaaagcagcuuggccagaucaugcuguugauccuguguacaagccagauucuccugaugcgaacuaccugggcauuaugcgaguccaucacacuugcuaccgguccccugacuacgcucugggaggggucuccaggaaaauucuggaauacaaccauagccguuucaauggcgaacauuuuuagaggcagcuaucuagccggugcaggccuggcuuucuccuugaugaagagucuagggggaggcaggcgcgggacuggagcccaaggcgaaacccucggugagaaauggaagcggcagcuuaaucagcugucuaagagcgaguucaacaucuacaaaagaucagggauuauggagguggaccguuccgaagcaaaggagggauugaaaaggggcgagacaacucggcacgcugucagucgcgguaccgccaagcugcgaugguuuguggaaagaaaucucguaaaaccugagggcaaggugaucgacuuaggguguggaaggggcggguggagcuauuacugcgccggacugaagaaaguuacagaagugaagggcuauacgaaaggugggcccggacaugaggaaccgauaccaauggcgaccuacggcuggaaccuugucaagcugcacucuggcaaagauguguucuuuacuccucccgagaagugugacacacuacucugcgauaucggggaguccucaccaaaucccaccauugaagagggacggacucugcgcgucuugaaaaugguggaaccuuggcugagagguaaccaguucuguaucaagauucucaauccguacaugcccagcguuguagagacacuugagcaaaugcagaggaagcauggcgggaugcuggugcgaaacccauuaucgagaaauucuacccacgaaauguauugggucaguugcggaacgggcaacaucguguccgcuguuaauaugaccagccguaugcuguugaacagauuuacaauggcacaccgcaaaccuacuuacgagagggacguggaucucggugccgggacccggcaugucgcuguggaacccgagguagccaaccuggacauuaucggacagagaauagaaaauauuaagcacgagcauaaaucaacauggcacuaugaugaggacaacccuuacaagacuugggcauaucauggcuccuacgaagugaaaccaucuggcagcgccaguuccaugguuaauggggucgugaagcuacuuaccaagcccugggaugugaucccuauggucacacagaucgcuaugaccgacacuacgccauucggacaacagcgcguuuuuaaagagaagguggauacaaggacccccaaagcgaagcgagguacugcccagauuauggaaguaaccgcacgguggcuguggggcuuccucagcagaaacaaaaagccgaggauauguacacgcgaggaauuuacgcguaaggugcggucuaaugcugccaucggggcagucuucguggacgagaaccaauggaacucagccaaagaggcuguugaagacgagagauuuugggaucuggugcagaaggaaagggaguugcacaaacagggaaagugcgcgaccugcgucuauaacaugaugggcaaacgcgaaaagaagcugggugaguucgggaaagccaagggaagucgagcaauuugguacauguggcucggcgcccgguuucuugaguucgaagcucugggcuucaugaaugaggaccacugguuuuccagagaaaacagcuuaucugggguggagggagagggucugcauaaauugggcuacauccucagggauauuucgaagaucccugggggaaauauguaugccgacgauacugcaggcugggacacacgcauaaccgaagaugaccugcagaacgaggcuaaaaucacugauauuauggaaccagagcacgcccuacuugcuacaucaaucuucaagcugaccuaccaaaauaaaguaguuagagugcagcggcccgccaagaacgguacagucauggacgugauuagcaggcgugaucagcgaggguccggacaggugggcacuuauggccucaauaccuuuacgaacauggaagcacaacugauccgccagauggagagugaggggauauucuugccuucugaauuagagaccccaaaccuggcggaaagaguccucgacuggcuugagaaguacggaguugaacggcugaaaaggauggccauuagcggugaugacugugugguaaagcccaucgacgaucgcuuugcuacagcccuaacugcacugaaugacaugggcaaagugagaaaggauaucccgcagugggagccuuccaaaggguggaacgacuggcagcaaguccccuucugcucacaucacuuucaccagcucauuaugaaggauggacgggagauagugguuccauguaggaaucaggacgaauuggugggccgagcucgugucagucagggugccggguggucucugagagagaccgcaugccuuggaaagagcuaugcccaaauguggcagcugauguacuuccaucgccgggaucucagguuagcggcuaacgccaucuguuccgcagugccuguagacuggguucccacaucaagaacuaccuggagcauucacgcccaucaccaguggaugacgacagaagauaugcugucuguguggaaucgcgucuggaucgaggaaaacccauggauggaggacaaaacccauguguccaguuggggcgauguucccuauuugggcaagcgggaggaccaauggugcgggagccugauuggacucacugcuagggccacaugggcaucgaauauccagguggcuauaaaccagguccgaagacuuaucgguaaugaaaacuaccuggacuacaugaccuccaugaaacgguuuaagaaugagggcgauccugaaggggcccuaugguga

SEQ ID NO: 13851 - RNA, 9879 nt, Artificial Sequence
  derived and/or modified CDS sequence (opt3) from DENV-1__FJ898410__SS-prME
agcgugaccaugcugcucaugcuuacccccacugcacuggcuuuccacuugacgaccagaggaggggaaccucauaugaucgucuccaagcaggaaagggggaaaucuuuacuguuuaagacaucagccgguguuaauaugugcacucuaauugccauggaccucggcgaguucugugaagauaccaugacauacaaaugcccacggauaaccgaggcggaaccggacgauguggacuguuggugcaaugcuacugauacauggguaaccuaugggacguguagucaaacuggagagcaccgccgagacaagcguagcguggcccuggcaccccaugucggccuuggucuggagaccagaacagaaacuuggauguccucugagggggccuggaaacagauccagaggguggaaaccugggcuuugcggcacccuggauuuacaguuauugcacucuuccuggcccaugcuaucggcaccucgauuacgcagaagggcaucauauuuauccugcucauguuagugacuccaucaauggccaugcgcugcgucgggauuggaagcagagauuucguggagggucugaguggcgcgacauggguagacguugugcuugagcacggguccugugucaccacuauggcaaaggauaaacccacauuggacaucgaacugcuaaagaccgaggugacgaacccugccgugcucaggaaacugugcauugaagcuaagaucucuaauaccacaacugauagccgguguccaacccaaggagaggccacacuugucgaagaacaagacgcaaacuuuguuugccgccgaacuuucguggauagaggcugggguaauggguguggacuguuuggcaaaggcuccuugauaaccugcgcuaaguucaagugcguaacaaaacucgaggggaagauugugcaguacgaaaaccugaaauauucagucaucgugaccguucacacuggagaccagcaucaaguggguaaugagaguacggaacacggcacaaccgccacuauuacaccccaggcgccuagcacagagauccaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggcaggaccuucugguaaccuuuaaaacagcucacgccaagaagcaggaaguuguggucuuggguucucaagagggggcuaugcacacugcccucaccggcgcaacggaaauccagaccuccggaacaacuaccauuuucgccggccaucugaaaugccguuuaaagauggauaaacugacacuaaaggggaugagcuaugugauguguacuggaucguucaaacucgagaaggaagucgcugagacccagcacgguacggugcugguucagauaaaguacgagggcacagacgcgccuugcaaaaucccauuuucuacccaagaugaaaagggggugacucagaacggacgccuuauuacagcaaaucccaucguaaccgacaaagagaagccugucaacauagaagccgagccacccuucggcgaguccuauauugugaucggugcuggggaaaaagccuugaagcugucaugguuuaagaaaggcaguagcaucggaaagauguucgaggcaacugccagaggcgcuaggcggauggccauucucggggauaccgcaugggacuuuggauccaucgguggcguuuucacaucuguggggaaacugguccaucagauuuuuggaacggcguacggcgugcuuuucagcgguguaucauggaccaugaagauagggaucggcgugcuguugacuuggcucggacugaauagucgauccacuagcuuaucuaugaccuguauugcuguuggccuggucacacuauaccucggggugauggugcaggccgauucaggaugcgucaucaacuggaaaggccgcgaacugaagugugguagugggaucuuuguuacuaaugaggugcacaccuggacggaacaauauaaguuccaggcagacagcccgaaaagacuuuccgccgcuauuggaaaggccugggaggagggcgugugcgguauaaggucugcaacacgguuggaaaacaucauguggaaacagauuucgaacgagcugaaucauauccuccuggaaaacgacaugaaguuaaccguagucgugggcgauguugcugggauucuggcccagggcaagaagaugauccgcccucaacccauggaguacaaauauagcuggaagauauggggcaaggcgaaaaucauuggggccgacgugcagaauacuaccuuuaucauugauggaccaaacacaccugaaugucccgacgaucagagagcuuggaauaucugggaggucgaggacuacggcuucgguauauuuacuaccaacauuuggcuuaaguugagggauuccuauacacaggugugcgaccaccgucucaugucagcagccaucaaagauaguaaggcuguucacgccgacaugggguacuggauugaaucugagaaaaaugaaacguggaagcuggcacgggcgagcuucaucgaggugaagaccuguauauggccaaaaucccauacucuauggucaaacggaguacuggaaagcgagaugaucauucccaagaucuauggcgguccuauuucucaacacaauuaccgaccaggcuacuucacacagaccgccgggccguggcaucucggaaaacuggagcuugauuuugacuugugcgaaggcacuacagucgugguggaugagcacugcgggaacagaggacccucccugaggaccacgacugucaccggcaagaucauacacgaaugguguugccgcaguuguacauuaccuccacuccgguucaaaggugaggacgggugcugguauggaauggagauuagacccguuaaggaaaaggaggaaaaucuggugaaaagcaugguaucugcuggcuccggugagguggacucauuuagucuuggccuguuguguaucagcaucaugauugaagaggucaugaggucgcgcuggucccgaaagaugcucaugaccgggacucuggccguguucuuucuacugaucaugggacagcucacauggaacgaucugauucggcuuugcauaaugguuggcgcaaaugcuucugaccguauggggaugggaaccacauacuuggcccugauggcaacuuucaaaaugagaccuauguuugccgugggcuuacucuucaggcgccugaccagccgggagguccuucugcuaacgaucggucucucacugguggcuaguguugaauugccaaacucccuggaggaauuaggggauggacucgcgaugggcauuaugauccugaaacuucugacagacuuucaaucucaucaguugugggccacccuccugagccuaacuuucauuagaaccacauuuucccugcacuaugcauggaaaacuauggcuauggugcuuucaaucgucagccucuucccccuguguuugaguaccacgucucagaagacaaccuggcugccgguauuacucggcucccuggggugcaagccucuuacuauguuucugauagccgagaauaaaaucuggggaagaaaguccuggccauugaacgaagguauuauggccgugggcaucguuucgauucuccugucaucucuacugaaaaacgaugugccccuugcugggccucucaucgcaggaggcaugcugauagccuguuacgucauuagugguuccagcgcggacuugucuuuagagaaggcugccgaggugagcugggaagaggaagcagagcauuccggggccucacacaauauccugguagaagugcaggaugacggaacaaugaaaaucaaggaugaggagcgagacgauacccucacuauucugcuuaaagcuacacuguuggcagucaguggcguuuauccccuaagcauaccagccacccuguucgugugguacuucuggcaaaagaagaaacagcgcucuggcgugcucugggacacgccuucacccccagaagucgagcgggcggugcuggaugacgggaucuauagaauuaugcagaggggacuuuuaggucguagccagguuggcguagggguguuucaagaaaacgucuuccauacuauguggcacgugacccgcggagcuguucugauguaccagggcaagcggcucgagccgaguugggccagcgugaaaaaggacuugaucuccuacggugggggauggagacugcagggcucuuggaauacaggcgaggaaguccaggugauugcaguagagccugggaaaaaccccaagaauguccaaaccgccccaggaacauuuaagacuucggaaggugaggugggcgcuaucgcccucgauuucaaacccgggaccagcggaucaccuauaguuaacagggaaggcaagaucgugggucuguaugggaauggagucgugacgacauccggcacuuacguuagugcaauugcucaggccaaagcgucucaggagggcccacuucccgagaucgaagacgagguguuucgaaagcggaaccugaccauuauggauuugcacccugggagcggaaaaacacgcagauaucuaccggccaucgucagggaagcaauaaagcggcgacugagaacccucauuuuagcuccaacucgcgugguagccuccgagauggcugaagcacugaaggguaugcccaucagguaccaaaccacagccgugaaaucagagcauacgggcaaggagaucguugaccuuaugugccacgccacuuucaccaugcgucugcucucuccuguccgggugccaaauuauaacaugauuaucauggaugaagcucauuuuacagaccccagcaguauagcggcaagaggguacauuuccaccagggugggaaugggcgaggccgcugccaucuucaugacugcaacaccuccggguagcgucgaagccuuuccccagucuaaugcuguaauucaggaugaggaacgcgacaucccagagcgaucauggaacuccggguaugaguggauaaccgauuucccuggaaaaacggugugguuuguucccaguauuaagagcggcaaugacaucgcgaacuguuugaggaaaaauggcaagcgggugauccagcugucgaggaagacuuucgauacagaauaccagaaaaccaagaacaacgacugggacuacgucgugaccacugauauuucugagaugggggccaauuuccgcgcagaccguguuaucgauccaagacggugccucaaaccugugauucugaaggacggacccgaaagggucauacuugcugguccaaugccggugacaguagccuccgcagcccagcgccgaggcagaaucgggcggaaccacaauaaagagggagaucaguauauuuacaugggccagccucuaaacaaugacgaggaucaugcucacuggaccgaagccaagaugcuguuggacaacaucaauacacccgaggguaucauuccagcguuauuugaacccgagagggaaaagagcgcagccauagauggggaguaucgccugagaggcgaggcuaggaaaacuuucguggaacucaugcggcguggagaccugccuguuuggcuuucauacaaggucgccagugagggcuuucaauauucugaucgccgauggugcuucgacggggaaagaaacaaucaggugcuggaggaaaacauggauguggagaucuggacgaaagagggagaaaggaagaaacuccggccacgcugguuggacgcuagaaccuacuccgacccccuggcacuaagggaguuuaaggaguucgccgcuggucggcgaagcgucucaggcgaucugauucucgagaucgggaaacuuccucagcaccugacacagagagcccaaaaugcauuagacaacuugguuaugcugcauaauagugaacagggaggccgcgcguauaggcacgccauggaggagcucccggauacuauugaaacccugaugcuucuggcucucaucgccguguugacaggugggguaacccuguuuuucuuaagcggccggggacuaggcaagacuuccauagggcugcucugugugauggcaucuagcguccuucuguggauggcuuccguggagccacauuggaucgccgcaucaauuaucuuggaauuuuuccugaugguucuccugauucccgagccugaccgucagagaacgccccaggauaaccaacuugccuacguggucaucggacuccuguuuaugauauugaccguagcugcgaaugagaugggucuguuagaaacaacuaagaaagaccuaggcauugggcacguggccguugagaaccaccaucacgcagcuaugcuggauguggaccuccauccagccucugccuggacccuuuacgcagucgcuacaaccaucauuacuccuaugaugaggcacacaaucgaaaacacgaccgccaauauaagucugacugcgaucgcuaaccaggccgcaauuuugaugggacuggauaagggcuggcccaucucgaaaauggacauuggugugccacuccuggcccuugggugcuauagccaggucaauccuuuaacacugaccgcugcagugcucauguugguugcccauuacgcgaucauaggcccgggacugcaagcuaaggccacccgcgaggcacagaaacggacagccgcuggcauuaugaagaaccccacuguggaugggaucguagccaucgaccuagauccaguggucuaugacgcaaaguucgaaaaacagcugggacagauuaugcuccuuauccuguguacgucccaaauauugcugaugcgaaccacaugggcucucugcgagucuauuacucuggccaccggcccuuuaacaacccuuugggaggguucacccgggaaguuuuggaauacuacgaucgcgguuagcauggccaacauuuucagaggauccuaccuggcaggcgcuggucucgccuucagucuaaugaaaucucugggcgggggaaggcgcggcacaggggcacagggagaaaccuugggcgagaaguggaaacggcagcugaaucagcucagcaagccagaauuuaacacuuauaagagaucagguaucauggagguggaccguuccgaagcuaaagaggggcuuaagaggggagagaccacaaaacacgccgucagucggggcacugccaagcugcgcugguucguggaacgaaauuugguaaaaccugaggguaaggugauagaucugggcugugggagaggaggcuggagcuacuauugcgcggggcucaagaaaguuaccgaagugaagggauacacaaaaggcggucccgggcacgaggaaccgaucccaauggcuacguacggauggaacuuagucaagcugcauucuggcaaagacguguuuuucauuccucccgagaagugugauacccuucugugcgacaucggcgaguccucaccaaaucccacuauugaagaggggaggacacuacggguccucaaaaugguggaaccuuggcugcgcggaaaccaauuuuguaucaagauuuugaauccguauaugcccagcguuguagagacccuggagcagaugcagagaaagcacgguggcaugcucgugaggaacccacuuucgcgaaauucuacucaugaaauguacugggucaguugcgggacaggaaacaucguguccgcaguuaauaugaccagccggaugcuguuaaaccguuucacgauggcccacagaaaaccuaccuaugagcgcgauguggaccugggcgcugguacaaggcacgucgccguggaacccgagguagcaaacuuggauauaauugggcagcggaucgaaaauaucaagcaugagcacaaaucaacuuggcauuacgacgaggauaacccuuauaagaccugggccuaccacggauccuaugaagugaaaccaucuggcagcgcuaguuccaugguuaauggcgucgugaagcuccugacaaagcccugggacgugauuccuauggucacucaaauagcgaugaccgauacaaccccauuugggcagcagagaguuuucaaagagaagguggacacucgcacgcccaaagccaagaggggaacagcacaaaucauggaaguaaccgcuaaauggcuaugggguuuucuuagccgaaacaagaagccgcggauuuguacuagagaggaguucaccaggaaagugcgcucuaaugccgcaaucggcgccgucuuuguggacgagaaccaguggaacucagcuaaggaggccguugaagaugagcguuucugggaccuggugcaucgggaaagagagcuccacaaacaggggaagugcgcgacaugcgucuacaacaugaugggaaaaagggaaaagaagcugggcgaguuugguaaagcaaaggggagucgcgccauuugguacaugugguugggagcucgauuccuggaguucgaagcccucggcuuuaugaaugaggaucacugguucucccgggaaaacagccuuucuggcguggagggggagggacugcauaaauuagguuauauccugagagacauaucgaagaucccuggcgggaauauguacgcagaugacacggcuggaugggauaccaggauuacugaagacgauuugcagaacgaggccaaaaucacagacauuauggaaccagagcacgcucuccuggccaagucaaucuuuaaacuaaccuaucaaaauaagguaguucgcgugcagagacccgcaaagaacggcacugucauggaugugauaagccggagggaccagcgugguuccggacaggugggaacauacggccuuaauaccuucacaaacauggaagcgcaacugauucgacagauggagagugagggcaucuuuucuccuagcgaacucgagacuccaaaccuggccgggcgcgucuuggauugguuagaaaaacauggaguugagagacugaagcggauggcuaucuccggugacgacugugugguaaaacccauugaugacagguucgccaccgcacucacggcucuuaaugauaugggcaaggugcgcaaagacauaccgcagugggaaccuucaaagggguggaacgauuggcagcaaguccccuuuugcagucaccacuuccaucagcugaucaugaaggacggaagagagauugugguuccaugucggaaucaggaugagcuagugggcagggcccgagucucucagggugcaggguggagccugcgugaaaccgccugccucggaaaauccuaugcgcaaauguggcaguugauguacuuucacagacgcgaccugcggcuugcugccaacgcaaucuguucagccgugccuguagauuggguucccacaagcaggacuaccuggucuauucaugcucaccaucaguggaugacaacugaggacaugcuguccguguggaauagagucuggaucgaagagaacccauggauggaagauaagacccacgugaguagcuggggcgacguucccuaucucggcaaacgcgaggaccaauggugcgggucguuaauaggacugacggcccgggcaacaugggcuaccaauauccagguggccauuaaccaggucaggcgauugcuggguaaugagaacuaccucgauuacaugacuuccaugaagagauucaaaaaugaaucugacccugagggcgcgcuuugguga

SEQ ID NO: 13852 - RNA, 9879 nt, Artificial Sequence
  derived and/or modified CDS sequence (opt3) from DENV-1__FJ898411__SS-prME
uccgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucugcucugcucaagaacgaugugccccuggcagggccucuuauugccggaggcaugcucaucgcguguuacgucauaagugguuccagcgcugaccugucuuuggagaaggccgcagaggugagcugggaagaggaagccgagcauuccggggcuucacacaauauuuuaguagaagugcaggaugacggaacuaugaaaaucaaggaugaggagagggacgauacacugaccauccuccugaaggcaacucuucuggccgucaguggcguuuaucccuugagcauuccagcgacacuauucgugugguacuuuuggcagaaaaagaaacaacgaucuggcgugcugugggacaccccuucacccccagaagucgagcgcgcugugcucgaugacgggauauaucggaucaugcagagaggacugcuugguaggagccagguuggcguagggguguuccaggaaaacgucuuucauacgauguggcacgugacucguggagccguuuuaauguaccaaggcaagcgccuggagccgaguugggcaagcgugaaaaaggaccucauuuccuacggugggggauggcgguugcagggcucuuggaauaccggcgaggaaguccaggugaucgccguagagccugggaagaaccccaaaaauguccagacagcuccaggaaccuucaagacaucggaaggugaggugggcgccauugcacuggauuuuaaacccgggacuagcggaucaccuaucguuaacagagaaggcaagauagugggucucuaugggaauggagucgugaccacguccggcacauacguuagugcuaucgcccaagcgaaagccucucaggagggcccacugcccgagauugaagacgagguguucaggaagcgaaaccuuacuaucauggaucugcacccugggagcggaaagacccggcgcuauuugccggcaauugucagagaagcuaucaaaaggaagcuacggacacugauacucgccccaacccgagugguagcuuccgagauggcagaagccuuaaaagguaugcccauuagauaccagacuaccgccgugaagucagagcauacaggcaaagagaucguugaccugaugugccacgcuacguuuacuaugcgccuucugucuccugucagggugccaaauuauaacaugaucauuauggaugaagcgcauuucaccgaccccagcaguaucgcagcccguggguacauauccacacgggugggaaugggcgaggcugccgcaauuuuuaugaccgccacuccuccggguagcgucgaggcuuucccccaaucuaaugcgguaauccaggaugaggaaagagacauuccagagaggucauggaacuccggguaugaguggaucacagauuuuccuggaaagaccgugugguucguucccaguauaaagagcggcaaugacauugccaacugucuccgcaaaaauggcaagcgagugauccaguugucgagaaaaacguucgauacugaauaccagaagaccaaaaacaacgacugggacuacgucgugaccaccgauaucucugagaugggggcaaauuuucgggcugacaggguuauugauccacgccguugccugaagccugugauccucaaggacggacccgaaagagucauucuggccgguccaaugccggugacuguagcauccgccgcucaacggaggggccgcauagggcgaaaccacaauaaagagggagaucaguauaucuacaugggccagccucuuaacaaugacgaggaucaugcccacuggacagaagcgaagaugcuacuggacaacauuaauacccccgaggguaucaucccagcauuguucgaacccgagagagagaaaagcgccgcuauugauggggaguaucgguuaaggggcgaggcccgcaagacauuuguggaacugaugagaaggggagaccucccuguuuggcugucauacaaagucgcuagugagggcuuccaguauucugaucggcguuggugcuuugacggggaacgcaacaaucaagugcuugaggaaaacauggauguggagauauggacuaaggagggagaaaggaaaaagcugagaccaagauggcucgacgcacggacguacuccgaccccuuggcccugcgcgaguucaaggaauuugcugccgguagaaggagcgucucaggcgaucuaauccuggagauugggaaacucccucagcaccuuacccagcgggcacagaaugcgcuggacaacuuaguuauguugcauaauagugaacaaggaggccgagccuauagacacgcuauggaggagcugccggauacaaucgaaacucucaugcugcuugcccugauugcagugcucaccggugggguaacauuguucuuucugagcggccgcggauuaggcaagaccuccaucgggcuacugugugugauggcuucuagcguccuccuuuggauggccuccguggagccacauuggauagcagccucaaucauucuggaguucuuuuugaugguucugcucauccccgagccugacaggcagcggacuccccaggauaaccagcuggcuuacguggucauuggacuucucuucaugauccugacgguagcggccaaugagauggguuugcuggaaaccaccaaaaaggacuuaggcauagggcacguggcaguugagaaccaccaucacgcugccaugcuagauguggaccugcauccagccucugcauggacucucuacgcugucgccaccacaauuaucaccccuaugaugcgucacacuauugaaaacacaacggcgaauaucagucuuaccgcuauagccaaccaagcagccauccugaugggauuggauaaaggcuggcccauuucgaagauggacaucggugugccacugcucgcucuggggugcuauagccaggucaauccucuuacuuuaacagcagccgugcugaugcucguugcgcauuacgcuauuaucggcccgggauugcaggccaaggcaaccagagaggcccagaaaaggaccgcugccggcauaaugaagaaccccacaguggaugggauuguagcaaucgaccuggauccaguggucuaugacgcuaaauuugaaaagcagcuaggacagaucaugcugcucauucuuuguacuucccagauccuguugaugcgcacgaccugggcccugugcgagucuauaacacucgcgacuggcccucugaccacauuaugggaggguucacccgggaaauucuggaauaccacuauugccguuagcauggcaaacaucuuccggggauccuaccuugcuggcgccggucuggcauuuagucucaugaagucucuaggcgggggacgaagaggcacgggggcucaaggagaaacacugggcgagaaguggaaaaggcaguugaaucagcugagcaagucagaguucaacaccuauaaacgcuccgguauuauggagguggaccggagugaagccaaggaggggcucaaaagaggagagacuaccaagcacgccgucagccguggcacagcgaaacuuaggugguuuguggaacggaaucugguaaaaccagaggguaaggugaucgauuugggcugugggcgcggaggcuggucuuacuauugcgcugggcugaaaaagguuacugaagugaaaggauacaccaagggcgguccugggcacgaggaacccauaccgauggcaacauacggauggaaccucgucaaauuacauuccggcaaggacguguucuuuaucccaccugagaagugugauacgcugcuuugcgacauuggcgagucaagccccaauccaaccaucgaagaggggcgaacucugagaguccuaaaaaugguggaacccuggcucaggggaaaccaguucuguauuaagauccugaauccuuauaugccgucgguuguagagacauuggagcaaaugcagcggaaacacgguggcaugcuggugcgcaacccccucucuagaaauaguacccaugaaauguacugggucuccugcgggacuggaaacauugugagcgccguuaauaugacaucaaggaugcuucugaaccgauuuaccauggcucaccggaagccaacguaugagcgugauguggacuuaggcgccgguaccagacacgucgcaguggaaccugagguagccaaccuggauaucauagggcagcgcauugaaaauaucaaacaugagcacaaguccacauggcauuacgacgaggauaaccccuauaagacuugggcuuaccacggaucuuaugaagugaaaccuagcggcagugcguccagcaugguuaauggcgucgugaaguugcucaccaaaccaugggacgugauccccauggucacacagauugccaugacugauaccacaccuuucgggcaacagaggguuuuuaaggagaaaguggacacccggacuccaaaggcaaagagaggaacggcucagauaauggaaguaacagccaaauggcugugggguuuccuaucucgcaacaagaaacccaggaucuguacccgagaggaauuuacucggaaggugagaucaaaugcagccauuggcgcugucuucguggacgagaaccaauggaauagugccaaagaggcgguugaagaugagagguuuugggaccuugugcaucgcgaacgugagcugcacaagcaggggaagugcgcaaccugcgucuacaacaugaugggaaaacgggaaaagaaacucggcgaguucgguaaggccaaaggguccagagcuaucugguacauguggcugggagccagguucuuggaguuugaagcacugggcuucaugaaugaggaucacugguuuagccgcgaaaacucucucucgggcguggagggggagggacuucauaagcuggguuauauuuuacgagacaucucaaaaauaccgggcgggaauauguacgcugaugacacagccggaugggauacgcggaucaccgaagacgaucugcagaacgaggcuaagauuacugacaucauggaaccugagcacgccuugcucgcaaagagcauuuucaaacugacauaucagaauaagguaguuagagugcaaaggccagcgaaaaacggcaccgucauggaugugaucucccgcagagaccagcgggguaguggacaggugggaacuuacggccuaaauacauuuaccaacauggaagcccagcuuauaaggcaaauggagucugagggcauuuucagccccuccgaacuggagacaccuaaccucgcugggcguguccuggauugguuggaaaagcauggaguugagcgauuaaaacgcauggccaucucaggugacgacugugugguaaagccaaucgaugacagauuugcaacugcucugaccgcccucaaugauaugggcaaggugcggaaagacauuccccagugggaaccgaguaagggguggaacgauuggcagcaggucccuuucugcucucaccacuuucaucaacuuauaaugaaagacggaagggagaucgugguucccugucgcaaucaggaugagcuggugggcagagcacgggucagccagggugccggguggucccuaagggaaacggcgugccugggaaagucauaugcucagauguggcaacucauguacuuccaccgacgugacuugagacuggccgcaaacgccauuuguagcgcugugccaguagauuggguuccuaccucucgcacaacuugguccauccaugcccaccaucaguggaugaccacagaggacaugcuuaguguguggaaucgggucuggauugaagagaaccccuggauggaagauaaaacucacaucagcucguggggcgacgugccauaucugggcaagagggaggaccaguggugcgggucccucauaggauuaaccgcaagagcuacgugggccacaaauauccaaguugcgauuaaccaggugcgccggcugaucgguaaugagaacuacuuggauuacaugaccucuaugaagagguuuaaaaaugaaucagaccccgagggcgcucugugguga

SEQ ID NO: 13853 - RNA, 9879 nt, Artificial Sequence
  derived and/or modified CDS sequence (opt3) from DENV-1__FJ898412__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaaaaugagaccuauguucgcagugggccuccuguuuaggcgccuuaccagccgggagguccugcuacucacgauaggucugucauugguggccaguguugaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuuggcucccuggggugcaaaccuuugacuauguuucucaucgcugagaauaagauauggggaagaaaaagcuggccacugaacgaagguaucauggccgugggcguugugucgauucuacugucaucucuucucaagaacgaugucccccuggccgggccuuugaucgcuggaggcauguuaauugcauguuaugugaucagugguuccagcgccgaccugucucucgagaaagcggcugagguaagcugggaagaggaagccgagcacuccggggcaucacauaauauacugguggaaguccaggaugacggaacaaugaagauuaaagaugaggagagggacgauacccuuacuauccuguugaaggccacacuacuggcuguuaguggcguguacccccucagcaucccagcaacccuguucgugugguauuuuuggcaaaagaaaaagcagcgaucuggcguccuuugggacacgccuucacccccagaaguggagcgcgccguuuuagaugacgggauuuaccggauaaugcagagaggacugcucgguaggagccagguaggcgugggggucuuccaagaaaacguguuccacacuauguggcacguuacccguggagcgguguugauguaucagggcaaacgccuggagccgaguugggcuagcgucaagaaagaccucaucuccuacggugggggauggcggcugcagggcucuuggaauacaggcgaggaagugcagguaauugccgucgagccugggaagaaccccaagaaugugcaaaccgcaccaggaacauuuaaaacucccgaaggugagguuggcgccaucgcucuugauuucaagccugggaccucgggaagcccaauugugaacagagaaggcaaaaucgucggucuguacgggaauggagugguuacgacaucaggcacuuauguguccgccauagcacaggcuaaggccagucaggagggccccuugccugagaucgaagacgaggucuuuaggaaacgaaaccuaaccauuauggaucugcauccggggucuggaaagacacggcgcuaccucccagcgaucgugagagaagccauuaagaggaaauuacggacccugauccuugcacccacucgaguaguggcuagcgagauggccgaagcucugaaggguaugccuauaagauaucaaaccacagcaguuaaauccgagcacacgggcaaggagauugucgaccucaugugccaugccacuuucaccaugcgcuugcugucaccagugagggugcccaauuacaacaugaucaucauggaugaagcccacuuuacagacccuucuagcauugcugcgcguggguauaucaguacccgggucggaaugggcgaggcagccgcuauauucaugacugccacaccgcccgguuccguagaagcauuuccacagagcaaugccgugauucaggaugaggaaagagacaucccugagaggucuuggaacucaggguacgaguggauuaccgauuuccccggaaaaacgguuugguuugugccauccaucaagaguggcaaugacauagcuaacugucuccgcaagaauggcaaacgagucauucagcugagcagaaagacuuucgauacagaauaucagaaaaccaagaacaacgacugggacuacgugguuaccacugauaucucggagaugggggcgaauuuucgggccgacagggugaucgauccucgccguugccuuaaacccgucauucuaaaggacggaccagaaagagugauccuggcagguccgaugccuguaacaguggcuucugccgcacagcggaggggccgcauugggcgaaaccauaauaaggagggagaucaguacauauauaugggccagcccuugaacaaugacgaggaucacgcccacuggaccgaagcuaaaauguuacuggacaacaucaauacaccagaggguauuauccccgcccucuucgaaccugagagagaaaaguccgcggcaaucgauggggaguaccggcugaggggcgaggcccgcaaaacuuucguugaacuuaugagaaggggagaccugccagucuggcucagcuauaagguggcuucagagggcuuucaauacagugaucggcguuggugcuucgacggggaacgcaacaaucagguguuggaggaaaacauggaugucgagauuuggacgaaagagggagaacgaaagaaacugagacccagguggcuagacgcccggaccuauucugacccucuggcucuccgcgaguuuaaggaguucgcagccgguagaagguccguuagcggcgaucuuauacuggagaucgggaaguuaccgcagcauuugacacagcgggcucaaaaugcccuggacaaccucgugaugcugcacaauucagaacagggaggccgagcauacagacaugcgauggaggagcuuccagauacuauugaaacccugaugcucuuggcccugaucgcuguauuaacagguggggugacccuauuuuuccugaguggccgcggacucggcaaaacuagcauugggcuucugugugucauggccuccucuguguugcuguggauggcaagcguugagccccacuggaucgcugccuccauaauccucgaauuuuuccugauggugcuucucauuccugagcccgacaggcagcggacgccacaggauaaccaacuggcauaugucguaaucggauugcuguuuaugauuuuaaccguggccgcuaaugagaugggucuacuggaaacaacuaagaaagaccucggcaucgggcacguugcgguggagaaccaucaccaugucaccaugcuugauguggaccugcacccugccucagcauggacauuguacgcugucgccaccacuauaauuacacccaugaugcgucauacgaucgaaaacaccacugccaauauuucucugacagcaaucgcuaaccaggccgcgauacucaugggacuggauaagggcuggccaaucaguaaaauggacauuggugugccucuuuuagcucuggggugcuacucgcagguuaauccgcucaccuugaccgccgcagugcugaugcuaguagcccacuaugcuaucauuggccccggacugcaagcaaaggccacaagagaggcgcagaagaggacugcugccggcaucaugaaaaacccaacgguggaugggauagucgcaauugaccucgauccuguuguguacgacgccaaguucgaaaaacagcuuggacagaucaugcuguugauccuguguaccagccaaauucuccugaugcgcacaacuugggcuuuaugcgaguccaucacccuugccacaggcccccugaccacucucugggaggguucuccagggaaguuuuggaauacgacaauagcagucucaauggcuaacauuuuccggggaagcuaucuagccggcgcgggucuggccuuuuccuugaugaaaagucugggcgggggacgaagaggcaccggggcacagggagaaacucucggcgagaaguggaagaggcagcuuaaucagcugucuaaaagcgaguucaacaucuacaagcgcucagguauuauggagguggaccgguccgaagcuaaagagggguugaagagaggagagaccacacgucacgccguaaguaggggcacugcaaaacugcggugguucguggaacgcaaucucguuaagccugaggguaaggugaucgauuuaggcugugggcgaggaggcuggagcuauuacugcgcugggcugaaaaaggucaccgaagugaaaggauauacaaagggcggucccgggcaugaggaaccgauaccaauggccacguacggauggaaccuugucaaacugcacucuggcaaggacguguuuuucaccccucccgagaaaugugauacucuacucugcgacaucggcgaguccucaccaaaucccacaauugaagaggggagaacccugaggguuuugaagaugguagaaccuuggcugcggggaaaccaauuuuguaucaagauucucaauccguacaugcccagcguggucgagacucuugagcagaugcagcgcaaacaugguggcaugcuggugagaaacccauuaucgagaaauucuacacacgaaauguauuggguuaguugcgggaccggaaacaucguguccgccgucaauaugacgagccgaaugcuguugaaccgguucaccauggcgcaccguaagccuacauacgagagagauguggaccucggcgcugguacucgccauguagcaguggaacccgagguugccaaccuggauauuaucgggcagaggauagaaaauauuaaacacgagcauaagucaaccuggcacuaugacgaggauaacccuuacaaaacaugggcuuaucauggauccuacgaagucaagccaucuggcagcgccaguuccauggugaauggcguggucaagcuacuuacuaaacccugggacguuaucccuauggugacccaaaucgcaaugacagauaccacuccauuugggcagcagcggguauucaaggagaaaguggacacgagaacacccaaggccaaacgcggaaccgcucaaauuauggaagucacugcgagguggcugugggguuuucucagccgaaacaagaagccgcggauauguaccagagaggaguucacaaggaaagugcgcucuaaugccgcaaucggcgcuguuuuuguggacgagaaccaguggaacucagccaaggaggcagucgaagaugagcguuucugggaccuggugcagaaagaacgggaguugcacaagcaggggaaaugcgccacgugcguauauaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguugagggggagggacugcauaaguuggguuacauccuccgggacauuucgaaaaucccuggcgggaauauguaugccgaugacaccgcuggaugggauacuagaauaacagaagacgaucugcaaaacgaggccaagaucaccgacauuauggaaccagagcacgcacuacuugcuacuucaaucuuuaaacugacauaccagaauaagguggucagggugcagcgccccgccaagaacggcaccgugauggaugucauuagcagacgggaccagagggguuccgggcaaguuggaacauauggccucaauacuuucaccaacauggaagcucagcugauccgucagauggagagugagggcauauuuuugccuucugaauuagagacgccaaaccuggccgaacgagugcucgauuggcuugagaaauacgggguagaacgccugaagagaauggcaauuagcggagacgacuguguggucaaacccaucgaugaccgguucgcgaccgcccuaacagcucugaaugauauggguaaggugaggaaagacaucccgcagugggagccuuccaagggcuggaacgauuggcaacagguucccuuuugcucacaucacuuccaccagcucauuaugaaggacgggcgcgagauaguggucccauguagaaaucaggaugaauuggugggacgggccaggguaagucaaggcgcagguuggucucugcgagagacugcuugccuugggaaaagcuaugcccagauguggcagcugauguacuuucaucguagagaccuccgcuuagcagccaacgcgaucuguuccgcuguuccuguggauuggguccccaccucacggacaacuuggagcauucacgcccaucaccaauggaugaccacggaagacaugcugucuguguggaauaggguuuggaucgaggaaaacccauggauggaggauaagacacauguguccaguuggggagacguccccuauuugggcaaaagagaggaccaguggugcggcagccugauugggcucaccgcacgcgccacuugggcuucgaauauccagguggccauaaaccagguacggaggcuuaucggaaaugaaaacuaccuggauuacaugacauccaugaagcgauucaaaaaugagggugacccugaaggcgcacuaugguga

SEQ ID NO: 13854 - RNA, 9879 nt, Artificial Sequence
  derived and/or modified CDS sequence (opt3) from DENV-1__GQ199852__SS-prME
agcgugaccaugcugcucaugcuuaugcccacagcacuggcuuuccacuugacuacgagaggaggggagccucauaugaucgucaccaagcaggaaaggggaaaauccuuacuguuuaagaccucugccgguguuaauaugugcacucuaauugcaauggaccucggagagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaggaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggccagcuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaccacugggacacuggcuguuuuccuacugcucaucaugggacagcugaccuggaacgaucuuauucgguugugcaucauggugggcgccaaugcaucugaccguauggggaugggaacaacuuaucuggcuuuaauggccaccuuuaaaaugagaccuauguucgcagucggccuccuguuuaggcgccuuacgagccgggaggugcugcuacucacaauuggucugucauugguugccaguguggaacugccaaacuccuuagaggaacucggggauggacuggcuaugggcauaaugauccuuaagcuguugaccgacuuccaaucucaccagcucugggcgacucugcuaagccugaccuuuauuaaaacaacucuuccccuccauugugccuggaagaccauggcaaugguccuguccaucgcuucauuguucccgcugugcuuaagcacgacaagucagaagaccacuuggcucccuguacugcuuggcucucugggguguaaaccauugacaauguuucucauuaccgagacuaagaucuggggaagaaaauccuggccccugaaugaagguauaauggccgugggcguugugagcauccuacugucgucacuucucaagaacgaugucccucuggccgggcccuugauugcuggaggcauguuaaucgcaugcuacgugauuucugguaguuccgccgaccugagccucgagaaagcggcugagguaucuugggaagaggaagccgagcacagcggggcaucccauaacauccugguggucguucaggaugacggaacaaugaagauaaaagaugaagagagggacgauacccuuacgauucuguugaaggccacucuacuggcugugucaggcguguauccacucaguaucccugcaacccuguucgucugguacuuuuggcaaaagaaaaagcagcgaagcggcgugcuuugggacacacccucuccaccggagguugaacgcgccguauuagaugacgggaucuaucggauuaugcagagaggacugcucgguaggucccaggugggcgucgggguguuccaagagaauguuuuccacaccauguggcacgugacacguggagcggucuugauguaccagggcaaacgccuggaaccuucaugggcuagugugaagaaagaccucauaagcuauggugggggauggcggcugcagggcuccuggaacacuggcgaggagguacaggucaucgccguggaacccgggaagaauccaaagaacguucaaaccgcacccggaacguuuaaaacaccugagggugaagugggcgccauugcucuugauuucaagccagggacuucuggaucgcccaucgucaauagagagggcaaaauugugggucuguacgggaacggaguugugaccacaagcggcaccuacgucucagccaucgcacaggcuaaggccucccaggaaggcccuuugccggagauagaggacgaaguguuuaggaaacgaaaucuaacuaucauggaucugcauccagggaguggaaagacccggcgcuaucuccccgcgauuguaagagaggccaucaagaggaaauuacggacacugauucuugcaccuacgcgagugguugcuucugaaauggccgaggcucugaaggguaugccaaucagauaccaaacuaccgcagucaaaagcgaacacacaggcaaggagauaguggaccucaugugucaugccaccuucacuaugcgcuugcugucccccgugagggucccuaacuauaauaugauuaucauggaugaggcccacuuuacagacccgucaucuaucgcugcgcguggguacauuagcacccggguaggaaugggcgaagcagccgcuaucuucaugacggccacucccccagguaguguggaggcauuuccucaguccaacgccguuauacaggaugaagagagagacauucccgaaaggagcuggaacucuggguaugaguggaucacagauuucccaggaaaaaccgugugguuugucccuucaauuaaguccggcaacgacaucgcuaauugccuccgcaagaacggcaaacgagugauacagcugaguagaaagaccuucgauacugaguaccagaaaaccaagaauaacgacugggacuauguugugaccacagauauuagcgaaaugggggcgaacuuucgggccgacagggucaucgauccccgccguugccuuaaaccagugauccuaaaggacggaccggagagaguaauucuggcagguccuaugcccgugacuguugcuucggccgcacagcggaggggccgcaucgggcgaaaucauaacaaggaaggagaucaguacauuuacaugggccagccauugaauaacgacgaggaucacgcccacuggacggaggcuaaaauguuacuggacaauauaaacacccccgaagguaucauuccugcccucuucgagccagaaagagagaagucugcggcaaucgauggggaauaucggcugaggggcgaggcccgcaaaacauucgucgagcuuaugagaaggggagaccugcccguguggcucuccuacaagguggcuagcgaaggcuuucaauauucagaucggcguugguguuucgacggggagcgcaauaaccaggucuuggaagagaauauggauguugaaaucuggacuaaagagggagagcgaaagaaacugagaccuagguggcuagacgcccggaccuacagugacccgcuggcucuccgcgaauuuaaggaguucgcagccgguagaaggucuguguccggcgaucuuauucuggaaauagggaaguuaccacagcauuugacacagcgggcucaaaacgcccuggacaaucucguaaugcugcacaacagcgagcagggaggccgagcauauagacaugcgauggaggaacuucccgauaccaucgagacucugaugcucuuggcccugauugcuguguuaacggguggggucacccuauuuuuccugucaggccgcggacucggcaaaacaaguaucgggcuucugugcgugauggccagcuccguuuugcuguggauggcaucuguggaaccucacuggauugcugccagcaucauacucgaguuuuuccugaugguccuucucauccccgaaccagacaggcagcggacuccucaggauaaucaacuggcauacguagugauuggauugcuguuuaugaucuuaaccguugccgcuaacgagaugggucuacuggagacaaccaagaaagaccucggcauugggcacguggcggucgaaaaucaucaccaugccacuaugcuugauguggaccugcaccccgcauccgcuuggacauuguaugccgucgccacgaccaucauaacuccaaugaugcgucauacaauugagaacaccaccgcaaacaucucacugacagcuauugccaaucaggcggcuauccucaugggacuggauaagggcuggccuauaucuaaaauggacaucggugugccgcuuuuagcccugggguguuacagucagguuaacccccucacuuugacggcagccgugcugaugcuaguagcucacuacgcaauuaucggcccaggacugcaagccaaggcgaccagagaagcucagaagaggacagccgcaggcauuaugaaaaauccuacuguggaugggaucgucgccauagaccucgaucccguuguguaugacgcuaaguucgagaaacagcuuggacagauuaugcuguugauccugugcaccucgcaaauccuccugaugcgcacaaccugggccuuaugugaaagcauuacucuugcaacgggcccacugacaacccucugggaggguuccccugggaaguuuuggaacacuaccaucgcugucucuauggccaauauauuccggggaucauaccuagcgggcgccggucuggcauuuagcuugaugaaaucccugggcgggggacgaagaggcacaggggcucagggagagacucucggcgaaaaguggaagaggcagcuuaaccagcugaguaaaucugaguucaauauuuauaagcgcagcgguaucauggaaguggaccggucagaggccaaagaaggguugaagagaggagagaccacacgucacgcaguauccaggggcacggcuaaacugcggugguucguggagcgcaaccucguuaagcccgaagguaaggugauugauuuaggcugcgggcgaggaggcuggaguuacuauugugccgggcugaaaaaggucaccgaggugaaaggauacacuaagggcgguccggggcaugaggagccaaucccuauggccacauauggauggaaucuugucaaacugcacagcggcaaggacguguuuuucacacccccagaaaaaugcgauacucuacucugugacauaggcgagucuucccccaacccuacaaucgaggaagggagaacccugaggguuuugaagaugguagagccguggcugcggggaaaucaauuuugcauuaagauccucaaccccuacaugccaucaguggucgaaacgcuugagcagaugcagcgcaaacaugguggcaugcuggugagaaauccuuuaagcaggaacucgacccacgagauguacuggguuucuugugggacaggaaauauugugagugcggucaacaugacuucccgaaugcuguugaaucgguucaccauggcucaccguaagcccacauaugaaagagauguggaccucggcgcagguacucgccauguagccguggagccugaaguugcuaaccuggauaucauugggcagaggaucgagaacauaaaacacgaacauaagagcaccuggcacuacgacgaggauaauccauauaaaacaugggccuaccauggaucauaugaggucaagcccuccggcucugcaagcaguauggugaacggcguggucaagcuacuuaccaaaccuugggacguuauuccaauggugacucaaaucgccaugacggauacaacccccuuugggcagcagcggguauucaaggaaaaaguggacacuagaaccccgaaggcuaaacgcggaacagcgcaaaucauggaggucacggccagguggcugugggguuuucucucccgaaauaagaagccucggauuugcaccagagaagaguucacuaggaaagugcgcagcaacgcagcuauaggcgccguuuuuguggacgaaaaucaguggaacucugcaaaggaggccgucgaggaugaacguuucugggaccuggugcagaaagagcgggaauugcacaagcaggggaaaugcgcuacauguguauacaauaugaugggaaagagagagaagaaacugggcgaauuugguaaggccaaagggucaagggcgaucugguauauguggcucggagcacgcuuccuugaguuugaggcccugggcuucaugaacgaagaucacugguucagucgagaaaauuccuuaagcggcguugaaggggagggacugcauaaguuggguuacauucuccgggacaucucuaaaauuccaggcgggaacauguacgcugaugacaccgccggaugggauacuagaaucacagaggacgaucugcaaaaugaagcaaagauaaccgacaucauggagcccgaacacgcucuacuugccacaucgauuuuuaaacugacuuaucagaacaagguggucagggugcagcgcccugcuaagaauggcaccgugauggaugucaucucaagacgggaccagagggguagcgggcaaguuggaacguacggccucaacaccuucacaaauauggaggcccagcugauucgucagauggaauccgagggcaucuuuuugccaagugaguuagaaacucccaaccuggcagagcgagugcucgauuggcuugaaaaauaugggguagagcgccugaagagaauggcgauaucuggagacgacugcguggucaaaccgauugaugaccgguucgccaccgcucuaacagcccugaacgauauggguaaggugaggaaagacaucccucagugggaacccagcaagggcuggaaugauuggcaacagguuccauuuuguucccaucacuuccaccagcucaucaugaaggacgggcgcgagauuguggucccuugcagaaaccaggaugaguuggugggacgggcaaggguaucacaaggcgcugguuggagucugcgagaaacugccugucuugggaaaucuuacgcacagauguggcagcugauguauuuucaucguagagaccuccgcuuagccgcgaaugcuauaugcagcgccguucccguggauugggucccaaccucccggacgacauggucaauccacgcacaucaccaauggaugaccacugaggacaugcugagcguguggaacaggguuuggauugaagagaaucccuggauggaagauaagacacaugugucuuccuggggagacgucccuuacuugggcaaaagagaggaccagugguguggcagucugaucgggcucaccgcccgcgcuacuugggccagcaacauucagguggcaaucaaucagguacggaggcuuauaggaaacgagaauuaucuggauuacaugaccucgaugaagcgauucaaaaacgaaggugacccagagggcgcucuaugguga

SEQ ID NO: 13855 - RNA, 9879 nt, Artificial Sequence
  derived and/or modified CDS sequence (opt3) from DENV-1__FJ898415__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaagcuucaaacuggagaaggaaguggcugagacccagcacgguacgguccuugugcagauaaaguacgagggcacagacgcgccuugcaaaaucccauucuugacccaagaugaaaaggggguuacucagaacggacgccugauuacagcaaaucccaucgugaccgacaaagagaagccuguaaacauagaagccgagccacccuuuggcgagucguauauugucaucggugcuggggaaaaagcccucaagcugucuugguucaagaaaggcuccaauaucggaaagauguuugaggcaacugccagaggcgcuaggcggauggccauucuuggggauaccgcaugggacuucggaucaaucgguggcguguuuacaaguguugggaaacuggugcaucagauuuucggaacggcguacggcgucuuguuuagcgguguguccuggaccaugaagauagggaucggcguacuccugacuugguuaggacugaacucucgaagcacaucacuaaguaugaccuguauugcugugggccucguuacacuguaccuuggggucauggugcaggccgauuccggaugcgugaucaauuggaaaggccgcgaauugaagugugguagcgggaucuucgucacuaacgagguucacaccuggacggaacaauauaaguuucaggcagacucuccgaaaagacugucagccgcuauuggaaaggccugggaggagggcgugugcgguauaaggagugcaacacggcucgaaaacaucauguggaaacagauuagcaaugagcugaaccauaucuuacuggaaaaugacaugaaguucaccgugguagucggcgaugugguugggauucuugcucagggaaaaaagaugauccgcccucaacccauggagcacaaauacuccuggaagucuuggggcaaggccaaaauaaucggggcggacgugcagaacacuaccuuuauuaucgauggaccaaauacaccugaaugucccgacgaucagagagccuggaacauuugggaggucgaggacuauggcuucgguaucuuuacuaccaauauaugguugaagcucagggauucguacacacaggugugcgaccaccgucugaugagcgcugcaauuaaagauuccaaggccguucaugcugacaugggguauuggaucgaaucagagaaaaacgaaacguggaagcuagcccgggcaaguuucauugaggugaagaccuguaucuggccaaaaucucacacucuguggagcaauggaguacucgaauccgagaugauaauccccaagauuuacggcgguccuaucucacaacauaacuaucgaccaggcuacuucacacagaccgcggggccguggcaccugggaaaacuugaguuggauuuugaccugugcgaaggcacuacagucgugguggaugagcacugcgggaauagaggacccagcuuaaggaccacgacugucaccggcaagacaauucaugaaugguguugccgcucuuguacccucccuccacugcgguucaaaggugaggacgggugcugguacggaauggagaucagacccguuaaggaaaaggaggaaaaccuugugaaauccaugguaagugccggcagcggugagguggacucuuuuucccugggcuugcucuguauaucaauuaugaucgaagaggucaugaggagucgcuggagccgaaagaugcugaugacugggacacuagcuguguuccugcuccugaucaugggacagcuuaccuggaaugauuugauucggcugugcaucaugguuggcgccaacgcaucggaccguauggggaugggaacaacuuauuuagcucucauggccaccuuuaaaaugagaccuauguucgcagugggccugcuuuuuaggcgccugacgucccgggagguccuacuccugacaauugguuugucucugguggccagcguugaauuaccaaauucacucgaggaacugggggauggacuugcuaugggcauaaugauccugaaguugcucaccgacuuccaaagucaccagcugugggcgacucuacugucccuuaccuuuauuaaaacaacucucucucugcauuacgccuggaagaccauggcaaugguguugagcaucgucucccuguuccccuuaugucucucaacgacaagccagaagaccacuuggcugccgguacuucugggcaguuuggggugcaaaccucucacaauguuucugauugcugagaacaagaucuggggaagaaaaucuuggccacuaaacgaagguauaauggccgugggcguuguguccauccugcuuagcucgcuccugaagaaugauguccccuuggccgggccuuuaauugcuggaggcaugcugaucgcauguuaugugauuucagguucuagugccgaccucucccuggagaaagcggcugagguaagcugggaagaggaagccgagcacucuggggcaagccauaacauccuuguggaaguccaggaugacggaaccaugaagauaaaagaugaggagagggacgauacucugacaauuuugcuaaaggccacccugcucgcuguuuccggcguguacccccugucaaucccagcaacgcuuuucgugugguauuuuuggcaaaagaaaaagcagcgaaguggcgucuuaugggacacuccuagccccccagaaguggagcgcgccguucuggaugacgggaucuaccggauuaugcagagaggacucuuggguaggucucagguaggcgugggggucuuccaagaaaauguguuccacaccauguggcacguuacacguggagcggugcugauguaucagggcaaacgccucgagccguccugggcuucagucaagaaagaccugauaaguuacggugggggauggcggcuucagggcagcuggaacaccggcgaggaagugcagguaaucgccgucgagccugggaagaaucccaagaacgugcaaacagcaccaggaacuuuuaaaacccccgaaggugagguuggcgccauugcucuggauuucaagccugggacguccggaucuccaaucgugaauagagaaggcaaaauugucgguuuguacgggaacggagugguuacaacuucgggcaccuaugugagcgccaucgcacaggcuaaggccucacaggagggcccccuaccugagauagaagacgaggucuuuaggaaacgaaaucugacaaucauggaucuccauccgggguccggaaagacccggcgcuacuuaccagcgauugugagagaagccaucaagaggaaacugcggacucuuauucuggcacccacccgaguaguggcuagugagauggccgaagcucucaaggguaugccuaucagauaucaaacaacggcaguuaaaucugagcacacuggcaaggagauagucgacuugaugugccaugccaccuucacaaugcgccugcucagcccagugagggugcccaacuacaauaugauuaucauggaugaagcccacuuuaccgacccuuccucaaucgcugcgcguggguauauuucuacucgggucggaaugggcgaggcagccgcuaucuucaugacagccaccccgcccgguagcguagaagcauuuccacagaguaacgccgugauacaggaugaggaaagagacauuccugagagguccuggaauagcggguacgaguggaucacggauuuccccggaaaaacuguuugguuugugccaucuauuaagucaggcaacgacaucgcuaauugucugcgcaagaacggcaaacgagucauacagcuuuccagaaagacauucgauaccgaauaucaaaaaaccaagaacaaugacugggacuacgugguuacuacagauauuagugagaugggggcgaacuuucgggccgacagggugaucgauccucgccguugccuaaaacccgucauccugaaggacggaccagaaagagugauuuuggcagguccgaugccuguaaccguggcuagcgccgcacagcggaggggccgcaucgggcgaaaucauaacaaggagggagaucaguacauuuauaugggccagcccuuaaauaacgacgaggaucacgcccacuggacagaagcuaaaaugcugcucgacaauauaaacacuccagaggguaucauucccgcccuguucgaaccugagagagaaaagucggcggcaaucgauggggaguaccggcuuaggggcgaggcccgcaaaacguucguugaacugaugagaaggggagaccucccagucugguugucuuauaagguggcuuccgagggcuuucaauacagcgaucggcguuggugcuucgacggggaacgcaauaaccaggugcuggaggaaaauauggaugucgagaucuggaccaaagagggagaacgaaagaaacuaagacccagguggcuggacgcccggacauauucagacccucucgcucuucgcgaguuuaaggaauucgcagccgguagaaggaguguuucuggcgaucugauuuuagagauagggaaguugccgcagcaucugacucagcgggcucaaaacgcccucgacaaucuggugaugcuucacaacuccgaacagggaggccgagcauacagacaugcgauggaggagcugccagauaccaucgaaacacucauguugcuggccuuaauugcuguacuaaccgguggggugacucuguuuuuccucagcggccgcggacuuggcaaaacgucaaucgggcuguugugugucauggccaguagcgugcugcucuggauggcauccguugagccccacuggauugcugccucuaucauacuggaauuuuuccuuauggugcuccugaucccugagcccgacaggcagcggaccccacaggauaaucaauuggcauaugucguaauuggacuguuauuuaugauccuaacaguggccgcuaacgagaugggucugcucgaaacuaccaagaaagaccuuggcauugggcacguugcgguggagaaccaucaccaugccacaaugcuggaugucgacuugcacccugcaagcgcuuggacccuguacgccguggccacuacaaucauaacgcccaugaugcgucauaccauugaaaauacuacagcaaacaucucccucaccgcuauugccaaucaggcggcuauccugaugggacuugauaagggcuggccaauaucaaaaauggacaucggugucccuuuacuggcccucgggugcuacucucaggugaacccguugacccugacagcagccguucuaaugcugguggcucacuaugcaauuaucggccccggacuccaagccaaggcgacuagagaggcucagaagaggacggccgcaggcauuaugaaaaauccaaccguagaugggaucguggccauagaccuugauccugucguuuacgacgcuaaguucgaaaaacagcugggacagauuauguugcugauccucuguacaagucaaauccuguuaaugcgcacuaccugggcccuuugcgagucgauuacacuggcaaccggcccccucacuacgcuaugggaggguagcccagggaaguuuuggaacacaaccaucgcuguguccauggccaauauauuccggggaucuuaucuggcgggcgccgguuuggcauuuucacugaugaaaagccucggcgggggacgaagaggcacuggggcucagggagaaacccuuggcgagaaguggaagaggcagcugaaccaguuguccaaaagugaauucaauauuuacaagcgcucugguaucauggaggucgaccggagcgaagccaaagaggggcugaagagaggagagacaacucgucacgcagugucaaggggcaccgcuaaacuccggugguucguagaacgcaacuuagugaagccugaggguaagguuauugaucugggcugugggcgaggaggcugguccuauuacugcgccgggcuuaaaaaggugacagaagucaaaggauauacgaagggcggucccgggcaugaggaaccgaucccaauggccaccuacggauggaaucuggugaaacuacacaguggcaaggacgucuuuuucacuccucccgagaaaugugauacacuccugugcgacauaggcgagagcucuccaaaccccaccaucgaagaggggagaacuuugagggugcugaagaugguugaaccuuggcuccggggaaaucaauuuuguauuaagauccuuaacccguacaugcccuccguaguggagacacuggagcagaugcagcgcaaacaugguggcauguuagucagaaauccacugucaaggaacagcacccacgaaauguauugggugucgugcgggacgggaaauauuguuucugcggugaacaugaccagucgaauguugcucaaccgguucacaauggcucaccguaagccuacuuacgagagagaugucgaccugggcgcagguacccgccauguggccguagaacccgagguggcuaaucuagauaucauugggcagaggaucgaaaacauaaaacacgagcauaaguccacauggcacuaugacgaggauaauccuuacaaaacuugggccuaucauggaagcuacgaaguuaagccaucaggcuccgcaucuagcauggucaacggcguggugaagcuucugaccaaacccugggacgucauuccuaugguuacacaaaucgccaugaccgauacuacgccauuugggcagcagcggguguucaaggagaaaguagacacaagaacccccaaggcuaaacgcggaacugcgcaaaucauggaagugaccgccagguggcucugggguuuucugagucgaaauaagaagccgcggauuuguacaagagaggaauucacgaggaaaguccgcuccaacgcagcuauaggcgccguguuuguugacgagaaucaguggaacagcgcaaaggaggccguggaagaugagcguuucugggacuugguccagaaagaacgggagcugcacaagcaggggaaaugcgcuaccugcguguauaauaugaugggaaagagagaaaagaaacucggcgaguuugguaaggccaaagggucuagggcgaucugguacauguggcuuggagcacgcuuccuggaguuugaagccuuaggcuucaugaacgaggaucacugguucucacgagaaaauagucuguccggcguagagggggagggauugcauaagcucgguuacauucugcgggacaucagcaaaauuccuggcgggaacauguaugcugaugacacugccggaugggauacaagaaucaccgaagacgaucuacaaaaugaggcaaagauaacugacaucauggaaccagagcacgcucuucuggccacaucuauuuuuaaacucaccuaccagaacaagguugugaggguccagcgccccgcuaagaauggcacagugauggaugugaucucgagacgggaccagagggguucagggcaagucggaacuuauggccugaacaccuucacgaacauggaagcccaguugauucgucagauggagagcgagggcaucuuuuccccuagugaauuagagauaccaaaucuggcagaacgaguucucgauuggcuugagaaauacgggguggaacgccugaagagaauggcgauuucuggagacgacuguguagugaaacccaucgaugaccgguucgccaccgcucuaacagcccugaacgauauggguaaggucaggaaagacgugccgcagugggagccuagcaagggcuggaaugauuggcaacagguucccuuuugcucccaucacuuccaccagcucaucaugaaggacgggcgcgagauuguggucccauguagaaaccaggaugaauuggugggacgggcaaggguaucacaaggcgcugguuggagucugcgagagacugccugccuugggaaaucuuaugcacagauguggcagcugauguacuuucaucguagagaccuccgcuuagccgcgaaugcuauauguagcgccguuccuguggauuggguccccaccucccggacaacuuggucaauccacgcacaucaccaauggaugaccacggaagacaugcugagcguguggaacaggguuuggauugaggaaaauccauggauggaggauaagacacaugugucuuccuggggagacguccccuauuugggcaaaagagaggaccaguggugcggcagucugaucgggcucaccgcccgcgcuacuugggccagcaacauucagguggcaaucaaucagguacggaggcuuauaggaaacgaaaauuaccuggauuacaugacaucgaugaagcgauucaaaaacgagggugacccugaaggcgcucuaugguga

SEQ ID NO: 13856 - RNA, 9879 nt, Artificial Sequence
  derived and/or modified CDS sequence (opt3) from DENV-1__FJ898416__SS-prME
agcgugaccaugcugcucaugcuuaugcccacagcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgcuagcuuguucccccuguguuuaaguaccacgucucagaagacaaccuggcucccgguacugcuuggcucccuggggugcaaaccuuugacuauguuucucauuacagagaccaagaucuggggaagaaaaagcuggccacugaaugaagguauaauggccgugggcguugugucgauccuacugucaucucuucucaagaacgaugucccccuggccgggccuuugauugcuggaggcauguuaaucgcauguuaugugauuagugguuccagcgccgaccugucucucgagaaagcggcugagguaagcugggaagaggaagccgagcacuccggggcaucacauaacauccugguggucguucaggaugacggaacuaugaagauaaaagaugaagagagggacgauacacuuaccauucuguugaaggccacgcuacuggcugugaguggcguguacccccucagcaucccagcaacucuguucgucugguauuuuuggcaaaagaaaaagcagcgaucuggcgugcuuugggacaccccuucacccccagagguugaacgcgccguauuagaugacgggaucuaccggauuaugcagagaggacugcucgguaggagccaggugggcgucgggguguuccaagagaauguuuuccacacaauguggcacgugacccguggagcggucuugauguaucagggcaaacgccuggaaccgaguugggcuagcgugaagaaagaccucauauccuacggugggggauggcggcugcagggcucuuggaacacaggcgaggagguacaggucaucgccguggaaccugggaagaaucccaagaacguucaaacugcaccaggaaccuuuaaaacgcccgagggugaagugggcgccauugcucuugauuucaagccugggacaucgggaagcccaaucgucaauagagagggcaaaauugugggucuguacgggaacggaguugugacuaccucaggcacauaugucuccgccaucgcacaggcuaagaccagucaggaaggccccuugccugagauagaggacgaaguguuuaggaaacgaaaucuaacuaucauggaucugcauccggggucuggaaagacccggcgcuaccucccagccauuguaagagaggcgaucaagaggaaauuacggacacugauucuugcccccacgcgagugguugcaagcgaaauggcugaggcccugaaggguaugccuaucagauaucaaacuaccgcugucaaauccgaacacacaggcaaggagauaguggaccucaugugccaugcaaccuucacuaugcgcuugcugucaccagugaggguccccaacuacaauaugauuaucauggaugaggcccacuuuacagacccuucuagcaucgccgcucguggguauauuaguacccggguaggaaugggcgaagcggcagccaucuucaugacggcuacuccgcccgguuccguggaggccuuuccacagagcaacgcaguuauacaggaugaagagagagacauuccugaaaggucuuggaacucaggguacgaguggaucacagauuuccccggaaaaaccgugugguuugucccauccauuaagaguggcaacgacaucgccaauugucuccgcaagaacggcaaacgagugauacagcugagcagaaagaccuucgauacugaguaucagaaaaccaagaauaacgacugggacuacguugugaccacagauauuucggaaaugggggcuaacuuucgggcggacagggucaucgauccucgccguugccuuaaacccgugauccuaaaggacggaccagagagaguaauucuggccgguccgaugccugugacuguugcaucugcugcccagcggaggggccgcaucgggcgaaaucauaacaaggaaggagaucaguacauuuauaugggccagcccuugaauaacgacgaggaucacgcacacuggacggaggccaaaauguuacuggacaauauaaacaccccagaagguaucauucccgcucucuucgagccugaaagagagaaguccgccgcgaucgauggggaauaccggcugaggggcgaggcacgcaaaacauucgucgagcuuaugagaaggggagaccugccaguguggcucagcuauaagguggccucagaaggcuuucaauacagugaucggcguuggugcuucgacggggagcgcaauaaccaggucuuggaagagaauauggauguugaaaucuggacuaaagagggagagcgaaagaaacugagacccagguggcuagacgcucggaccuauucugacccucuggcccuccgcgaauuuaaggaguucgcugcagguagaagguccgugagcggcgaucuuauucuggaaauagggaaguuaccgcagcauuugacacagcgggcccaaaacgcucuggacaaucucguaaugcugcacaacucagagcagggaggccgagccuacagacaugcaauggaggaacuuccagauaccaucgagacucugaugcucuuggcgcugauugccguguuaacggguggggucacccuauuuuuccugaguggccgcggacucggcaaaacaagcaucgggcuucugugugugauggcuuccucuguuuugcuguggauggccagcguggaaccccacuggauugcagcuuccaucauacucgaguuuuuccugaugguccuucucaucccugaacccgacaggcagcggacuccacaggauaaucaacuggccuauguagugauuggauugcuguuuaugaucuuaaccguugcagccaacgagaugggucuacuggagacaaccaagaaagaccucggcauugggcacguggcugucgaaaaucaucaccaugcgacuaugcuugauguggaccugcacccugccucagcauggacauuguacgcugucgccacgaccaucauaacucccaugaugcgucauacaauugagaacaccaccgccaacaucucucugacagcaauugcuaaucaggccgcgauccucaugggacuggauaagggcuggccaauaaguaaaauggacaucggugugccucuuuuagcucuggggugcuacucgcagguuaacccgcucacuuugacggccgcagugcugaugcuaguagcccacuaugcuauuaucggccccggacugcaagcaaaggccaccagagaagcgcagaagaggacagcugccggcauuaugaaaaauccaacuguggaugggaucgucgcaauagaccucgauccuguuguguacgacgccaaguucgagaaacagcuuggacagauuaugcuguugauccuguguaccagccaaauccuccugaugcgcacaaccugggcuuuaugcgaauccauuacucuugccacgggcccccugacaacccucugggaggguucuccagggaaguuuuggaacacuaccaucgcagucucaauggcuaauauauuccggggaagcuaucuagccggcgcgggucuggccuuuuccuugaugaaaagucugggcgggggacgaagaggcacaggggcacagggagagacucucggcgaaaaguggaagaggcagcuuaaccagcugucuaaaagcgaguucaauauuuacaagcgcucagguaucauggaaguggaccgguccgaggcuaaagaaggguugaagagaggagagaccacacgucacgccguaaguaggggcacggcaaaacugcggugguucguggagcgcaaccucguuaagccugaagguaaggugauugauuuaggcugugggcgaggaggcuggagcuauuacugcgcugggcugaaaaaggucaccgaggugaaaggauauacuaagggcggucccgggcaugaggagccgaucccaauggccacauacggauggaaucuugucaaacugcacucuggcaaggacguguuuuucaccccucccgaaaaaugugauacucuacucugcgacauaggcgaguccucaccaaaccccacaaucgaggaagggagaacccugaggguuuugaagaugguagagccuuggcugcggggaaaucaauuuuguauuaagauccucaacccguacaugcccagcguggucgaaacgcuugagcagaugcagcgcaaacaugguggcaugcuggugagaaauccauuaucgaggaacucuacccacgagauguauuggguuaguugcgggacaggaaauauuguguccgccgucaacaugacuagccgaaugcuguugaaucgguucaccauggcgcaccguaagccuacauacgaaagagauguggaccucggcgcugguacucgccauguagcaguggagcccgaaguugccaaccuggauaucauugggcagaggaucgagaacauaaaacacgaacauaagucaaccuggcacuaugacgaggauaauccuuacaaaacaugggcuuaucauggauccuacgaggucaagccaucuggcagcgccaguuccauggugaacggcguggucaagcuacuuaccaaacccugggacguuauuccuauggugacucaaaucgcaaugacggauacaaccccauuugggcagcagcggguauucaaggaaaaaguggacacuagaacccccaaggccaaacgcggaacagcucaaaucauggaggucacggcgagguggcugugggguuuucucagccgaaauaagaagccgcggauuuguaccagagaagaguucacuaggaaagugcgcucuaacgccgcaauaggcgcuguuuuuguggacgaaaaucaguggaacucagccaaggaggcagucgaggaugaacguuucugggaccuggugcagaaagagcgggaauugcacaagcaggggaaaugcgccacaugcguauauaauaugaugggaaagagagagaagaaacugggcgaauuugguaaggcuaaagggaguagggccaucugguacauguggcucggagcgcgcuuccuugaguuugaggcacugggcuucaugaacgaagaucacugguucucccgagagaauagcuuaucuggcguugaaggggagggacugcauaaguuggguuacauucuccgggacaucucgaaaauuccuggcgggaacauguaugccgaugacaccgcuggaugggauacuagaaucacagaggacgaucugcaaaaugaagccaagauaaccgacaucauggagccagaacacgcacuacuugcuacaucaauuuuuaaacugacuuaccagaacaagguggucagggugcagcgccccgccaagaauggcaccgugauggaugucaucagcagacgggaccagagggguuccgggcaaguuggaacguauggccucaacaccuucacaaauauggaggcucagcugauucgucagauggaaagugagggcaucuuuuugccuucugaguuagaaacuccaaaccuggccgagcgagugcucgauuggcuugaaaaauacgggguagagcgccugaagagaauggcaauaagcggagacgacuguguggucaaacccauugaugaccgguucgcgaccgcccuaacagcucugaacgauauggguaaggugaggaaagacaucccgcagugggaaccuuccaagggcuggaaugauuggcaacagguucccuuuugcucacaucacuuccaccagcucaucaugaaggacgggcgcgagauuguggucccauguagaaaccaggaugaguuggugggacgggccaggguaagucaaggcgcagguuggucucugcgagaaacugcuugccuugggaaaagcuaugcccagauguggcagcugauguacuuucaucguagagaccuccgcuuagcagccaaugcgauauguuccgcuguuccuguggauuggguccccaccucacggacgacauggagcauccacgcccaucaccaauggaugaccacugaggacaugcugucuguguggaacaggguuuggauugaagagaauccauggauggaagauaagacacauguguccaguuggggagacguccccuauuugggcaaaagagaggaccaguggugcggcagccugaucgggcucaccgcacgcgccacuugggcuucgaacauucagguggccaucaaucagguacggaggcuuauaggaaacgagaauuaccuggauuacaugaccuccaugaagcgauucaaaaacgaaggugacccugagggcgugcuaugguga

SEQ ID NO: 13857 - RNA, 9879 nt, Artificial Sequence
  derived and/or modified CDS sequence (opt3) from DENV-1__FJ898417__SS-prME
uccgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucugcucugcucaagaacgaugugccccuggcagggccucuuauugccggaggcaugcucaucgcguguuacgucauaagugguuccagcgcugaccugucuuuggagaaggccgcagaggugagcugggaagaggaagccgagcauuccggggcuucacacaauauuuuaguagaagugcaggaugacggaacuaugaaaaucaaggaugaggagagggacgauacacugaccauccuccugaaggcaacucuucuggccgucaguggcguuuaucccuugagcauuccagcgacacuauucgugugguacuuuuggcagaaaaagaaacaacgaucuggcgugcugugggacaccccuucacccccagaagucgagcgcgcugugcucgaugacgggauauaucggaucaugcagagaggacugcuugguaggagccagguuggcguagggguguuccaggaaaacgucuuucauacgauguggcacgugacucguggagccguuuuaauguaccaaggcaagcgccuggagccgaguugggcaagcgugaaaaaggaccucauuuccuacggugggggauggcgguugcagggcucuuggaauaccggcgaggaaguccaggugaucgccguagagccugggaagaaccccaaaaauguccagacagcuccaggaaccuucaagacaucggaaggugaggugggcgccauugcacuggauuuuaaacccgggacuagcggaucaccuaucguuaacagagaaggcaagauagugggucucuaugggaauggagucgugaccacguccggcacauacguuagugcuaucgcccaagcgaaagccucucaggagggcccacugcccgagauugaagacgagguguucaggaagcgaaaccuuacuaucauggaucugcacccugggagcggaaagacccggcgcuauuugccggcaauugucagagaagcuaucaaaaggaagcuacggacacugauacucgccccaacccgagugguagcuuccgagauggcagaagccuuaaaagguaugcccauuagauaccagacuaccgccgugaagucagagcauacaggcaaagagaucguugaccugaugugccacgcuacguuuacuaugcgccuucugucuccugucagggugccaaauuauaacaugaucauuauggaugaagcgcauuucaccgaccccagcaguaucgcagcccguggguacauauccacacgggugggaaugggcgaggcugccgcaauuuuuaugaccgccacuccuccggguagcgucgaggcuuucccccaaucuaaugcgguaauccaggaugaggaaagagacauuccagagaggucauggaacuccggguaugaguggaucacagauuuuccuggaaagaccgugugguucguucccaguauaaagagcggcaaugacauugccaacugucuccgcaaaaauggcaagcgagugauccaguugucgagaaaaacguucgauacugaauaccagaagaccaaaaacaacgacugggacuacgucgugaccaccgauaucucugagaugggggcaaauuuucgggcugacaggguuauugauccacgccguugccugaagccugugauccucaaggacggacccgaaagagucauucuggccgguccaaugccggugacuguagcauccgccgcucaacggaggggccgcauagggcgaaaccacaauaaagagggagaucaguauaucuacaugggccagccucuuaacaaugacgaggaucaugcccacuggacagaagcgaagaugcuacuggacaacauuaauacccccgaggguaucaucccagcauuguucgaacccgagagagagaaaagcgccgcuauugauggggaguaucgguuaaggggcgaggcccgcaagacauuuguggaacugaugagaaggggagaccucccuguuuggcugucauacaaagucgcuagugagggcuuccaguauucugaucggcguuggugcuuugacggggaacgcaacaaucaagugcuugaggaaaacauggauguggagauauggacuaaggagggagaaaggaaaaagcugagaccaagauggcucgacgcacggacguacuccgaccccuuggcccugcgcgaguucaaggaauuugcugccgguagaaggagcgucucaggcgaucuaauccuggagauugggaaacucccucagcaccuuacccagcgggcacagaaugcgcuggacaacuuaguuauguugcauaauagugaacaaggaggccgagccuauagacacgcuauggaggagcugccggauacaaucgaaacucucaugcugcuugcccugauugcagugcucaccggugggguaacauuguucuuucugagcggccgcggauuaggcaagaccuccaucgggcuacugugugugauggcuucuagcguccuccuuuggauggccuccguggagccacauuggauagcagccucaaucauucuggaguucuuuuugaugguucugcucauccccgagccugacaggcagcggacuccccaggauaaccagcuggcuuacguggucauuggacuucucuucaugauccugacgguagcggccaaugagauggguuugcuggaaaccaccaaaaaggacuuaggcauagggcacguggcaguugagaaccaccaucacgcugccaugcuagauguggaccugcauccagccucugcauggacucucuacgcugucgccaccacaauuaucaccccuaugaugcgucacacuauugaaaacacaacggcgaauaucagucuuaccgcuauagccaaccaagcagccauccugaugggauuggauaaaggcuggcccauuucgaagauggacaucggugugccacugcucgcucuggggugcuauagccaggucaauccucuuacuuuaacagcagccgugcugaugcucguugcgcauuacgcuauuaucggcccgggauugcaggccaaggcaaccagagaggcccagaaaaggaccgcugccggcauaaugaagaaccccacaguggaugggauuguagcaaucgaccuggauccaguggucuaugacgcuaaauuugaaaagcagcuaggacagaucaugcugcucauucuuuguacuucccagauccuguugaugcgcacgaccugggcccugugcgagucuauaacacucgcgacuggcccucugaccacauuaugggaggguucacccgggaaauucuggaauaccacuauugccguuagcauggcaaacaucuuccggggauccuaccuugcuggcgccggucuggcauuuagucucaugaagucucuaggcgggggacgaagaggcacgggggcucaaggagaaacacugggcgagaaguggaaaaggcaguugaaucagcugagcaagucagaguucaacaccuauaaacgcuccgguauuauggagguggaccggagugaagccaaggaggggcucaaaagaggagagacuaccaagcacgccgucagccguggcacagcgaaacuuaggugguuuguggaacggaaucugguaaaaccagaggguaaggugaucgauuugggcugugggcgcggaggcuggucuuacuauugcgcugggcugaaaaagguuacugaagugaaaggauacaccaagggcgguccugggcacgaggaacccauaccgauggcaacauacggauggaaccucgucaaauuacauuccggcaaggacguguucuuuaucccaccugagaagugugauacgcugcuuugcgacauuggcgagucaagccccaauccaaccaucgaagaggggcgaacucugagaguccuaaaaaugguggaacccuggcucaggggaaaccaguucuguauuaagauccugaauccuuauaugccgucgguuguagagacauuggagcaaaugcagcggaaacacgguggcaugcuggugcgcaacccccucucuagaaauaguacccaugaaauguacugggucuccugcgggacuggaaacauugugagcgccguuaauaugacaucaaggaugcuucugaaccgauuuaccauggcucaccggaagccaacguaugagcgugauguggacuuaggcgccgguaccagacacgucgcaguggaaccugagguagccaaccuggauaucauagggcagcgcauugaaaauaucaaacaugagcacaaguccacauggcauuacgacgaggauaaccccuauaagacuugggcuuaccacggaucuuaugaagugaaaccuagcggcagugcguccagcaugguuaauggcgucgugaaguugcucaccaaaccaugggacgugauccccauggucacacagauugccaugacugauaccacaccuuucgggcaacagaggguuuuuaaggagaaaguggacacccggacuccaaaggcaaagagaggaacggcucagauaauggaaguaacagccaaauggcugugggguuuccuaucucgcaacaagaaacccaggaucuguacccgagaggaauuuacucggaaggugagaucaaaugcagccauuggcgcugucuucguggacgagaaccaauggaauagugccaaagaggcgguugaagaugagagguuuugggaccuugugcaucgcgaacgugagcugcacaagcaggggaagugcgcaaccugcgucuacaacaugaugggaaaacgggaaaagaaacucggcgaguucgguaaggccaaaggguccagagcuaucugguacauguggcugggagccagguucuuggaguuugaagcacugggcuucaugaaugaggaucacugguuuagccgcgaaaacucucucucgggcguggagggggagggacuucauaagcuggguuauauuuuacgagacaucucaaaaauaccgggcgggaauauguacgcugaugacacagccggaugggauacgcggaucaccgaagacgaucugcagaacgaggcuaagauuacugacaucauggaaccugagcacgccuugcucgcaaagagcauuuucaaacugacauaucagaauaagguaguuagagugcaaaggccagcgaaaaacggcaccgucauggaugugaucucccgcagagaccagcgggguaguggacaggugggaacuuacggccuaaauacauuuaccaacauggaagcccagcuuauaaggcaaauggagucugagggcauuuucagccccuccgaacuggagacaccuaaccucgcugggcguguccuggauugguuggaaaagcauggaguugagcgauuaaaacgcauggccaucucaggugacgacugugugguaaagccaaucgaugacagauuugcaacugcucugaccgcccucaaugauaugggcaaggugcggaaagacauuccccagugggaaccgaguaagggguggaacgauuggcagcaggucccuuucugcucucaccacuuucaucaacuuauaaugaaagacggaagggagaucgugguucccugucgcaaucaggaugagcuggugggcagagcacgggucagccagggugccggguggucccuaagggaaacggcgugccugggaaagucauaugcucagauguggcaacucauguacuuccaccgacgugacuugagacuggccgcaaacgccauuuguagcgcugauccaguggacuggguaccuaccucucgcacaacuugguccauccaugcccaccaucaguggaugaccacagaggauaugcuuaguguuuggaaucggguguggauugaagagaaccccuggauggaagacaaaacucacaucagcucguggggcgacgucccauaucugggcaagagggaggaucaguggugcgggucccucauaggauuaaccgcaagagcuacgugggccacaaauauccaaguggcgauuaaccagguucgccggcugaucgguaaugagaacuacuuggacuacaugaccucuaugaagagguuuaaaaaugaaucagaucccgagggcgcucugugguga

SEQ ID NO: 13858 - RNA, 9879 nt, Artificial Sequence
  derived and/or modified CDS sequence (opt3) from DENV-1__GQ868612__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacacugauugccauggaccucggcgaacugugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggaucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggccauggugcaggcagauucuggaugcgugaucaacuggaaaggccgcgaacuuaagugugguucagggaucuucgucacuaaugagguucacaccuggacggaacaauauaaguuucaggccgacaguccgaaaagauugagcgcugccauuggaaaggcaugggaggagggcgugugcgguauaagguccgcuacacggcuggaaaacaucauguggaaacagauuucuaacgagcucaaucauauccuguuagaaaacgacaugaagcugaccgugguagucggcgauguggccgggauucuuggacagggcaaaaagaugauccgcccucaacccauggaguacaaauauucguggaaaagcugggggaaggcgaagauaaucggagccgacgcucagaauacuaccuucauuaucgauggcccaaacacaccugaaugucccgacgaucagagagcauggaauauuugggagguugaggacuacgguuuugggaucuucacuaccaacauaugguugaagcucagggauuccuauacacaggugugcgaccaccgucugaugucagccgcuauuaaagauaguaaggccguccacgcagacaugggauacuggaucgaaucugagaaaaaugaaacguggaagcuagcgcgggccagccugauugaggugaagaccuguaucuggccaaaaucccauacucucuggucaaacggcguucuggaaagcgagaugauaauccccaagauuuaugguggcccuaucucucaacacaauuaccgaccaggguacuuuacacagaccgcuggaccguggcaucuuggcaaauuggagcuggauuucgacuuaugcgaagggacuacagugguagucgaugagcacugcggaaacagaggccccucccucaggaccacgacugugaccgguaagauuauccacgaaugguguugccgcaguuguacacugccuccacuucgguucagaggggaggacggaugcugguauggcauggagauaaggcccgugaaagaaaaggaggaaaaucuggucaagagcaugguuucugccgguuccggcgagguggacucauuuaguuuggggcuccuguguauuagcaucaugaucgaagagguaaugcgcucgcgauggucccggaaaaugcuaaugaccggaacucuggcaguguucuuucuccugauuaugggccagcuuacauggaacgauuugauccgucugugcauuauggucggggcuaaugccucugacagaaugggaaugggcaccacauacuuagcacucauggccacuuucaagaugaggccuauguuugcugugggucugcuuuuccgccggcugaccagcagagagguucuacuccugacgauaggguugucacugguggcgagugucgaauuaccaaacucccucgaggaacugggagauggccuugccaugggcaucaugauucugaaauugcucacagacuuucaaucucaucagcugugggcaacccuacugagccuuacuuucaucaagaccacauuuucccuccacuaugcuuggaaaacuauggccauggugcugucaauuguuagcuuguucccccuguguuuaaguaccacgucucagaagacaaccuggcucccggugcugcuugggucccugggaugcaagccuuugacuauguuucucaucgccgagaauaaaauaugggguaggaaguccuggccacugaacgaaggcaucauggcugucgggauuguaucgauccuacugucaucucuucucaaaaacgaugugccccuggcaggaccuuugauugccggcgguauguuaaucgcguguuacguuauaaguggguccagcgcugaccugucucucgagaaggccgcagaggugagcugggaagaggaagccgagcauuccggagcuucacacaauauucuggucgaagugcaggaugacggcacaaugaaaaucaaggaugaggagcgagacgauacccuuacuauccuguugaaagcaacacuacuggccguaaguggcguguauccccucagcauuccagcgacccuguucgucugguacuuuuggcaaaagaagaaacagcgcucugggguucuuugggacacgccuucacccccagaaguggagcgggcuguguuagaugacggaauauauagaaucaugcagaggggucugcucggccguagccaggucggggugggaguuuuccaagaaaacguauuccauacuauguggcacgugacccgcggcgccgucuugauguaccaggguaagcggcuggagccgaguugggcaagcgugaaaaaggaccucauuuccuacgggggaggcuggagacugaggggcucuuggaauacaggggaggaaguucaggugaucgccgucgagccuggcaaaaaucccaagaaugugcagaccgcuccagguacauuuaagacucccgaaggcgagguaggggccauugcacuugauuucaaaccuggaaccucgggcagcccaaucgucaaccgagaagguaagauaguggggcuguauggaaauggcguugugacgacaucaggcacuuacgucuccgcuaucgcccaagcgaaagccagucaggaggggcccuugccugagauugaagacgagguguuucggaagcgcaaccuaaccaucauggaucugcacccgggaucugguaaaacaagaagguaucucccagcaauuguucgggaagcuaucaagcgaaaguuaagaacccugauacuugcccccacucgcguggucgcuagcgagauggcagaagcccugaaaggcaugccuauuagguaccagaccacagccgugaaguccgagcauacggggaaagagaucguagaccucaugugccacgcuacuuucaccaugcguuugcugucaccagugcggguucccaauuauaacaugaucauuauggaugaagcgcauuuuacagacccuucuagcaucgcagccagaggauacauaaguaccagggucggcaugggugaggcugccgcaauuuucaugacugccacaccgcccggguccguggaggcuuuuccacaaagcaaugcggugauccaggaugaggaacgcgacauuccugagcgaucuuggaacucaggauaugaguggaucaccgauuuccccggcaagacggucugguuuguaccauccauaaaaaguggcaaugacauugccaacugucucagaaagaaugggaagcgggugauccagcugagcaggaaaacuuucgauacagaauaccagaagaccaaaaacaacgacugggacuacguugugaccacugauaucucggagaugggagcaaauuuucgcgcugaccgugucauugauccuagacggugccuuaagcccgugauccuaaaagacgguccagaaaggguuauucuggccggcccgaugccugugacagucgcaucugccgcucaacgccgagggagaauaggacggaaccacaauaaggagggcgaucaguauaucuacaugggucagcccuugaacaaugacgaggaucaugcccacuggaccgaagcgaagauguuacuggacaacauuaauacaccagaggggaucauccccgcacucuucgaaccugagagggaaaaauccgccgcuguggauggcgaguaucgccugagaggagaggccaggaagacuuucguagaacuuaugcggcguggcgaccugccaguguggcucagcuacaaaguugcuucagagggguuucaguauagugaucgccgauggugcuucgacggagaaagaaacaaucaagucuuggaggaaaacauggauguggagauuuggacgaaggagggugaaaggaaaaagcugcggccccgcuggcuagacgcaagaaccuacucugacccucuggcccucagggaguuuaaagaguucgcugccggccggcgauccgugagcggggaucuuauacuggagaucggaaaguuaccgcagcacuugacacagagagcacagaaugcgcuggacaaccucgucaugcugcauaauucagaacaaggcggucgcgccuauaggcacgcuauggaggagcuuccagauacuauugaaacccugaugcucuuggcccugaucgcaguuuuaacagggggcgugacccuauuuuuccugaguggacggggccucgggaagacuagcauuggacuucuguguguaauggcuuccucuguguugcuguggauggccagcgucgagccccauuggaucgcagccuccauaauccucgaauuuuuccugauggugcuucucauuccugagcccgaccgucagagaacgccacaggauaaccagcuggcuuacguugugaucgguuugcuguuuaugauuuuaaccgucgcggccaaugagaugggccuacuggaaacaacuaaaaaggaccucgggaucggacacguagcaguggagaaccaccaucacgcugccaugcuugauguugaccugcauccugccucagcauggaccuuguacgcuguggccacaaccauaauuacucccaugaugaggcacacaaucgaaaacacgaccgcgaauauuucucugacugcuaucgccaaccaagcagccauacucaugggccuggauaaagguuggccaaucaguaagauggacauuggggucccucuuuuagcucugggcugcuauagccaggugaauccgcucacauugaccgcagccguccugaugcuaguggcgcauuacgcuaucauuggacccggccugcaggccaaagcaacccgcgaggcccaaaagcggacagcugccgggaucaugaagaacccaacuguugauggaauaguggcaauugaccucgauccuguaguguaugacgcuaaauucgaaaagcagcuuggccagaucaugcuguugauccuguguacgagccagauucuccugaugcgaaccacaugggccuuaugcgaguccaucacucuugcgaccgguccccugacaacccucugggaggggucuccaggaaaauuuuggaauacuacgauagccgucucaauggcaaacauuuucagaggcagcuaccuagcuggugccggccuggcauuuuccuugaugaagagucuagggggaggcaggcgcgggacaggagcucaaggcgaaacccucggugagaaauggaagcggcagcuuaaucagcugucuaagagcgaguucaacacuuauaaaagaucagggaucauggagguugaccguuccgaagccaaggagggauugaaaaggggcgagaccacaaagcacgccgugagucgggguacugcgaaacugcgcugguucgucgaacgaaaucucgugaagccugagggcaagguaauugauuuaggguguggaagaggcggguggagcuacuauugcgcuggacugaaaaaggugaccgaaguuaaaggcuacacaaagggugggcccggacacgaggaaccgaucccaauggcaacguacggcuggaaccuugugaaacugcauucuggcaaggacgucuuuuucauaccucccgagaaaugugauacccuacucugcgacaucggggaguccucaccaaaucccacuauugaagagggaaggacacugcggguguugaagauggucgaaccuuggcugcgcgguaaccaguuuuguaucaagauucucaauccguauaugcccagcgugguugagacccuugagcaaaugcagagaaaacacggcgggaugcugguaaggaacccauuaucgcgaaauucuacucaugaaauguacugggugaguugcggaacaggcaacaucgucuccgccgugaauaugaccagccggaugcuguugaaccguuucacgauggcucacagaaagccuaccuaugagcgcgauguugaccucgguacagggacuaggcacguggccgucgaacccgagguggcaaaccuggauauuaucggacagcggauagaaaauauuaaacaugagcacaagucaaccuggcauuacgacgaggauaacccuuauaaaacaugggccuaccacggcuccuaugaaguaaagccaucuggcagcgcuaguuccauggugaaugggguugucaagcuacuuacuaaacccugggacgugaucccuauggugacccagaucgcgaugacagauaccacuccauuuggacaacagagagucuucaaggagaaaguugacacgcgcacacccaaggccaaaagggguaccgcacagauuauggaagugacugcucgauggcuguggggcuuucucagccggaacaagaagccgagaauauguaccagggaggaguucacacgcaaaguacguucuaaugccgcaaucggggccguguuugucgacgagaaccaauggaacucagcuaaggaggccguggaagaugagcgguucugggaccugguucauagagaaagggaguugcacaaacagggaaagugcgcgacgugcguguacaacaugaugggcaaacgcgaaaagaagcugggugaguuugggaaagcaaagggaagucgagccauuugguacauguggcucggcgcucgguuccuugaguuugaagcccugggcuucaugaaugaggaucacugguucuccagagaaaacagcuuaucuggggucgagggagagggucugcauaaauugggcuauauccucagggacauuucgaagaucccugggggaaauauguacgcagaugacaccgcuggcugggauacucgcauaacagaagacgaucugcagaacgaggccaaaaucaccgacauuauggaaccagagcacgcucuacuugccaaggcaaucuuuaaacugacuuaucagaauaaggugguaagaguucaacggcccgcgaagaacgguacagugauggaugucauuucaaggcgugaccagcgagggagcggacaggugggcaccuacggccucaauacauucacuaacauggaagcccagcugauccgccaaauggaguccgaggggauauuuaguccuucugaauuggagaccccaaacuuagcugaaagagcccuggauuggcucgagaaauauggaguggaacggcuuaagaggauggcaauuagcggugacgacugugucguuaaacccaucgaugaccgcuucgcuacggcccugaccgcacuaaaugauaugggcaaggugagaaaagacaucccgcagugggagccuuccaagggguggaacgauuggcagcagguacccuuuugcucacaucacuuccaccaacugauuaugaaggacggacgggagauaguggucccauguaggaaucaggaugaacucgugggccgagcccguguuagucagggugcgggguggucuuugagagagacagcuugccugggaaaaagcuacgcccagauguggcaacuuauguauuuucaucgccgggaccugaggcucgcagccaacgcuaucuguuccgccgugccugucgauugggugcccacuucaagaaccacauggagcauucacgcacaucaccaguggaugacuaccgaagacauguuaucuguauggaaucgcguuuggaucgaggaaaacccauggauggaggauaagacgcauauuuccaguugggaggacgugcccuaccugggcaaacgggaagaccaguggugcggcagcuugaucgggcugacagcuagggccaccugggcgacuaauauacaagucgcuaucaaccaggugcgaagacucauuggaaaugagaacuaccuugauuauaugacaucgaugaagcgguucaaaaaugaauccgacccugagggugcccugugguga

SEQ ID NO: 13859 - RNA, 9879 nt, Artificial Sequence
  derived and/or modified CDS sequence (opt3) from DENV-1__FJ898419__SS-prME
uccgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggaaagaccuucugguaacauuuaagaccgcucacgccaagaaacaggaaguuguggucuuggguucucaggagggggcuaugcacacagcccucacuggcgcaaccgaaauccaaacguccggaaccacaacuauuuucgccggccaucugaagugccguuuaaaaauggauaagcugacccuaaaagggaugagcuaugugauguguacaggaucguucaagcucgagaaggaagucgcugagacucagcacgguaccgugcugguucagauaaaauacgagggcacggacgcgccuugcaagaucccauuuucuacacaggaugaaaaaggggugacccaaaacggacgccuuauuacugcaaaucccaucguaacagacaaggagaaaccugucaacauagaagccgagccacccuucggcgaguccuauauugugaucggugcuggggaaaaggccuugaagcugucaugguuuaaaaagggcaguagcaucggaaaaauguucgaggcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgaacugaagugugguagugggaucuuuguuacaaaugaggugcacacuuggaccgaacaguauaaauuccaagcagacagcccgaagagacuuuccgccgcuauuggaaaagccugggaggagggcgugugcgguauaaggucugcaacgcgguuggaaaacaucauguggaagcagauuucgaacgagcugaaucauauccuccuggaaaacgacaugaaauuuacaguagucgugggcgauguugcugggauuuuagcccagggaaagaaaaugauccgcccucagcccauggaguacaaguauagcuggaaguccuggggcaaagcgaagauaaucggggccgacgugcaaaauaccacuuucauuaucgauggaccaaacaccccugaaugucccgacgaucagagagcuuggaauauuugggaggucgaggacuacggcuuugguaucuucacaacuaacauauggcugaaacuuagggauucauauacccaggugugcgaccaccguuugaugagugcagccauuaaggauucuaaagcuguucacgccgacaugggguacuggaucgaaagcgagaagaaugaaacauggaagcucgcacgggcguccuucauugaggugaaaacguguaucuggccaaagucacauacccuguggagcaacggaguacuagaaucugagaugauaauccccaaaauuuauggcgguccuaucucccagcacaauuaccgaccaggcuacuuuacucaaacagccgggccguggcaucugggaaagcucgagcuggauuucgaccuuugcgaaggcaccacugucgugguggaugagcacugcgggaacagaggacccaguuugaggacaaccacggucacuggcaaaauuauccacgaaugguguugccgcagcuguacccugccuccauuacgguuuaagggugaggacgggugcugguauggaauggagauaagacccguuaaggaaaaagaggaaaaucucgugaagucuaugguauccgcuggcucaggugagguggacaguuucagccugggccuucuguguauuucgaucaugaucgaagaggucaugaggucccgcuggucucgaaaaauguugaugacagggacccucgccguguuuuuccugcuaauuaugggacagcugacuuggaacgaucucauccggcugugcauuaugguuggcgcaaaugcuagcgaccguauggggaugggaacaaccuaccuugccuugauggcaacauuuaagaugagaccuauguucgccgugggccuguuauuuaggcgccucacuucacgggagguccugcuucugaccauaggucuaagucucguggcuuccguugaacugccaaacucuuuggaggaacugggggauggauuagcgaugggcaucaugauucucaaacugcuuacggacuuccagagccaucaacugugggccacauugcucucccugaccuuuaucaagacuaccuucucacuacacuaugcauggaagacaauggcuauggugcugagcauugucagucuuuuuccccucugucugucuacuaccucccagaaaacgacaugguugccgguacuguuaggcagccucgggugcaagccucugaccauguuccuuaucgccgagaauaaaauauggggaagaaagucguggccacugaacgaagguaucauggccgugggcauuguuucaaucuugcucucugcucugcucaagaacgaugugccccuggcagggccucuuauugccggaggcaugcucaucgcguguuacgucauaagugguuccagcgcugaccugucuuuggagaaggccgcagaggugagcugggaagaggaagccgagcauuccggggcuucacacaauauuuuaguagaagugcaggaugacggaacuaugaaaaucaaggaugaggagagggacgauacacugaccauccuccugaaggcaacucuucuggccgucaguggcguuuaucccuugagcauuccagcgacacuauucgugugguacuuuuggcagaaaaagaaacaacgaucuggcgugcugugggacaccccuucacccccagaagucgagcgcgcugugcucgaugacgggauauaucggaucaugcagagaggacugcuugguaggagccagguuggcguagggguguuccaggaaaacgucuuucauacgauguggcacgugacucguggagccguuuuaauguaccaaggcaagcgccuggagccgaguugggcaagcgugaaaaaggaccucauuuccuacggugggggauggcgguugcagggcucuuggaauaccggcgaggaaguccaggugaucgccguagagccugggaagaaccccaaaaauguccagacagcuccaggaaccuucaagacaucggaaggugaggugggcgccauugcacuggauuuuaaacccgggacuagcggaucaccuaucguuaacagagaaggcaagauagugggucucuaugggaauggagucgugaccacguccggcacauacguuagugcuaucgcccaagcgaaagccucucaggagggcccacugcccgagauugaagacgagguguucaggaagcgaaaccuuacuaucauggaucugcacccugggagcggaaagacccggcgcuauuugccggcaauugucagagaagcuaucaaaaggaagcuacggacacugauacucgccccaacccgagugguagcuuccgagauggcagaagccuuaaaagguaugcccauuagauaccagacuaccgccgugaagucagagcauacaggcaaagagaucguugaccugaugugccacgcuacguuuacuaugcgccuucugucuccugucagggugccaaauuauaacaugaucauuauggaugaagcgcauuucaccgaccccagcaguaucgcagcccguggguacauauccacacgggugggaaugggcgaggcugccgcaauuuuuaugaccgccacuccuccggguagcgucgaggcuuucccccaaucuaaugcgguaauccaggaugaggaaagagacauuccagagaggucauggaacuccggguaugaguggaucacagauuuuccuggaaagaccgugugguucguucccaguauaaagagcggcaaugacauugccaacugucuccgcaaaaauggcaagcgagugauccaguugucgagaaaaacguucgauacugaauaccagaagaccaaaaacaacgacugggacuacgucgugaccaccgauaucucugagaugggggcaaauuuucgggcugacaggguuauugauccacgccguugccugaagccugugauccucaaggacggacccgaaagagucauucuggccgguccaaugccggugacuguagcauccgccgcucaacggaggggccgcauagggcgaaaccacaauaaagagggagaucaguauaucuacaugggccagccucuuaacaaugacgaggaucaugcccacuggacagaagcgaagaugcuacuggacaacauuaauacccccgaggguaucaucccagcauuguucgaacccgagagagagaaaagcgccgcuauugauggggaguaucgguuaaggggcgaggcccgcaagacauuuguggaacugaugagaaggggagaccucccuguuuggcugucauacaaagucgcuagugagggcuuccaguauucugaucggcguuggugcuuugacggggaacgcaacaaucaagugcuugaggaaaacauggauguggagauauggacuaaggagggagaaaggaaaaagcugagaccaagauggcucgacgcacggacguacuccgaccccuuggcccugcgcgaguucaaggaauuugcugccgguagaaggagcgucucaggcgaucuaauccuggagauugggaaacucccucagcaccuuacccagcgggcacagaaugcgcuggacaacuuaguuauguugcauaauagugaacaaggaggccgagccuauagacacgcuauggaggagcugccggauacaaucgaaacucucaugcugcuugcccugauugcagugcucaccgguggguggacauuguucuuucugagcggccgcggauuaggcaagaccuccaucgggcuacuguguguaauggcuucuagcgugcuccuuuggauggccuccgucgagccacauuggauagcagccucaaucauucuggaguucuuuuugauggugcugcucauccccgagccugacaggcagcggacuccccaggauaaccagcuggcuuacguugugauuggacuucucuucaugauccugacggucgcggccaaugagauggguuugcuggaaaccaccaaaaaggacuuaggcauagggcacguagcaguggagaaccaccaucacgcugccaugcuagauguugaccugcauccagccucugcauggacucucuacgcuguggccaccacaauuaucaccccuaugaugcgucacacuauugaaaacacaacggcgaauaucagucuuaccgcuauagccaaccaagcagccauccugaugggauuggauaaaggcuggcccauuucgaagauggacaucggugucccacugcucgcucuggggugcuauagccaggugaauccucuuacuuuaacagcagccguccugaugcucguggcgcauuacgcuauuaucggcccgggauugcaggccaaggcaaccagagaggcccagaaaaggaccgcugccggcauaaugaagaaccccacaguugaugggauuguggcaaucgaccuggauccaguaguguaugacgcuaaauuugaaaagcagcuaggacagaucaugcugcucauucuuuguacuucccagauccuguugaugcgcacgaccugggcccugugcgagucuauaacacucgcgacuggcccucugaccacauuaugggaggguucacccgggaaauucuggaauaccacuauugccgucagcauggcaaacaucuuccggggauccuaccuugcuggcgccggucuggcauuuagucucaugaagucucuaggcgggggacgaagaggcacgggggcucaaggagaaacacugggcgagaaguggaaaaggcaguugaaucagcugagcaagucagaguucaacaccuauaaacgcuccgguauuauggagguugaccggagugaagccaaggaggggcucaaaagaggagagacuaccaagcacgccgugagccguggcacagcgaaacuuaggugguuugucgaacggaaucuggugaaaccagaggguaagguaaucgauuugggcugugggcgcggaggcuggucuuacuauugcgcugggcugaaaaaggugacugaaguuaaaggauacaccaagggcgguccugggcacgaggaacccauaccgauggcaacauacggauggaaccucgugaaauuacauuccggcaaggacgucuucuuuaucccaccugagaagugugauacgcugcuuugcgacauuggcgagucaagccccaauccaaccaucgaagaggggcgaacucugagagugcuaaaaauggucgaacccuggcucaggggaaaccaguucuguauuaagauccugaauccuuauaugccgucggugguugagacauuggagcaaaugcagcggaaacacgguggcaugcugguacgcaacccccucucuagaaauaguacccaugaaauguacuggguguccugcgggacuggaaacauugucagcgccgugaauaugacaucaaggaugcuucugaaccgauuuaccauggcucaccggaagccaacguaugagcgugauguugacuuaggcgccgguaccagacacguggcagucgaaccugagguggccaaccuggauaucauagggcagcgcauugaaaauaucaaacaugagcacaaguccacauggcauuacgacgaggauaaccccuauaagacuugggcuuaccacggaucuuaugaaguaaaaccuagcggcagugcguccagcauggugaauggcguugucaaguugcucaccaaaccaugggacgugauccccauggugacacagauugccaugacugauaccacaccuuucgggcaacagagggucuuuaaggagaaaguugacacccggacuccaaaggcaaagagaggaacggcucagauaauggaagugacagccaaauggcugugggguuuccuaucucgcaacaagaaacccaggaucuguacccgagaggaauuuacucggaagguaagaucaaaugcagccauuggcgcuguguucgucgacgagaaccaauggaauagugccaaagaggcgguggaagaugagagguuuugggaccuuguucaucgcgaacgugagcugcacaagcaggggaagugcgcaaccugcguguacaacaugaugggaaaacgggaaaagaaacucggcgaguucgguaaggccaaaggguccagagcuaucugguacauguggcugggagccagguucuuggaguuugaagcacugggcuucaugaaugaggaucacugguuuagccgcgaaaacucucucucgggcgucgagggggagggacuucauaagcuggguuauauuuuacgagacaucucaaaaauaccgggcgggaauauguacgcugaugacacagccggaugggauacgcggaucaccgaagacgaucugcagaacgaggcuaagauuacugacaucauggaaccugagcacgccuugcucgcaaagagcauuuucaaacugacauaucagaauaaggugguaagaguucaaaggccagcgaaaaacggcaccgugauggaugucaucucccgcagagaccagcgggguaguggacaggugggaacuuacggccuaaauacauuuaccaacauggaagcccagcuuauaaggcaaauggagucugagggcauuuucagccccuccgaacuggagacaccuaaccucgcugggcgugugcuggauugguuggaaaagcauggagucgagcgauuaaaacgcauggccaucucaggugacgacuguguugugaagccaaucgaugacagauuugcaacugcucugaccgcccucaaugauaugggcaagguacggaaagacauuccccagugggaaccgaguaagggguggaacgauuggcaacaggugccuuucugcucucaccacuuucaucaacuuauaaugaaagacggaagggagaucgucgugcccugucgcaaucaggaugagcugguuggcagagcacgggugagccagggugccggguggucccuaagggaaacggcgugccugggaaagucauaugcucagauguggcaacucauguacuuccaccgacgugacuugagacuggccgcaaacgccauuuguagcgcugucccaguggauuggguaccuaccucucgcacaacuugguccauccaugcccaccaucaguggaugaccacagaggacaugcuuaguguuuggaaucggguguggauugaagagaaccccuggauggaagauaaaacucacaucagcucguggggcgacgucccauaucugggcaagagggaggaccaguggugcgggucccucauaggauuaaccgcaagagcuacgugggccacaaauauccaaguggcgauuaaccagguucgccggcugaucgguaaugagaacuacuuggauuacaugaccucuaugaagagguuuaaaaaugaaucagaccccgagggcgcucugugguga

SEQ ID NO: 13860 - RNA, 9879 nt, Artificial Sequence
  derived and/or modified CDS sequence (opt3) from DENV-1__FJ898420__SS-prME
uccgugaccaugcugcucaugcuuaugcccacagcacuggcuuuccacuugacuacgcggggcggggaaccucauaugaucgucuccaagcaggaaaggggaaaaucuuuacuguuuaagaccucagccgguguuaauaugugcacauugauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugggagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggccauggugcaggcagauucuggaugcgugaucaacuggaaaggccgcgaacuuaagugugguucagggaucuucgucacuaaugagguucacaccuggacggaacaauauaaguuucaggccgacaguccgaaaagauugagcgcugccauuggaaaggcaugggaggagggcgugugcgguauaagguccgcuacacggcuggaaaacaucauguggaaacagauuucuaacgagcucaaucauauccuguuagaaaacgacaugaagcugaccgugguagucggcgauguggccgggauucuuggacagggcaaaaagaugauccgcccucaacccauggaguacaaauauucguggaaaagcugggggaaggcgaagauaaucggagccgacgcucagaauacuaccuucauuaucgauggcccaaacacaccugaaugucccgacgaucagagagcauggaauauuugggagguugaggacuacgguuuugggaucuucacuaccaacauaugguugaagcucagggauuccuauacacaggugugcgaccaccgucugaugucagccgcuauuaaagauaguaaggccguccacgcagacaugggauacuggaucgaaucugagaaaaaugaaacguggaagcuagcgcgggccagcuuuauugaggugaagaccuguaucuggccaaaaucccauacucuguggucaaacggcguucucgaaagcgagaugauaauccccaagauuuaugguggcccuaucucucaacacaauuaccgaccaggguacuucacacagaccgcuggaccguggcaucugggcagacuugaguuggauuucgaccugugcgaagggacuacagugguagucgaugagcacugcggaaacaggggccccuccuuacgcaccacgacugugaccgguaaaauuauccacgaaugguguugccggaguuguacacucccuccacugagauuuaggggagaagacggaugcugguauggcauggagauacgccccgugaaggaaaaagaggaaaaucuugucaagagcaugguuucugccgguuccggcgagguggacucauucagucugggguugcucuguauuagcaucaugaucgaagagguaaugcgaucgcgguggucccguaagaugcugaugaccggaacucuagcaguguuuuuccugcucauuaugggccagcugacauggaacgaucuuaucagauugugcauuauggucggggcuaaugccucugacaggaugggaaugggcaccacauaccuggcauuaauggccacuuuuaaaaugcgcccuauguucgcugugggucuccuguuucggagacuuaccagcagggagguucugcuacucacgauagggcugucauugguggcgagugucgaacugccaaacuccuuagaggaacucggagauggccuggccaugggcaucaugauucuuaagcuguugacagacuuccaaucucaucagcucugggcaacccugcuaagccugacuuuuaucaaaaccacauucucccuucacuaugcuuggaagacuauggccauggugcucucaauuguuagccuguuucccuugugucugaguaccacgucucagaaaacaaccugguuaccggugcuccuggggucccuuggaugcaagccucugacuauguucuugaucgccgagaauaagauauggggucgaaaaagcuggccacucaacgaaggcaucauggcugucgggauuguaucgauccugcuaucaucucugcuuaagaacgaugugccccucgcaggaccucugauugccggcgguauguugaucgcguguuacguuauaaguggguccagcgcugacuuaucucuggagaaagccgcagaggugagcugggaagaggaagccgagcauuccggagcuucacacaauauucucgucgaagugcaggaugacggcacaaugaagaucaaagaugaggagcgcgacgauacccugacuauccuucugaaggcaacauugcuagccguaaguggcguguauccccugagcauuccagcgacccucuuugucugguacuucuggcagaagaagaagcagcggucugggguucugugggacacgccuucacccccagaaguggagagagcugugcuugaugacggaauauauaggaucaugcagcgugguuuacugggccgcagccaggucggggugggaguuuuccaagaaaacguauuucauacuauguggcacgugacccggggcgccguccucauguaccaggguaaaagauuggagccgaguugggcaagcgugaagaaagaccugauuuccuacgggggaggcuggaggcuccgaggcucuuggaauacaggggaggaaguucaggugaucgccgucgagccuggaaagaaccccaaaaaugugcagaccgcuccagguacauucaagacucccgaaggcgagguaggggccauugcacuggauuuuaagccuggaaccucgggcagcccaaucgucaaccgggaagguaaaauaguggggcuuuauggaaauggcguugugacgacaucaggcacuuacgucuccgcuaucgcccaagcgaaggccagucaggaggggccccugccugagauugaagacgagguguuccgcaaaagaaacuugaccaucauggaucuacacccgggaucugguaagacaaggcgguaucugccagcaauuguucgagaagcuaucaaaagaaagcuccgcaccuuaauacuggcccccacuaggguggucgcuagcgagauggcagaagcccuuaagggcaugccuauucguuaccagaccacagccgugaaauccgagcauacggggaaggagaucguagaccugaugugccacgcuacuuuuaccaugcggcucuugucaccagugagaguucccaauuauaacaugaucauuauggaugaagcgcauuucacagacccuucuagcaucgcagccaggggauacauaaguacccgcgucggcaugggugaggcugccgcaauuuuuaugacugccacaccgcccggguccguggaggcuuucccacaaagcaaugcggugauccaggaugaggaacgagacauuccugagagaucuuggaacucaggauaugaguggaucaccgauuuucccggcaaaacggucugguucguaccauccauaaagaguggcaaugacauugccaacugucugcggaaaaaugggaagagggugauccagcucagccgcaagacuuuugauacagaauaccagaaaaccaagaacaacgacugggacuacguugugaccacugauaucucggagaugggagcaaauuuccgugcugacagagucauugauccucggaggugccugaaacccgugauccuuaaggacgguccagaacgcguuauucuagccggcccgaugccugugacagucgcaucugccgcucaacgaagagggcggauaggaaggaaccacaauaaagagggcgaucaguauaucuacaugggucagccccugaacaaugacgaggaucaugcccacuggaccgaagcgaagauguuguuagacaacauuaauacaccagaggggaucauccccgcacuguucgaaccugagcgcgaaaaguccgccgcuguggauggcgaguauagacucaggggagaggcccggaaaacuuuuguagaacugaugcgucgcggcgaccuuccaguguggcugagcuacaagguugcuucagagggguuccaguauagugaucgaagauggugcuuugacggagaaaggaacaaucaaguccucgaggaaaacauggauguggagauuuggacgaaagagggugaacggaagaaauugcgccccagauggcuggacgcaaggaccuacucugacccucuagcccugcgggaguucaaggaauuugcugccggccgaagauccgugagcggggaucucauacuugagaucggaaaacugccgcagcacuuaacacagcgcgcacagaaugcguuggacaaccuggucaugcuccauaauucagaacaaggcgguagggccuaucggcacgcuauggaggagcugccagauacuauugaaacccuuaugcugcucgccuugaucgcaguucugacagggggcgugaccuuauucuuucuaaguggacguggccuggggaagacuagcauuggacuccuuuguguaauggcuuccucugugcuguuguggauggccagcgucgagccccauuggaucgcagccuccauaauccuggaguucuuucucauggugcugcuuauuccugagcccgacagacagaggacgccacaggauaaccagcucgcuuacguugugaucggucuguuguucaugauucugaccgucgcggccaaugagaugggcuuacuagaaacaacuaagaaagaccuggggaucggacacguagcaguggagaaccaccaucacgcugccaugcucgauguugaccuucauccugccucagcauggacccuguacgcuguggccacaaccauaauuacucccaugaugcgccacacaaucgaaaacacgaccgcgaauauuucuuugacugcuaucgccaaccaagcagccauacugaugggccucgauaaggguuggccaaucaguaaaauggacauuggggucccucugcuugcuuuaggcugcuauucgcaagugaauccgcugacacucaccgcagccgucuugaugcugguggcgcauuacgcuaucauuggacccggccuacaggccaaggcaacccgggaggcccaaaaacgaacagcugccgggaucaugaagaacccaacuguugauggaauaguggcaauugaccuggauccuguaguguaugacgcuaaguuugaaaaacagcucggccagaucaugcuucugaucuuguguacgagccagauucugcucaugagaaccacaugggcccugugcgaguccaucacuuuagcgaccgguccccuuacaacccugugggaggggucuccaggaaaguucuggaauacuacgauagccgucucaauggcaaacauuuuuaggggcagcuaccucgcuggugccggccuagcauucucccugaugaaaagucuagggggaggccgccgggggacaggagcucaaggcgaaacccugggugagaaguggaaaagacagcucaaucagcuuucuaagagcgaguucaacacuuauaagcguucagggaucauggagguugacagguccgaagccaaagagggacugaagcggggcgagaccacaaaacacgccgugagucgcgguacugcgaaguugcgaugguuugucgaaagaaaucuggugaaaccugagggcaagguaauugaucucggguguggaaggggcggguggagcuacuauugcgcuggauuaaagaaagugaccgaaguuaagggcuacacaaaaggugggcccggacacgaggaaccgaucccaauggcaacguacggcuggaaccuggugaaacuucauucuggcaaagacgucuucuuuauaccucccgagaagugugauacccugcuaugcgacaucggggaguccucaccaaaucccacuauugaagagggacggacacuccgcgugcugaaaauggucgaaccuugguugagagguaaccaguucuguaucaagauucugaauccguauaugcccagcgugguugagacccucgagcaaaugcagaggaagcacggcgggaugcuuguacgaaacccacugucgagaaauucuacucaugaaauguacugggugaguugcggaacaggcaacaucgucuccgccgugaauaugaccagccguauguuacugaacagauuuacgauggcucaccgcaaaccuaccuaugagagggauguugacuuggguacagggacucggcacguggccgucgaacccgagguggcaaaccucgauauuaucggacagagaauagaaaauauuaagcaugagcacaaaucaaccuggcauuacgacgaggauaacccuuauaagacaugggccuaccacggcuccuaugaaguaaaaccaucuggcagcgcuaguuccauggugaaugggguugucaagcugcuaacuaagcccugggacgugaucccuauggugacccagaucgcgaugacagauaccacuccauucggacaacagcgcgucuuuaaagagaagguugacacgaggacacccaaagccaagcgagguaccgcacagauuauggaagugacugcucgguggcuuuggggcuuccugagcagaaacaaaaagccgaggauauguacccgcgaggaauuuacacguaagguacggucuaaugccgcaaucggggccguguucgucgacgagaaccaauggaacucagcuaaagaggccguggaagaugagagauuuugggaccucguucauagggaacgcgagcugcacaagcagggaaaaugcgcgacgugcguguacaacaugaugggcaagcgagagaagaaguugggugaguucgggaaggcaaaaggaagucgggccauuugguacauguggcugggcgcuagauuucucgaguucgaagcccuuggcuucaugaaugaggaucacugguuuuccagggaaaacagccugucuggggucgagggagaggguuuacauaagcugggcuauaucuugcgcgacauuucgaaaaucccugggggaaauauguacgcagaugacaccgcuggcugggauacuagaauaacagaagacgaucuccagaacgaggccaagaucaccgacauuauggaaccagagcacgcucugcuagccaaagcaaucuucaaacuuacuuaucagaauaaagugguacggguucaaaggcccgcgaagaacgguacagugauggaugucauuucacgucgagaccagcgcgggagcggacaggugggcaccuacggccugaauacauuuacuaacauggaagcccagcucaucagacaaauggaguccgaggggauauucaguccuucugaacuggagaccccaaacuuggcugaacgggccuuagauuggcuggagaaguauggaguggaaaggcucaaacgcauggcaauuagcggugacgacugugucguuaagcccaucgaugacagauuugcuacggcccuuaccgcacugaaugauaugggcaaagugcggaaggacaucccgcagugggagccuuccaaaggguggaacgauuggcagcagguacccuucugcucacaucacuuucaccaacuaauuaugaaggacggaagggagauaguggucccaugucgaaaucaggaugaacuggugggccgugccagaguuagucagggugcgggguggucucuccgcgagacagcuugcuugggaaagagcuacgcccagauguggcaacugauguauuuccauaaacgggaccuuaggcuggcagccaacgcuaucuguuccgccgugccugucgauugggugcccacuucaagaaccacauggagcauucacgcacaucaccaguggaugacuaccgaagacaugcucucuguauggaaucgcguuuggaucgaggaaaacccauggauggaggauaagacgcauauuuccaguugggaggacgugcccuacuuaggcaaacgggaagaccaguggugcggcagccugaucggguugacagcuagggccaccugggcgacuaauauacaagucgcuaucaaccaggugcgaagacugauuggaaaugagaacuaccucgauuauaugacaucgaugaagcgguuuaaaaaugaauccgacccugagggugcccuuugguga

SEQ ID NO: 13861 - RNA, 9879 nt, Artificial Sequence
  derived and/or modified CDS sequence (opt3) from DENV-1__FJ898421__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggagaacugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucagcauuucgaucaugaucgaagaggugaugcgcucccgauggucucggaaaaugcugaugaccggaacucuagccgucuuuuuccugcucauuaugggccagcugacauggaacgaucuuauccguuuguguauuauggugggggcaaaugcuagcgacagaaugggaaugggcaccacauaccuggccuuaauggcaacuuuuaagaugaggccuauguucgccguuggucuccuguuucgccggcuuaccucaagagaggugcugcuacucacgauagggcugaguuuggucgcuuccguggaacugccaaacucuuuagaggaacucggagauggccuggcgaugggcaucaugauucuuaaacuguugacagacuuccaaagccaucagcucugggccacccugcuaucccugacuuuuaucaagaccacauucucacuucacuaugcauggaaaacuauggcuaugguucucagcauugugagucuguuucccuugugccugucuaccacgucccagaagacaaccugguuaccgguccuccuggggagccuuggauguaagccucugacuauguucuugaucgccgagaauaaaauaugggguaggaagucguggccacucaacgaaggcaucauggccguagggauugugucaauccugcuaucuagucugcuuaaaaacgauguuccccucgcuggaccucugauugcaggcgguauguugaucgccugcuacgugauauccgggagcucugcggacuuaagccuggagaaggcugccgaggucuccugggaagaggaagcagagcauucaggagccagucacaauauucucguggaaguacaggaugacggcacaaugaaaaucaaggaugaggagcgagacgauacccugacuauccuucugaaagcuacauugcuagcagugagcggcgucuauccccugucuauuccagccacccucuuuguuugguacuucuggcaaaagaagaaacagcgcuccggggugcugugggacacgccuucacccccagaaguggagcgggcgguccuugaugacggaauauauagaaucaugcagagggguuuacugggccguagucagguggggguuggaguauuccaagaaaacguguuucauacuauguggcacgucacccgcggcgcugugcucauguaccaggguaagcgguuggagccgagcugggccuccguuaaaaaggaccugauuucuuacgggggaggcuggagacucaggggcucguggaauacaggggaggaagugcaggucaucgcaguggagccuggcaaaaaccccaagaauguacagaccgccccagguacauucaagacucccgaaggcgaggucggggcuauugcccuggauuuuaaaccuggaaccagcggcucaccaaucgugaaccgagaagguaagauaguugggcuuuauggaaauggcguggucacgacauccggcacuuacgugagugcaaucgcucaagccaaagcgucucaggaggggccccugccugagauugaagacgagguuuuccggaagcgcaacuugaccaucauggaucuacacccgggaagcgguaaaacaagaagguaucugccagccauugugcgggaagcaaucaagcgaaagcucagaaccuuaauacuggcucccacucgcgucguggccuccgagauggcugaagcacuuaaaggcaugccuauuagguaccagaccacagccguaaagucagagcauacggggaaagagaucguggaccugaugugucacgccacuuuuaccaugcgucucuugucuccaguucggguccccaauuauaacaugaucauuauggaugaagcucauuucacagacccuagcaguaucgcggcaagaggauacauauccaccagggugggcaugggugaggccgcugccauuuuuaugacugcaacaccgcccgggagcguggaagccuucccacaaucuaaugcugucauccaggaugaggaacgcgacauuccugagcgaucauggaacuccggauaugaguggaucaccgauuuucccggcaagacgguaugguucgugccaaguauaaaaagcggcaaugacauugcgaacugccugagaaagaaugggaagcggguuauccagcucucgaggaaaacuuuugauacagaauaccagaagaccaaaaacaacgacugggacuacguggucaccacugauaucucugagaugggagccaauuuccgcgcagaccgugugauugauccuagacggugucugaagcccguuauccuuaaagacgguccagaaagggugauucuagcuggcccgaugccugucacaguggccuccgcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggagaaaagcgcagccguagauggcgaguaucgccucagaggagaggcuaggaagacuuuuguggaacugaugcggcguggcgaccuuccaguuuggcugucauacaaagucgccagugagggguuccaguauucugaucgccgauggugcuuugacggagaaagaaacaaucaagugcucgaggaaaacauggauguggagauuuggacgaaggagggugaaaggaaaaaguugcggccccgcuggcuggacgcuagaaccuacuccgacccucuagcacugagggaguucaaagaauuugccgcuggccggcgaagcgucucaggggaucucauacuugagaucggaaagcugccgcagcacuuaacacagagagcccagaaugcauuggacaaccugguuaugcuccauaauagugaacaaggcggucgcgcguauaggcacgccauggaggagcugccagauacuauugaaacccuuaugcugcucgcuuugaucgccgugcugacagggggcguaaccuuauucuuucuaagcggacggggccuggggaagacuuccauuggacuccuuugcgugauggcaucuagcguccuguuguggauggcuuccguggagccccauuggaucgccgcaucaauaauccuggaguucuuucucaugguucugcuuauuccugagcccgaccgucagagaacgccacaggauaaccagcucgccuacguggucaucggucuguuguucaugauucugaccguagcugcgaaugagaugggcuuacuagaaacaacuaaaaaggaccuggggaucggacacguggccguugagaaccaccaucacgcagcuaugcucgauguggaccuucauccugccucugccuggacccuguacgcagucgcuacaaccauaauuacucccaugaugaggcacacaaucgaaaacacgaccgccaauauuaguuugacugcgaucgcuaaccaagccgcaauacugaugggccucgauaaagguuggccaaucucgaagauggacauuggggugccucugcuugccuuaggcuguuauagccaggucaauccgcugacacucaccgcugcaguguugaugcugguugcccauuacgcgaucauuggacccggccuacaggcuaaagccacccgcgaggcacaaaagcggacagccgcugggaucaugaagaacccaacuguggauggaauaguagccauugaccuggauccuguggucuaugacgcaaaauuugaaaagcagcucggccagaucaugcuucugaucuugugcacgucccagauucugcucaugcgaaccacaugggcucugugugagucuaucacuuuagccaccgguccccuuacaacccugugggaggggucaccaggaaaauucuggaauacuacgauagcgguuagcauggccaacauuuuuagaggcuccuaccucgcaggagcuggccuagccuucagucugaugaagucucuaggggguggcaggcgcgggacaggagcacaaggcgaaacccugggugagaaauggaagcggcagcucaaucagcuuagcaagucagaguucaacacuuauaaaagauccgggaucauggagguggaccguagugaagcuaaggagggacugaaaaggggcgagaccacaaagcacgccgucagccgggguacugccaaauugcgcugguuuguggaacgaaaucugguaaagccugagggcaaggugauugaucucgggugcggaagaggcggguggucuuacuauugugcgggacuaaagaagguuaccgaagugaaaggcuacacaaagggugggcccggacacgaggaaccgaucccaauggcuacguacggcuggaaccuggucaaacuucauuccggcaaggacguguucuuuauaccucccgagaaaugcgauacccugcuaugugacaucggggagucaagcccaaaucccacuauugaagagggaaggacacuccggguccugaagaugguggaaccuugguugcgcgguaaccaguucugcaucaagauucugaauccguauaugcccucgguuguagagacccucgagcaaaugcagagaaaacacggcgggaugcuugugaggaacccacugucucgaaauaguacucaugaaauguacugggucuccuguggaacaggcaacaucgugagcgcaguuaauaugaccucacggauguuacugaaccguuuuacgauggcccacagaaagccuaccuaugagcgcgauguggacuuggguacagggacuaggcacgucgcuguggaacccgagguagccaaccucgauauuaucggacagcggauagaaaauauuaaacaugagcacaaguccaccuggcauuacgacgaggauaacccuuauaaaacaugggcauaccacggcucuuaugaagugaagccaagcggcagugccuccagcaugguuaauggggucgugaagcugcuaacuaaacccugggacgugaucccuauggucacccagaucgcuaugacagauaccacuccauucggacaacagagaguuuuuaaggagaaaguggacacgcgcacacccaaggcgaaaagggguaccgcccagauuauggaaguaacugcacgauggcuuuggggcuuccugucucggaacaagaagccgagaauaugcaccagggaggaauuuacacgcaaagugcguucaaaugcugccaucggggcagucuucguggacgagaaccaauggaauagugccaaggaggcuguugaagaugagcgguuuugggaccucgugcauagagaaagggagcugcacaaacagggaaagugugccacgugcgucuacaacaugaugggcaaacgcgaaaagaaguugggugaguucgggaaagcgaagggaucccgagcaauuugguacauguggcugggcgcccgguuucucgaguucgaagcucuuggcuucaugaaugaggaucacugguuuagcagagaaaacucucugucggggguggagggagaggguuuacauaaacugggcuauaucuugagggacauuucaaagaucccugggggaaauauguacgccgaugacaccgcaggcugggauacucgcauaacagaagacgaucuccagaacgaggcuaaaaucaccgacauuauggaaccagagcacgcccugcuagcuaaggccaucuucaaacuuacuuaucagaauaagguaguuagagugcaacggcccgcaaagaacgguacagucauggaugugauuagcaggcgugaccagcgaggguccggacaggugggcaccuacggccugaauacauuuacuaacauggaagcgcagcucauccgccaaauggagagugaggggauauucucuccuagcgaacuggagaccccaaacuuggccgaaagagcuuuagauuggcuggagaaauauggagucgaacggcucaagaggauggccauuuccggugacgacugcguugugaaacccaucgaugaccgcuuugcaacggcucuuaccgcccugaaugauaugggcaagguaagaaaagacaucccgcagugggagccuucaaagggguggaacgauuggcaacaggugcccuucuguagucaucacuuucaccaacuaauuaugaaggacggacgggagauagucgugccaugcaggaaucaggaugaacugguuggccgagcacgugugucucagggugccggguggagccucagagagacagcguguuugggaaaauccuacgcucagauguggcaacugauguauuuccaucgccgggaccuuaggcuggccgcaaacgccaucugcucagcugucccuguggauuggguacccacuagcagaaccacauggucuauucacgcccaucaccaguggaugacuaccgaagacaugcucuccguuuggaaucgcguguggaucgaggaaaacccauggauggaggauaagacgcauauuaguagcugggaggacguccccuacuuaggcaaacgggaagaccagugguguggcucgcugaucggguugacagcaagggcuaccugggccacuaauauacaaguggcgaucaaccagguucgaagacugauuggaaaugagaacuaccucgauuauaugacauccaugaagcgguuuaaaaaugaaucugguccugagggcgcucuuugguga

SEQ ID NO: 13862 - RNA, 9879 nt, Artificial Sequence
  derived and/or modified CDS sequence (opt3) from DENV-1__FJ898423__SS-prME
agcgugacaaugcugcucaugcuuaugcccacagcacuggcuuuccacuugacuacgagaggaggggaaccucauaugaucgucuccaagcaggaaagggggaaaucuuuacuguuuaagaccucagccgguguuaacaugugcacacuaauugccauggaccucggagaacugugugaagauacuaugaccuacaaaugcccacggauaacagaaguggaaccggacgauguagacuguuggugcaauaccacugauacaugggugaccuaugggacguguagucaaacuggagaacaccgccgagacaagcguagcgucgcgcuugcuccccaugugggccuggguuuggagaccagagccgaaacauggauguccucugagggggcauggaaacagauccagaagguugaaacuugggcccucaggcacccuggauucaccgugauugcucuguuucuggcacaugccaucggcacaucgauuacccagaagggcaucauauucauccucuuaaugcuggucacgccaucaauggcuaugcggugcguggggauuggaagccgcgauuuuguagagggucuuaguggcgccacuuggguugacguggucuuggagcacggguccugugugacaaccauggcgaaagauaagcccacucuggacaucgaacuacucaaaacagaggugaccaacccugcaguccugagaaaacuuugcauugaagccaaaaucucuaauacgaccacagauagcagauguccaacucaaggagaggcuacccugguugaagaacaggacgccaacuucgugugccggcgcacauuuguagaucgaggcugggguaauggguguggauuguucggcaagggcucccucauaacuugcgcaaaguuuaaaugcgugaccaagcuggaggggaaaauuauccaguacgaaaacuuaaaguauucagucauugugacaguucacaccggagaccagcaucaaguggguaaugagaguacugaacacggcacgaucgcuacaaucacaccccaggccccuacuagcgagauucagcugaccgacuacggggcgcucacacuugauuguucuccaagaaccggacuggacuucaacgaaauggucuugcuaacuaugaaagagaaguccuggcuggugcauaaacagugguuucucgaucugccgcuucccuggacaucaggcgccagcacgagucaagagaccuggaauaggcaggaccuguugguaacuuucaagacagcacacgcuaagaaacaggaaguugugguccucgguucucaagagggggccaugcacaccgcucugacaggcgccacugaaauacagaccacgggaaccacaacuaucuuugcaggccauuuaaagugccggcugaaaauggauaagcuaacccucaaagggauguccuaugugauguguacaggcagcuucaagcuggagaaggaagucgccgagacucagcacgguaccgugcuuguucagauuaaauacgagggcacggacgcuccuugcaagaucccauucucgacacaagaugaaaaaggggugacccagaacggacguuugauaacugcgaaucccauuguaacagacaaggagaaaccugucaacaucgaagcagagccacccuuuggcgagucuuauaucgugauuggugccggggaaaaggcucugaagcucuccugguucaaaaagggcucaaguaucggaaaaauguuugaggccaccgcacgcggcgccagaaggauggcuauucugggggauacugccugggacuucggaagcauagguggcguuuuuaccuccguggggaaacuuguccaucagaucuucggaacagcauacggcgugcuguuuucugguguaagcuggacgaugaaaauugggaucggcguguugcucaccuggcugggauuaaauucacggaguacuucccugagcaugacauguaucgcgguuggccuaauuacccucuaccugggggucauggugcaggcugauucuggaugcgugauaaacuggaagggccgagaacuuaagugugguucagggaucuucgucacaaaugagguucacacuuggaccgaacaauauaaauuucaggccgacaguccgaagcgcuugagcgcagccauuggaaaggcuugggaggagggcgugugcgguaucagauccgccacgaggcuggaaaacauuauguggcggcagaucucuaacgagcucaaucauauacuguuagaaaacgacaugaaguucacagugguagucggcgaugugguugggauccuggcacagggcaagaagauggugcgcccucaacccauggagcacaaauacucguggaaaagcuggggcaaggcuaagauuaucggggccgacguccagaauaccacuuuuauuaucgauggaccaaacaccccugaaugucccgacgaucagagagcguggaauauaugggagguggaggacuauggcuucgguauuuuuacaacuaacaucuggcuuaaguugagggauuccuacacccagguuugcgaccaccgucucaugucagccgcuauuaaagauaguaaggcagugcaugccgacaugggguauuggaucgaaucugagaaaaaugaaacauggaagcuggcucgggccagcuucauagagguaaagacguguaucuggccaaaaucccacacccuauggucaaacggaguccuggaaagcgagaugauuauccccaagauuuacggcgguccuaucucucaacauaauuaucgaccaggcuacuucacucagacagcagggccguggcaccucggaaaacuggagcuugauuuugacuugugcgaaggcaccacugugguggucgaugagcacugcgggaacagaggacccucccugaggacaaccacgguuacuggcaagauaauucaugaaugguguugccgcaguuguaccuuaccuccacuccgguucaaaggugaggacgggugcugguacggaauggagaucagacccgugaaggaaaaggaggaaaaucugguaaaaagcauggugucugcgggcuccggugaggucgacucauuuagucuuggccuguuguguaucagcauuaugaucgaagaggugaugaggucgcgcuggucccgaaagaugcucaugacagggacccuggccguuuucuuucuacugauuaugggacagcucacuuggaacgaucugauacggucuugcaucauggugggcgcuaaugccagcgaccguauggggaugggaacaaccuaucuugcauugauggcuacauucaaaaugagaccuauguuugccgucggccuguuauucaggcgccucacuucacgggaggugcugcuucugaccauuggucuaagucucguugcauccguggaacugccaaacucuuuggaggaacugggggauggauuagccaugggcaucaugauucucaagcugcuuacggacuuucaaagcuaccagcugugggcuacauugcucucccugaccuucaucaaaacuaccuuuucacuacacuaugcguggaagacaauggccaugguccugagcauaguaagucuucucccccuguguuugucuacuaccucccagaagacgacauggcugccgguguuacucggcagccuggggugcaaaccucuuaccauguuccugaucgcagagaauaagauuuggggaagaaaaucguggccauugaacgaagguaucauggcuguuggcauugugucaauccuccugucuagucuacugaagaacgaugucccccuugccgggccucucauagccggaggcaugcugauugcuuguuacgugaucuccgguagcucugcagacuugagcuuagagaaagccgcggagguauccugggaagaggaagcugagcauucaggggccagucacaauauccugguggaaguccaggaugacggaacuaugaagauuaaagaugaggagagggacgauacacucaccauacugcuuaaggcaacucuguuggccguuagcggcguguauccccuaucuaucccagcuacacuguuugugugguacuucuggcaaaagaaaaagcagcgauccggcguccucugggacaccccuucacccccagaaguggagcgcgcaguucuggaugacgggauuuaucggaucaugcagagaggacuuuuagguaggagucagguaggcgugggggucuuccaagaaaacguguuucauacgauguggcacguuacucguggagccgugcugauguaccagggcaaacgccucgagccgagcugggcguccgucaagaaagacuugauuucuuacggugggggauggcggcugcagggcucguggaauaccggcgaggaagugcagguaaucgcugucgagccugggaagaaccccaagaaugugcaaacagccccaggaaccuucaaaacacccgaaggugagguuggcgcaauagcccucgauuuuaagccugggacuagcggaucaccaaucgugaacagagaaggcaaaauugucggucuguaugggaauggagugguuaccacguccggcacauacgugagugcuaucgcccaggcaaaggcuucucaggagggcccccuuccugagauugaagacgaggucuucaggaaacgaaaccugacuaucauggauuugcacccggggagcggaaagacccggcgcuaucuaccagccauagugagagaagcgauuaagaggaaacugcggacacucaucuuagcccccacccgaguaguggcauccgagauggcugaagcccugaaggguaugccuaucagauaccaaacuaccgcuguuaaaucagagcauacaggccgcgagauugucgaccuuaugugccacgcaacguuuacuaugaggcugcucucuccagugcgugugcccaauuauaacaugaucauaauggaugaagcccauuucaccgacccuagcaguauugccgcucggggguacaucuccacaagagucggaaugggcgaggcggcagccauuuuuaugaccgcuacuccgcccgguagcguagaagccuucccacagucuaaugcagugauccaggaugaggaaagggacauaccugagcgcucauggaacuccggguaugaguggauuacagauuuucccggaaagaccguuugguucgugccaaguaucaaaagcggcaaugacaucgccaacuguuugcgaaagaauggcaagagagucauucagcugucgcggaaaacguuugauacugaauaccaaaagaccaagaacaacgacugggacuacgugguuaccaccgauaucucugagaugggggcuaauuucagggcggaccgcgugauugauccucguagaugccucaagcccgucauacugaaagacggaccagaacgggugauccuugccgguccgaugccuguaacuguggcauccgcugcccagaggcgcggccgaauugggagaaaccacaauaaggagggagaucaguauaucuacaugggccagccccuaaacaaugacgaggaucaugcacacuggacagaagccaagaugcuguuggacaacaucaauaccccagaggguauuauacccgcuuuauucgaaccugagcgggagaaaagcgccgcgaucgauggggaguauaggcugcgcggcgaggcaagaaagacauuuguugaacucaugaggcggggagaccugccagucuggcuuucauacaaaguggccagugagggcuuccaauauucugaucgucgcuggugcuuugacggggaacgaaacaaucaggugcuggaggaaaacauggaugucgagauuuggacuaaggagggagaaaggaaaaagcucaggccccggugguuggacgcucgcacguacuccgacccucuggcccuaagagaguucaaagaauuugcugcagguaggcggagcguuucaggcgaucugauccucgagauugggaaacuuccgcagcaccugacccagcgagcccaaaaugcuuuagacaacuuggugaugcugcauaauagugaacagggaggcagagccuaucgccacgcaauggaggagcucccagauacaaucgaaacucugaugcuucuggcgcucauagccguauugaccgguggggugacacuguucuuuuuaagcggcaggggacuaggcaagaccuccaucgggcugcucugugucauggcuucuagcgcccuucuguggauggcauccguggagccccauuggauugcugccucaaucauuuuggaguucuuucugaugguucuccugaucccugagcccgaccggcagcguacuccacaggauaaccaacuugcauacguggucauaggacuccuguucaugauuuugacgguagccgcuaaugagaugggucuguuagaaaccaccaaaaaggaccuaggcaucgggcacguggcgguugagaaccaccaucacgccacuaugcuggauguggaccuccauccugcaucugcuuggacccuuuacgccgucgccacaaccauuaucacucccaugaugagacacacaauagaaaacacgaccgcaaauaucagucugacugcuauugccaaccaggcggcuaucuugaugggacuggauaaaggcuggccaauuucgaagauggacaucggugugccucuccuggcccuugggugcuauagccaggucaauccguuaacacugaccgcagccgugcucauguugguugcucauuacgcaauaauuggccccggacugcaagccaaagcgaccagggaggcucagaagcgcacagccgcaggcaucaugaagaacccaacuguggaugggaucguagccauugaccuagauccuguggucuaugacgcuaaauuugaaaagcagcugggacagaucaugcuccuuauacuguguacgucccaaauuuugcugaugcggaccacaugggcccucugcgagucuaucacucuggcaaccggccccuuaacaacccuuugggaggguucaccagggaaauucuggaauacuacgauugcuguuagcauggccaacaucuuucgaggauccuaccuggcgggcgccggucucgcauucagucuaaugaagucucugggcgggggaagaaggggcacaggggcucagggagaaaccuugggcgagaaauggaagcgccagcugaaucagcucagcaagucagaguucaacacuuauaaacgguccgguauaauggagguggacagaagugaagccaaggaggggcuucguaggggagagaccacaaaacacgcagucagccggggcacugcuaagcugcgcugguuuguggaacgaaauuugguaaaaccugaggguaaggugaucgaucugggcugugggagaggaggcuggucuuacuauugcgccgggcucaagaaaguuaccgaagugaagggauacacaaaaggcggucccgggcacgaggaaccgauuccaauggccacguacggauggaacuuagucaagcugcauuccggcaaagacguguucuuuaucccucccgagaagugugauacccuucugugcgacauuggcgagucaagcccaaaucccacuaucgaagaggggaggacacuacggguccucaaaaugguggaaccuuggcugcgcggaaaccaauucuguauuaagaucuugaauccguauaugcccucgguuguagagacccuggagcacaugcagagaaagcaugguggcaugcucgugaggaacccacuuucucgaaauaguacucacgaaauguacugggucuccugcgggacaggaaacauagugagcgcgguuaauaugaccucacggaugcuguuaaaccguuuuacgauggcucacagaaaaccuaccuaugagcgcgauguggaccugggcgcagguacaaggcaugucgccguggaacccgagguagcuaacuuggauauuaucgggcagcggaucgaaaauauuaagcacgagcauaaauccacuuggcacuacgacgaggauaacccuuauaagaccugggccuaccauggaucuuaugaagugaaaccaagcggcagugcauccagcaugguuaauggcgucgugaagcuccugacaaagcccugggacgugauaccuauggucacucagaucgccaugaccgauacaaccccauucgggcaacagagaguuuuuaaagagaagguggacacucgcacgcccaaagcuaagaggggaacagcgcagauuauggaaguaaccgcccgauggcuaugggguuuccuuucucggaacaaaaagccgagaaucuguacuagggaggaauuuacccgcaaggugcguucaaaugcagcuauuggcgccgucuucguggacgagaaccaauggaauagugcaaaagaggccguugaagaugagcgguuuugggaccuggugcacagagaaagggagcuccacaagcaggggaaaugcgcuacaugcgucuacaacaugaugggaaagcgcgagaaaaagcugggcgaguucgguaaggccaaagggucccgagcgaucugguacaugugguugggagcacgguuucuggaguucgaagcccucggcuucaugaaugaggaucauugguuuagcagagaaaacucucuuucgggcguggagggggagggacugcacaaguuagguuauauacugagggacaucucaaaaauuccuggcgggaauauguacgcugaugacacggccggaugggauacccgcaucacugaagacgauuugcagaacgaggcaaagauuacagacaucauggaaccagagcaugcucuccuggccaccagcauauucaaacuaacuuaucagaauaagguaguuagagugcaacggcccgcuaaaaacggcacagucauggaugugauuuccaggcgugaccagcgagguaguggacaggugggaaccuacggccuuaauacauuuacuaacauggaagcccagcugauccgccaaauggagucugagggcaucuucagcccuuccgaacucgagaccccaaaccuggcagaaagagucuuggauugguuagagaaguaugggguugaacggcugaagaggauggcgauuucaggagacgacugugugguaaaacccauagaugaccgcuuugccacggcucucaccgcccuuaaugauauggguaaggugagaaaagacaucccgcagugggagccuaguaagggcuggaacgauuggcagcagguccccuucugcucucaccacuuucaucaacugauuaugaaagacgggcgggagaucgugguuccauguaggaaucaggaugagcuagugggacgagcacgugucagccagggcgcugguuggucccugagagagacagccugccucgggaagucauacgcacagauguggcaauugauguauuuccaccgccgggaccugaggcuugccgcgaacgcuauuuguagcgccgugccuguagauuggguucccacuucuagaaccacaugguccauccaugcacaccaucaguggaugacuaccgaagacaugcugaguguguggaaucgcgucuggauagaggaaaacccauggauggaggauaagacgcacaucagcucguggggagacgugcccuaccucggcaaacgggaggaccaguggugcggcuccuuaauugggcugacagccagggcuaccugggccacuaauauccaaguugcaauuaaccaggugcgaagauugaucggaaaugaaaacuaccuggauuauaugacaucuaugaagcgguuuaaaaaugagucagacccugaaggugcucucugguga

SEQ ID NO: 13863 - RNA, 9879 nt, Artificial Sequence
  derived and/or modified CDS sequence (opt3) from DENV-1__FJ898424__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucaacagguguuaacaugugcacucuaauugcaauggaccucggcgagcugugugaagauaccaugacauacaaaugcccacggauaaccgagguggaaccggacgauguagacuguuggugcaauacuacagauaccugggugacguaugggacuuguagucaaaccggagagcaccgccgagacaagcguagcgucgcccuugcgccccaugugggccuggguuuggagacaagagcugaaacuuggauguccucugagggggccuggaaacagauccagaagguugaaaccugggcacucaggcacccuggauucacagugauugcccuguuucuggcucaugcaaucggcaccucgauuacgcagaagggcaucauauucauccucuuaaugcuggucacuccaucaauggccaugcggugcguggggauuggaagccgcgauuuuguagagggucuuaguggcgcuacauggguugacguggucuuggagcacggguccugugugaccacuauggccaaagauaagcccacacuggacaucgaacuacucaaaaccgaggugacgaacccugcgguccugagaaagcuuugcauugaagcaaaaaucucuaauaccacaacugauagcagguguccaacccaaggagaggccacacugguugaagagcaggacgcuaacuucgugugccggcgcacuuuuguagaucgaggcugggguaauggguguggauuguucggcaagggcucccucauaaccugcgccaaguuuaaaugcgugacaaagcuggaggggaaaauuguccaguacgaaaacuuaaaguauucagugaucguuaccgugcacacuggagaccagcaucaagucgguaaugagaguacggaacacggcacaaccgcaacuauuaccccccaggcuccuacaagcgagauccagcugaccgacuacggggcccucacucuugauuguucuccaagaacaggacuggacuucaacgaaaugguguugcuaacgaugaaagagaaguccuggcugguacauaaacagugguuucucgaucugccgcuucccuggaccucaggcgcgagcacuagucaagagacauggaauaggcaggaccuguugguuaccuucaagacagcccacgcaaagaaacaggaaguggucgugcucgguucucaagagggggcuaugcacacugcccugaccggcgcuacggaaauccagaccuccggaacaacuaccauuuuugccggccauuuaaagugccggcugaaaauggauaagcuaacacucaaagggaugagcuaugucauguguacuggaucguucaagcuggagaaggaaguggcagagacccagcacgguacgguucuugugcagauaaaauacgagggcacagacgccccuugcaagaucccauucucuacccaagaugaaaaagggguaacucagaacggacguuugauuacagcuaaucccaucgucaccgacaaggagaaaccugugaacauagaagcggagccacccuuuggcgaguccuauauuguuaucggugcaggggaaaaggcccugaagcucucaugguucaaaaagggcaguagcaucggaaaaauguuugaggcuacugcccgcggcgcaagaaggauggccauucugggggauaccgcuugggacuucggauccaucgguggcguguuuacaucugucgggaagcuugugcaucagauuuucggaacggccuacggcguacuguuuagcggugugucauggaccaugaaaauagggaucggcguuuugcucacuuggcugggauuaaauagucgguccacaagccugucuaugaccuguauugcagucggccuagugacacucuaccugggggugaugguccaggcggauucaggaugcguuaucaacuggaagggccgagaacuuaagugugguagugggaucuucgugacuaaugaggugcacaccuggacggaacaauauaaauuucaggcugacagcccgaagcgcuuguccgccgcaauuggaaaagccugggaggagggcguaugcgguauaagaucugcuacaaggcuggaaaacaucauguggcggcagauuucgaacgagcucaaucauauccuguuagaaaacgacaugaaguucaccgucgugguuggcgauguggucgggauucuggcccagggaaaaaagaugauccgcccucaacccauggagcacaaauacagcuggaaguccuggggcaaggcaaaaauaaucggggcugacgugcagaauacuaccuuuauuaucgauggaccaaacacaccugaaugucccgacgaucagagagccuggaauauuugggagguugaggacuauggcuucgguaucuuuacuaccaacauauggcuuaaguugagggauucauacacacaggugugcgaccaccgucucaugagugcggccauuaaagauucuaaggcuguacaugcagacaugggguauuggaucgaaagcgagaaaaaugaaacguggaagcuggcccgggcuuccuucauugaggucaagaccuguaucuggccaaaaucacacacucuauggagcaacggagugcuggaaucugagaugauaauccccaagauuuacggcgguccuaucucccaacauaauuaucgaccaggcuacuucacacagaccgccgggccguggcaccucggaaaacuggagcuugauuuugacuugugcgaaggcacuacaguggucguugaugagcacugcgggaacagaggacccagucugaggaccacgacugugaccggcaagauuauccaugaaugguguugccgcagcuguacauuaccuccacuccgguucaaaggugaggacgggugcugguacggaauggagauaagacccguaaaggaaaaggaggaaaaucuggugaaaucuauggucuccgcaggcucaggugagguggacaguuuuagccuuggccuguuguguauuucgaucaugaucgaagagguuaugaggucccgcuggucucgaaagaugcucaugaccgggacucuggcgguguucuuucuacugauuaugggacagcucacauggaacgaucugauccggagcugcauuauggucggcgccaaugcuucagaccguauggggaugggaaccacauaucuugccuugauggcaacuuucaaaaugagaccuauguuugcugugggccuguuauucaggcgccucaccagucgggagguucugcuucugacgauaggucuaucccucguggccucugucgaacugccaaacagcuuggaggaacugggggauggauuagcaaugggcaucaugauucucaagcugcuuacagacuuucaauccuaccagcugugggccaccuugcucucacugacuuucaucaaaaccacauuuagccuacacuaugcuuggaagacuauggcgaugguacugaguauugugucucuucucccccuguguuuguccaccacgagccagaagacaaccuggcugccgguuuuacucggcucgcuggggugcaaaccucuuacuauguuccugaucgccgagaauaagauauggggaagaaaaucauggccauugaacgaagguaucauggcagugggcauugucucuauccuccugaguucccuacugaagaacgaugugccccuugcugggccucucauugccggaggcaugcugaucgccuguuacguaauaagcgguucuagcgcugacuuguccuuagagaaagcagccgaggugucaugggaagaggaagcggagcauaguggggcuagccacaauauucuggucgaaguucaggaugacggaacaaugaagaucaaagaugaggagagggacgauacccucacuauccugcuuaaggccacacuguuggcagugucuggcguguauccccuauccauuccagccacccuguuugucugguacuucuggcaaaagaaaaagcagcgaucaggcgugcucugggacacgccuagucccccagaaguugagcgcgcuguacuggaugacgggauauaucggaucaugcagagaggacuuuuagguaggagccaggugggcgucgggguguuccaagaaaacguuuuucauacuauguggcacgugacccguggagcaguccugauguaccagggcaaacgccucgagccguccugggccucugugaagaaagacuugauuucguacggugggggauggcggcugcagggcagcuggaauacaggcgaggaaguacaggucaucgcgguggagccugggaagaaccccaagaauguucaaaccgcuccaggaacauucaaaacucccgaaggugaggugggcgccauugcacucgauuuuaagccugggaccucaggauccccaaucgucaacagagaaggcaaaauagugggucuguaugggaauggaguugugacgacaaguggcacuuacgucucugccaucgcucaggccaaggcaagccaggagggcccccuuccugagauugaagacgagguguucaggaaacgaaaccugaccaucauggauuugcacccgggguccggaaagacacggcgcuaucuaccagcuauuguaagagaagccaucaagaggaaacugcggacccucauauuagcgcccacucgagugguugccucagagauggcagaagcucugaaggguaugccuauuagauaccaaaccacagccgucaaaucugagcauacgggccgcgagaucguggaccuuaugugccacgcuacuuuuaccaugaggcugcucagcccagugcguguccccaauuauaacaugaucauuauggaugaagcacauuucacagacccuaguuccaucgccgcccggggguacauaagcaccagaguaggaaugggcgaggcugcggcaauuuuuaugacugccacaccgcccgguucuguggaagcuuucccacagucaaaugccguuauccaggaugaggaaagggacauuccugagcgcuccuggaacaguggguaugaguggaucaccgauuuucccggaaagacggugugguucgucccaagcauaaaaucgggcaaugacauugcaaacuguuugcgaaagaauggcaagagagugauccagcugucucggaaaacuuuugauacagaauaccaaaagaccaaaaacaacgacugggacuacguugugaccacugauaucuccgagaugggggccaauuucagggcugaccgcgucauugauccucguagaugccucaagcccgugauccugaaagacggaccagaacggguaauucuugcggguccgaugccugugacaguugccagcgcagcucagaggcgcggccgaauagggagaaaccacaauaaggagggagaucaguauaucuacaugggccagccccuaaacaaugacgaggaucaugcccacuggaccgaagcaaagaugcuguuggacaacauuaauacaccagaggguaucauccccgccuuauucgaaccugagcgggaaaaaucagcugccauugauggggaguauaggcugcgcggcgaggcgagaaagacuuuugucgaacucaugaggcggggagaccugccaguguggcuuaguuacaaaguggcaucugagggcuuccaauauuccgaucgucgcuggugcuuugacggggaacgaaacaaucagguccuggaggaaaacauggauguugagauauggacgaaggagggagaaagaaaaaagcucaggccccggugguuggacgcccgcaccuacagcgacccucuggcucuaagagaguucaaagaauuugccgcugguaggcggucagugaguggcgaucugauccucgagauugggaagcuuccgcagcaccugacacagcgagcacaaaaugccuuagacaacuugguaaugcugcauaauagcgaacagggaggcagagcuuaucgccacgccauggaggagcucccagauacuaucgaaacccugaugcuucuggcacucauugcgguguugacagguggggucacccuguucuuuuuauccggcaggggacuaggcaagacuucuaucgggcugcucugugugauggccagcuccgcucuucuguggauggccucaguugagccccauuggauagcagcuucuaucauuuuggaauucuuucugauggugcuccugaucccugagcccgaccggcagcguacgccacaggauaaccaacuugccuacgucguaauuggacuccuguucaugaucuugaccguggcagccaaugagaugggucuguuagaaacaacuaaaaaggaccuaggcauagggcacguugcuguggagaaccaccaucacgcgaccaugcuggaugucgaccuccauccugccagugcauggacacuuuacgcuguggccaccacuauuaucacacccaugaugagacacacgauugaaaacaccacugccaauaucucgcugacagcaauagcuaaccaggccgcgaucuugaugggacuggauaaaggcuggccaauuagcaagauggacaucggugucccucuccuggcucuugggugcuauucccaggugaauccguuaacccugaccgccgcaguucucauguugguggcccauuacgcuauuaucggccccggacugcaagcaaaagccacaagggaggcgcagaagcgcacugcugccggcauaaugaagaacccaacgguagaugggauuguggcaaucgaccuagauccugucguuuaugacgccaaauuugaaaagcagcugggacagaucaugcuccuuauucuguguaccucucaaaucuugcugaugcggacaacuugggcucucugcgagucaauaacccuggccacaggccccuuaaccacucuuugggaggguagcccagggaaauucuggaauacgacaauugcaguguccauggcuaacaucuuucgaggaaguuaccuggccggcgcgggucucgccuucucucuaaugaagagccugggcgggggaagaaggggcaccggggcacagggagaaacuuugggcgagaaauggaagcgccagcugaaucagcucucaaaguccgaauucaacaccuauaaacggagugguauuauggaggucgacagaagcgaagcuaaggaggggcuucguaggggagagacaacuaaacacgccgugucucggggcaccgcaaagcugcgcugguuuguagaacgaaauuuggugaaaccugaggguaagguuaucgaucugggcugugggagaggaggcugguccuacuauugcgcugggcucaagaaagugacagaagucaagggauacacgaaaggcggucccgggcacgaggaaccgauaccaauggccaccuacggauggaacuuagugaagcugcauucaggcaaagacgucuucuuuaucccucccgagaagugugauacucuucugugcgacauuggcgagagcucgccaaaucccacaaucgaagaggggaggacccuacgggugcucaaaaugguugaaccuuggcugcgcggaaaccaauucuguauuaagaucuugaauccguauaugcccucuguaguggagacucuggagcagaugcagagaaagcacgguggcaugcucgucaggaacccacuuagucgaaauuccacacaugaaauguacugggugagcugcgggaccggaaacauuguuucagccgugaauaugacgucccggaugcuguuaaaccguuuuaccauggcgcacagaaaaccuacauaugagcgcgaugucgaccugggcgcugguacuaggcacguggcaguagaacccgagguggccaacuuggauaucauagggcagcggauugaaaauaucaagcaugagcacaaaucuaccuggcauuacgacgaggauaacccuuauaagacaugggcuuaccacggaagcuaugaaguuaaaccaaguggcuccgccagcucuauggucaauggcguggugaagcuccugacuaagcccugggacgucaucccuaugguuacccaaauugcaaugacagauaccacuccauucgggcagcagagaguguuuaaagagaagguagacacgcgcacacccaaagccaagaggggaaccgcucaaauaauggaagugacugcgcgauggcuaugggguuuccuuucacggaacaaaaagccgagaaucuguaccagggaggaauuuacacgcaagguccguaguaaugccgcaauuggcgcuguguucguugacgagaaccaguggaauuccgccaaagaggcaguggaagaugagcgguuuugggaccugguccauagagaaagggagcuccacaagcaggggaaaugcgccacgugcguguacaacaugaugggaaagcgcgaaaaaaagcugggcgaguucgguaaggcuaaagggagccgagccaucugguacaugugguugggagcgcgguuucuggaguucgaagcacucggcuucaugaaugaggaucacugguuuucuagagaaaacucgcuuucaggcguagagggggagggacugcauaaguuagguuauauucugagggacaucagcaaaauaccuggcgggaauauguacgccgaugacaccgcuggaugggauacucgcaucacagaagacgauuugcagaacgaggccaagauuaccgacaucauggaaccagagcacgcacuccuggcuacuuccauuuucaaacuaacauaucaaaauaagguugugagaguccagcggcccgccaggaacggcaccgugauggaugugaucagucgucgagaccagcgcgguucugggcaggucggaacauacggccuuaauacuuuuaccaacauggaagcucaacugauaagacagauggagagcgagggcauuuucuccccuucagaacucgagacgccaaaccuggccgaacggguuuuggauugguuagagaaacaugggguggaaaggcugaagcgcauggcaaucaguggagacgacuguguagugaagcccaucgaugacagauuugcgaccgcccucucugcucuuaaugauauggguaaaguccggaaggacauuccgcagugggagccuagcaaaggcuggaacgauuggcagcaagugcccuucugcucccaccacuuucaucagcugauaaugaaggacgggagggagaucguugugccaugucgaaaucaggaugaacuagucggacgugccagagugucacagggcgcagguuggagccugcgcgagacagcuugccucgggaaaucuuaugcccaaauguggcaguugauguacuuccaccggagggaccugagacuugcagccaacgcgauuuguuccgcuguaccuguugauugggugcccacuagucgcaccacauggagcauccaugcccaccaucaguggaugacuaccgaagacaugcugucggucuggaaucggguguggauugaggaaaacccauggauggaggauaagacgcacaucuccucuuggggagacguucccuaucucggcaagagggaggaccaauggugcggcucauuaauagggcugacagcacgagccaccugggcuacuaauauccagguggccauuaaccaggucagacgguugaucggaaaugaaaacuaccuggauuacaugacaagcaugaaaagguuuaagaaugagagugacccugaaggugcacucugguga

SEQ ID NO: 13864 - RNA, 9879 nt, Artificial Sequence
  derived and/or modified CDS sequence (opt3) from DENV-1__FJ898425__SS-prME
agcgugaccaugcugcucaugcuuaugcccaccgcccuggcuuuccacuugacuacgagaggaggggaaccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccauugggaaacuuguucaucagauauucggaacggcguacggcgugcuguuuucuggugucagcuggaccaugaagaucgggauuggcguguugcucacuuggcugggauuaaauucacgaaguacaucccugagcaugaccuguaucgcuguaggccuagugacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacauuauguggaaacagaucucuaacgagcucaaucauauucuguuagaaaacgacaugaaguucaccguggugguaggcgaugucguggggauccuggcucagggcaagaagaugauacgcccucaacccauggagcacaaauacucguggaaaagcuggggcaaggccaaaaucauuggggcggacguucagaauacuaccuuuaucauugauggaccaaacacaccugaaugucccgacgaucagagagccuggaauaucugggagguggaggacuauggcuucgguauauuuacuaccaacauuuggcuuaagaugagggauuccuacacacaggucugcgaccaccguuugaugucagcugcaaucaaagauaguaaggccgugcaugcugacaugggguauuggauugaaucugagaaaaaugaaacguggaagcucgcccgggcauccuucaucgagguuaagaccuguauauggccaaaaucccacacucuguggucaaacggagugcuagaaagcgagaugaucauucccaagaucuacggcgguccuauuucucaacauaauuaucgaccaggcuacuucacacagaccgcggggccguggcaccugggaaaacucgagcuggauuuugaccuuugcgaaggcacuacaguagucguggaugagcacugcgggaacagaggacccuccuugaggaccacgacugugaccggcaagaucauacaugaaugguguugccgcaguuguacacugccuccauuacgguucaaaggugaggacgggugcugguacggaauggagauuagacccgucaaggaaaaggaggaaaaucucguuaaaagcauggugucugccggcuccggugagguagacucauuuagucugggccuucuguguaucagcaucaugauugaagaggugaugaggucgcgcuggucccgaaagauguugaugaccgggacucucgcugucuuccugcuacugaucaugggacagcucacauggaacgaucugauucggcuuugcauaauggugggcgccaaugcaucugaccguauggggaugggaaccacauauuuggcucugauggccacuuuuaaaaugagaccuauguucgcaguuggcuuacucuuuaggcgccugaccagccgggaggugcuucugcuaacgaucggucucucacuggucgccaguguggaauugccaaacucccuggaggaauuaggggauggacucgcuaugggcauuaugauccugaaacuucugacagacuuccaaucucaccaguugugggcgacccuccugagccuaacuuuuauuaaaaccacacugucccuucauuacgccuggaagacuauggcaaugguucucucaaucgugagccugauacccuugugucugaguaccacgucucagaagacaaccugguuaccgguccuccugggcucccuugggugcaaaccucugacuauguucuugaucgcugagaauaagauuuggggaagaaaaagcuggccacucaacgaagguaucauggccguaggcgugguuucgauucugcuaucaucucugcuuaagaacgaugugccccucgccgggccucugaucgcuggaggcauguugauagcauguuaugucauuagugguuccagcgccgacuuaucucuggagaaagcggcugaggugagcugggaagaggaagccgagcacuccggggcaucacauaauauccucguagaagugcaggaugacggaacaaugaagaucaaagaugaggagagggacgauacccugacuauucuucugaaggccacauugcuagcugucaguggcguuuacccccugagcauaccagcaacccucuuugugugguauuucuggcaaaagaaaaagcagcgaucuggcgugcugugggacacgccuucacccccagaagucgagcgcgccgugcuugaugacgggaucuaccggauuaugcagagaggauuacuggguaggagccagguuggcguagggguguuucaagaaaacgucuuccacacuauguggcacgugacccguggagcgguucucauguaucagggcaaacgcuuggagccgaguugggcuagcgugaagaaagaccugaucuccuacggugggggauggcggcuccagggcucuuggaauacaggcgaggaaguccaggugauugccguagagccugggaagaaccccaagaauguccaaaccgcaccaggaacauucaaaacucccgaaggugaggugggcgccaucgcucuggauuuuaagccugggaccucgggaagcccaauaguuaacagagaaggcaaaaucgugggucuuuacgggaauggagucgugacgacaucaggcacuuauguuuccgccauugcacaggcuaaggccagucaggagggcccccugccugagaucgaagacgagguguucaggaaacgaaacuugaccauuauggaucuacauccggggucuggaaagacacggcgcuaccugccagcgaucgucagagaagccauaaagaggaaacuccggaccuuaauucuggcacccacucgagugguagcuagcgagauggccgaagcucuuaaggguaugccuaucagauaucaaaccacagcagugaaauccgagcacacgggcaaggagaucguugaccugaugugccaugccacuuuuaccaugcgccucuugucaccagucagggugcccaauuacaacaugauuaucauggaugaagcccacuucacagacccuucuagcauagcugcgcguggguauauuaguacccgggugggaaugggcgaggcagccgcuaucuuuaugacugccacaccgcccgguuccgucgaagcauucccacagagcaaugccguaauucaggaugaggaaagagacaucccugagaggucuuggaacucaggguacgaguggauaaccgauuuucccggaaaaacggugugguucguuccauccauuaagaguggcaaugacaucgcuaacugucugcgcaagaauggcaaacgagugauccagcucagcagaaagacuuuugauacagaauaucagaagaccaagaacaacgacugggacuacgucgugaccacugauauuucggagaugggggcgaauuuccgggccgacaggguuaucgauccucgccguugccugaaacccgugauucuuaaggacggaccagaaagagucauacuagcagguccgaugccugugacaguagcuucugccgcacagcggaggggccgcaucgggcgaaaccauaauaaggagggagaucaguacauuuauaugggccagccccugaacaaugacgaggaucacgcccacuggaccgaagcuaaaauguuguuagacaacaucaauacaccagaggguaucauucccgcccuguuugaaccugagagagaaaaguccgcggcaauagauggggaguaccggcucaggggcgaggcccgcaaaacuuucguggaacugaugagaaggggagaccuuccaguuuggcugagcuauaaggucgcuucagagggcuuccaauacagugaucggcguuggugcuuugacggggaacgcaacaaucaggugcucgaggaaaacauggauguggagaucuggacgaaagagggagaacgaaagaaauugagacccagguggcuggacgcccggaccuauucugacccucuagcucugcgcgaguucaaggaauuugcagccgguagaagguccgucagcggcgaucucauucuugagaucgggaagcugccgcagcauuuaacacagcgggcucaaaaugccuuggacaaccugguuaugcuccacaauucagaacagggaggccgagcauacagacaugcgauggaggagcugccagauacuauugaaacccuuaugcugcucgccuugaucgcugugcugacaggugggguaaccuuauucuuucuaaguggccgcggacugggcaaaacuagcauagggcuccuuugugugauggccuccucuguccuguuguggauggcaagcguggagccccacuggaucgcugccuccauuauccuggaguucuuucucaugguucugcuuauuccugagcccgacaggcagcggacgccacaggauaaccaacucgcauauguggucaucggacuguuguucaugauacugaccguagccgcuaaugagauggguuuacuagaaacaacuaagaaagaccugggcauugggcacguggcgguugagaaccaucaccaugccaccaugcucgauguggaccuucacccugcaucagcuuggacacuguacgccgucgccaccacuaucauuacacccaugaugcgucauacgaucgaaaacaccacugcaaauauaucuuugacagcuaucgccaaccaggcggcuauucugaugggacucgauaagggcuggccaaucaguaaaauggacauuggugugccucugcuugccuuagggugcuacucgcaggucaauccgcugacccucaccgcagccguguugaugcugguugcucacuaugcaaucauaggccccggacuacaagccaaggcgacaagagaggcucagaagaggacugccgcaggcauuaugaaaaacccaacgguggaugggaucguagccaucgaccuggauccuguggucuacgacgcuaaguuugaaaaacagcucggacagauuaugcuucugaucuuguguaccagccaaauacugcucaugcgcacaacuugggcccugugcgaguccauuaccuuagcaacaggcccccuuaccacucugugggaggguucuccagggaaguucuggaauacgacaaucgcuguuucaauggccaacauuuuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaauuuaacaucuacaagcgcucagguauaauggagguggaccgguccgaagccaaagaggggcugaagagaggagagaccacacgucacgcagucaguaggggcacugcuaaauugcggugguucguggaacgcaaucugguaaagccugaggguaaggugaucgaucucggcugugggcgaggaggcuggagcuauuacugcgccgggcuaaagaagguuaccgaagugaaaggauauacaaagggcggucccgggcaugaggaaccgauuccaauggccacguacggauggaaccuggucaaacuucacucuggcaaggacguguucuuuaccccucccgagaaaugugauacucugcuaugcgacaucggcgaguccucaccaaaucccacaauugaagaggggagaacccucaggguccugaagaugguggaaccuugguugcggggaaaccaauucuguaucaagauucugaauccguacaugcccagcguuguagagacucucgagcagaugcagcgcaaacaugguggcaugcuugugagaaacccacugucgagaaauucuacacacgaaauguauugggucaguugcgggaccggaaacaucguguccgcgguuaauaugacgagccgaauguuacugaaccgguuuaccauggcucaccguaagccuacauacgagaaagauguggacuugggcgcagguacuagacaugucgccguggaacccgagguagcuaaccucgauauaauugggcagcgcaucgaaaauaucaagcacgagcauaaaucaaccuggcacuaugacgaggauaacccuuacaagacaugggccuaucauggauccuacgaagugaagccaucuggcagcgcaaguuccaugguuaauggcgucgugaaacugcuaacuaagcccugggacgugauuccuauggucacccaaauagccaugacagauaccacuccauucgggcagcagaggguuuuuaaagagaagguggacacgcggacacccaaagcuaagagaggaaccguacaaaucauggaagugacugcgcgcuggcuuugggguuuccugagcaggaacaagaaaccgcgaauuuguacccgggaggaauuuacaagaaaggucaggucuaaugccgcaaucggcgcuguguucguugacgagaaccaguggaacucagccaaagaggcaguggaagaugagcgcuuuugggaccucguccagaaggaacgugagcugcacaaacaggggaagugcgccacgugcguguauaacaugaugggaaagcgggagaaaaaguugggcgaguucgguaaagcuaaggggaguagagccauuugguacauguggcugggagcgagguuucucgaguucgaagcacuuggcuuuaugaaugaggaucacugguucucccgcgaaaacagccugucuggcguagagggggagggauuacauaaacuggguuacaucuugcgagacauaucgaagaucccuggcgggaauauguaugccgaugacaccgcuggaugggauacucggauuacagaagacgaucuccaaaacgaggccaaaaucaccgacauuauggaaccagagcacgcacugcuagcuacuucaaucuucaaacuuacauaccagaauaagguugugagaguccagaggcccgccaaaaacggcaccgugauggaugugauaagccgcagagaccagcgggguuccgggcaagucggaacauauggccugaauacuuuuaccaacauggaagcucagcucauuaggcagauggagagugagggcaucuuccugccuucugaauuggagacgccaaacuuagccgaacguguucuggauuggcucgagaaguacgggguggaacgacuuaaacgcauggcaaucagcggagacgacuguguagugaagcccauugaugacagauuugcgaccgcccugacagcucuaaaugauauggguaaaguccggaaggacauaccgcagugggagccuuccaagggcuggaacgauuggcaacaggugcccuucugcucacaucacuuucaccagcugaucaugaaagacgggagggagauuguugugccaugucgcaaucaggaugaacucgucggaagggcacgggugagucaaggcgcagguuggucuuugagggagacugcuugccugggaaagagcuaugcccagauguggcagcuuauguacuuccaucgacgugaccugagacucgcagccaacgcgaucuguuccgcuguaccuguugauugggugcccaccucacgcacaacuuggagcauucacgcccaucaccaauggaugaccacggaagacauguuaucugucuggaaucggguguggaucgaggaaaacccauggauggaggauaaaacacauguuuccaguuggggagacgugcccuaucugggcaagagggaggaccaguggugcggcagcuugauagggcugaccgcaagagccacuugggcuucgaauauccaggucgccauuaaccaggugcgccggcucaucggaaaugaaaacuaccuugauuacaugacauccaugaaaagguuuaagaaugagggugacccugaaggcgcacugugguga

SEQ ID NO: 13865 - RNA, 9879 nt, Artificial Sequence
  derived and/or modified CDS sequence (opt3) from DENV-1__FJ898426__SS-prME
agcgugaccaugcugcuaaugcuuaugcccaccgcacuggcuuuccacuugacuacgcgaggcggggaaccucauaugaucgucuccaagcaggaaagggggaaaucuuuacuguuuaagaccucagccgguguuaacaugugcacccuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagggauuucguggagggucugaguggcgcgacuuggguagacguugugcuugagcacggguccugugucacaaccauggcaaaggauaaacccacuuuggacaucgaacugcuaaagacagagguggccaacccugcugugcucaggaaacugugcauugaagccaagaucucuaauaccacgaccgauagccgguguccaacacaaggagaggcaacucuugucgaagaacaagacgcuaacuuuguuugccgccgaaccuucguggauagaggcugggguaauggguguggacuguuuggcaaaggcuccuugauaacaugcgccaaguucaagugcguaacuaaacucgaggggaagauugugcaguacgaaaaccugaaauauucagucaucgugaccguucacacaggagaccagcaucaaguggguaaugagaguaccgaacacggcacuacggcgacaauuacaccccaggccccuagcacugagauccaguuaaccgacuacggggcacugacacucgauuguucuccaaggaccggacuugacuuuaacgaaaugguccuguugacuaugaaggagaaauccuggcuagugcauaagcagugguuccuggaucucccgcugcccuggacaucaggcgcuagcacgagucaagagaccuggaaucggaaagaccuucugguaacuuuuaagacagcccacgcuaagaaacaggaaguuguggucuuggguucucaggagggggccaugcacaccgcacucacaggcgccacugaaauccaaaccuccggaacgaccacaauuuucgcuggccaucugaagugccguuuaaaaauggauaagcugacucuaaaagggaugagcuaugugauguguaccggaucguucaagcucgagaaggaagucgcggagacacagcacgguacugugcugguucagauaaaauacgagggcaccgacgcaccuugcaagaucccauuuucuacgcaggaugaaaaaggggugacacaaaacggacgccuuauuaccgccaaucccaucguaacugacaaggagaaaccugucaacauagaagcugagccacccuucggcgaguccuauauugugaucggugccggggaaaaggcauugaagcugucaugguuuaaaaagggcaguagcaucggaaaaauguucgaggccacagcuagaggcgccaggcggauggcaauucucggggauaccgcgugggacuuuggauccaucgguggcguuuucacuucuguggggaagcugguccaucagauuuuuggaaccgcuuacggcgugcuuuucagcgguguaucauggacaaugaaaauagggaucggcgugcuguugacguggcucggacugaauagucgauccaccagcuuaucuaugacuuguauugccguuggccuggucacacuauaccucggggugauggugcaggcagauucaggaugcgucaucaacuggaagggccgcgaacugaagugugguagugggaucuuuguuaccaaugaggugcacacauggacugaacaguauaaauuccaagccgacagcccgaagagacuuuccgcugccauuggaaaagcaugggaggagggcgugugcgguauaaggucugcuacccgguuggaaaacaucauguggaagcagauuucgaacgagcugaaucauauccuccuggaaaacgacaugaaauuuacgguagucgugggcgauguugccgggauuuuagcgcagggaaagaaaaugauccgcccucagcccauggaguacaaguauagcuggaaguccuggggcaaagccaagauaaucggggcugacgugcaaaauacaaccuucauuaucgauggaccaaacacuccugaaugucccgacgaucagagagcauggaauauuugggaggucgaggacuacggcuuugguaucuucaccacaaacauauggcugaaacuuagggauucauauacucaggugugcgaccaccguuugaugagugccgcuauuaaggauucuaaagccguucacgcagacaugggguacuggaucgaaagcgagaagaaugaaaccuggaagcucgcgcgggccuccuucauugaggugaaaacauguaucuggccaaagucacauacgcuguggagcaacggaguacuagaaucugagaugauaauccccaaaauuuauggcgguccuaucucccagcacaauuaccgaccaggcuacuuuacccaaacugcugggccguggcaucugggaaagcucgagcuggauuucgaccuuugcgaaggcacaaccgucgugguggaugagcacugcgggaacagaggacccaguuugaggacuacaaccgucacgggcaaaauuauccacgaaugguguugccgcagcuguacucugccuccauuacgguuuaagggugaggacgggugcugguauggaauggagauaagacccguuaaggaaaaagaggaaaaucucgugaagucuaugguauccgccggcucaggugagguggacaguuucagccugggccuucuguguauuucgaucaugaucgaagaggucaugaggucccgcuggucucgaaaaauguugaugaccgggacacucgcaguguuuuuccugcuaauuaugggacagcugaccuggaacgaucucauccggcugugcauuaugguuggcgcuaaugccagcgaccguauggggaugggaacuacauaccuugcauugauggccaccuuuaagaugagaccuauguucgcugugggccuguuauuuaggcgccucacaucacgggagguccugcuucugacuauaggucuaagucucguggcguccguugaacugccaaacucuuuggaggaacugggggauggauuagccaugggcaucaugauucucaaacugcuuaccgacuuccagagccaucaacugugggcaacguugcucucccugacauuuaucaagaccacuuucucacuacacuaugcuuggaagaccauggccauggugcugagcauugucagucuuuuuccccucugucugucuacaacuucccagaaaaccacgugguugccgguacuguuaggcagccucgggugcaagccucugacaauguuccuuaucgccgagaauaaaauauggggaagaaagucguggccacugaacgaagguaucauggcugugggcauuguuucaaucuugcucucuagucugcucaagaaugaugugccccuggcagggccucuuauugccggaggcaugcucaucgcguguuacgucauauccgguagcucugcugaccugagcuuggagaaggccgcagagguguccugggaagaggaagccgagcauucaggggcuagucacaauauuuuaguagaagugcaggaugacggaaccaugaaaaucaaggaugaggagagggacgauacucugacaauccuccugaaggcaacccuucuggccgucagcggcguuuaucccuugucuauuccagcgacucuauucgugugguacuuuuggcagaaaaagaaacaacgauccggcgugcugugggacacaccuucacccccagaagucgagcgcgcugugcucgaugacgggauauaucggaucaugcagagaggacugcuugguaggagucagguuggcguagggguguuccaggaaaacgucuuucauaccauguggcacgugacgcguggagccguuuuaauguaccaaggcaagcgccuggagccgagcugggcauccgugaaaaaggaccucauuucuuacggugggggauggcgguugcagggcucguggaauacuggcgaggaaguccaggugaucgccguagagccugggaagaaccccaaaaauguccagaccgcuccaggaacauucaagaccagcgaaggugaggugggcgccauugcacuggauuuuaaacccgggacaucaggauccccuaucguuaacagagaaggcaagauagugggucucuaugggaauggagucgugacuaccaguggcacguacguuucugcuaucgcccaagcgaaagccagccaggagggcccacugcccgagauugaagacgagguguucaggaagcgaaaccuuacaaucauggaucugcacccuggguccggaaagacucggcgcuauuugccggcaauugucagagaagcuaucaaaaggaagcuacggacccugauacucgccccaacacgagugguagcuucagagauggcagaagccuuaaaagguaugcccauuagauaccagaccacugccgugaagucugagcauaccggcaaagagaucguugaccugaugugccacgcuacauuuacgaugcgccuucugagcccugucagggugccaaauuauaacaugaucauuauggaugaagcgcauuucacugaccccaguuccaucgcagcccguggguacauaagcacccgggugggaaugggcgaggcugccgcaauuuuuaugacagccaccccuccggguucugucgaggcuuucccccaaucaaaugcgguaauccaggaugaggaaagagacauuccagagagguccuggaacaguggguaugaguggaucacugauuuuccuggaaagacagugugguucguucccagcauaaagucgggcaaugacauugccaacugucuccgcaaaaauggcaagcgagugauccaguugucuagaaaaaccuucgauacggaauaccagaagacuaaaaacaacgacugggacuacgucgugacaaccgauaucuccgagaugggggcaaauuuucgggcugacaggguuauugauccacgccguugccugaagccugugauccucaaggacggacccgaaagagucauucuggccgguccaaugccggugaccguagcaagcgccgcucaacggaggggccgcauagggcgaaaccacaauaaagagggagaucaguauaucuacaugggccagccucuuaacaaugacgaggaucaugcccacuggacugaagcgaagaugcuacuggacaacauuaauacacccgaggguaucaucccagcauuguucgaacccgagagagaaaaaucagccgcuauugauggggaguaucgguuaaggggcgaggcccgcaagaccuuuguggaacugaugagaaggggagaccucccuguuuggcugaguuacaaagucgcuucugagggcuuccaguauuccgaucggcguuggugcuuugacggggaacgcaacaaucaagugcuugaggaaaacauggauguggagauauggacaaaggagggagaaagaaagaagcugagaccaagguggcucgacgcacggacuuacagcgaccccuuggcccugcgcgaguucaaggaauuugcugccgguagaaggucagucaguggcgaucuaauccuggagauugggaaacucccucagcaccuuacgcagcgggcacagaaugcgcuggacaacuuaguuauguugcauaauagcgaacaaggaggccgagccuauagacacgcuauggaggagcugccggauaccaucgaaacacucaugcugcuugcccugauugcagugcucacuggugggguaaccuuguucuuucuguccggccgcggauuaggcaagacaucuaucgggcuacugugugugauggcuagcuccguccuccuuuggauggccucaguggagccacauuggauagcagccucuaucauucuggaguucuuuuugaugguucugcucauccccgagccugacaggcagcggacaccccaggauaaccagcuggcuuacguggucauuggacuucucuucaugauccugacuguagcggccaaugagauggguuugcuggaaacgaccaaaaaggacuuaggcauagggcacguggcaguugagaaccaccaucacgcugccaugcuagauguggaccugcauccagccagugcauggacacucuacgcugucgccacuaccauuaucacaccuaugaugcgucacaccauugaaaacacuacagcgaauaucucgcuuacggcuauagccaaccaagcagccauccugaugggauuggauaaaggcuggcccauuagcaagauggacaucggugugccacugcucgcucuggggugcuauucccaggucaauccucuuaccuuaacugcagccgugcugaugcucguugcgcauuacgcuauuaucggcccgggauugcaggccaaggcaacaagagaggcccagaaaaggaccgcugccggcauaaugaagaaccccaccguggaugggauuguagcaaucgaccuggauccaguggucuaugacgcuaaauuugaaaagcagcuaggacagaucaugcugcucauucuuuguacaucucagauccuguugaugcgcacuacgugggcccugugcgagucaauaacccucgcgacaggcccucugacuaccuuaugggaggguagccccgggaaauucuggaauacaaccauugccguuuccauggcaaacaucuuccggggaaguuaccuugcuggcgccggucuggcauuuucucucaugaaaagccuaggcgggggacgaagaggcacuggggcucaaggagaaacgcugggcgagaaguggaaaaggcaguugaaucagcugucaaaguccgaguucaacacauauaaacgcagugguauuauggagguggaccggagcgaagccaaggaggggcucaaaagaggagagaccacuaagcacgccgucucucguggcaccgcgaaacuuaggugguuuguggaacggaaucugguaaaaccagaggguaaggugaucgauuugggcugugggcgcggaggcugguccuacuauugcgcugggcugaaaaagguuacagaagugaaaggauacacuaagggcgguccugggcacgaggaacccauaccgauggcaaccuacggauggaaccucgucaaauuacauucaggcaaggacguguucuuuaucccaccugagaagugugauacacugcuuugcgacauuggcgagagcucgcccaauccaacgaucgaagaggggcgaacccugagaguccuaaaaaugguggaacccuggcucaggggaaaccaguucuguauuaagauccugaauccuuauaugccgucuguuguagagacuuuggagcaaaugcagcggcgccacgguggcaugcuggugagaaacccccucaguagaaauuccacacaugaaauguacugggucagcugcgggaccggaaacauugugucagccguuaauaugacuucccgaaugcuucugaaccgguuuacaauggcucaccguaaaccaaccuaugagagagauguggacuuaggcgccgguacgcgccacgucgcaguggaaccugagguagccaaccuggauaucauagggcagaggauugaaaauaucaagcaugagcacaaaucuaccuggcauuacgacgaggauaaccccuauaagacaugggcuuaccacggaagcuaugaagugaagccuaguggcuccgcgagcucuaugguuaauggcgucgugaaauugcucacuaagccaugggacgugauccccauggucacccagauugccaugacagauacuaccccuuucgggcaacagcggguuuuuaaagagaagguggacacaagaaccccaaaagcaaagcgcggaacugcucagauaauggaaguaacggccaaguggcugugggguuuccuaucaaggaacaaaaagccccgaaucuguacacgggaggaauuuaccagaaaagugaggaguaaugcagccauuggcgcugucuucguggacgagaaccaauggaacuccgccaaggaggcgguugaagaugagcgcuuuugggaccuugugcaucgugaacgggagcugcacaaacaggggaagugcgcaacuugcgucuacaacaugaugggaaagagagagaaaaagcucggcgaguucgguaaagccaaggggagcagggcuaucugguacauguggcugggagcccgcuucuuggaguuugaagcacugggcuucaugaaugaggaucacugguuuucucgagaaaacucgcucucaggcguggagggggagggacuucauaaacuggguuauauuuuacgggacaucagcaagauaccgggcgggaauauguacgcugaugacaccgccggaugggauacaagaaucacggaagacgaucugcagaacgaggcuaaaauuaccgacaucauggaaccugagcacgccuugcucgcaaaguccauuuucaagcugacuuaucagaauaaaguaguuagggugcaacgcccagcgaagaacggcacagucauggaugugaucaguagacgggaccagagggguucuggacaggugggaaccuacggccuaaauacuuuuacaaacauggaagcccagcuuauacgucaaauggagagcgagggcauuuucucccccucagaacuggagaccccuaaccucgcugggcgaguccuggauugguuggaaaaacauggaguugagcgcuuaaagagaauggccaucaguggugacgacugugugguaaaaccaaucgaugaccgguuugcaacagcucugacugcccucaaugauaugggcaaggugaggaaggacauuccccagugggaaccgucuaaaggguggaacgauuggcagcaggucccuuucugcagccaccacuuucaucaacuuauaaugaaggacggacgcgagaucgugguucccuguagaaaucaggaugagcuggugggccgggcaagggucucccagggugccggguggucacuacgagaaaccgcgugccugggaaaaagcuaugcucagauguggcaacucauguacuuccaccguagagacuugcgccuggccgcaaacgccauuuguucugcugugccaguagauuggguuccuacgucccggaccacauggaguauccaugcccaccaucaguggaugacuaccgaggacaugcuuagcguguggaauagggucuggauugaagagaaccccuggauggaagauaagacacacaucucguccuggggcgacgugccauaucugggcaaaagagaggaccaguggugcgggucucucauaggauuaacugcacgcgcuaccugggccacgaauauccaaguugcgauuaaccaggugcggaggcugaucgguaaugagaacuacuuggauuacaugacaucaaugaagcgauuuaagaaugaaagcgaccccgagggcgcucugugguga

SEQ ID NO: 13866 - RNA, 9879 nt, Artificial Sequence
  derived and/or modified CDS sequence (opt3) from DENV-1__GQ199856__SS-prME
agcgugaccaugcugcucaugcuuaugcccacagcacuggcuuuccacuugacuacgagaggcggggaaccucauaugaucgucuccaagcaggaaaggggaaaaucuuuacuguuuaagaccucagccgguguuaacaugugcacccuaguggccauggaccucggcgaguucugugaagauacuaugaccuacaaaugcccacggauuacagaagcggaaccggacgauguagacuguuggugcaaugcuaccgauacuugggugacauaugggaccuguagucagacgggagaacaccgccgagacaagcguagcgucgcccuggcaccccaugugggccuuggucuggagacuagaaccgaaacauggauguccucugagggggccuggaaacagauacagaggguugaaacuugggcuuugcggcacccuggauuuaccgugaucgcacucuuccuggcccaugcuauuggcacaucgaucacccagaagggcauuaucuuuauacugcucauguuagucacgccaucaauggccaugcgcugcguggggaucggaagcagagauuucguugagggucugaguggcgcgacuuggguugacgugguccuugagcacggguccugugugacaaccauggcaaaggauaaacccacuuuggacauugaacugcuaaagacagaggugaccaacccugccguccucaggaaacugugcaucgaagcuaagauuucuaauacgaccacagauagccgguguccaacucaaggagaggccacccuuguugaagaacaggacgcaaacuuugugugccgccgaacauucguagauagaggcugggguaauggguguggacuguuuggcaaaggcuccuugaucacuugcgcuaaguucaagugcgugaccaaacucgaggggaagacaguccaguacgaaaaccugaaauauucagugauaguuaccgugcacacuggagaccagcaucaagucgguaaugagaguacggaacacggcacaaccgccacuauuacaccccaggcgccuagcacagagauccaguuaaccgacuacggggcccugacucucgauuguucuccaaggacaggacuugacuuuaacgaaauggugcuguugacgaugaaggagaaauccuggcuaguacauaagcagugguuccuggaucucccgcugcccuggaccucaggcgcaagcacaagucaagagacauggaaucggaaagaccuucugguuaccuuuaagacagcucacgccaagaaacaggaaguggucguguuggguucucaggagggggcuaugcacacugcccucaccggcgcaacggaaauucaaaccuccggaacaacuaccaucuucgccggccaucugaagugccguuuaaaaauggauaagcugacacuaaaagggaugagcuaugucauguguacuggaucguucaagcucgagaaggaaguggcugagacccagcacgguacgguucuggugcagaucaaauacgagggcacagacgcgccuugcaagauuccauuuucuacccaggaugaaaaagggguaacucaaaacggacgccuuauaacagcaaaucccaucgucaccgacaaggagaaaccugugaacauugaagccgagccacccuucggcgaguccuauaucguuauaggugcuggggaaaaggccuugaagcugucaugguuuaaaaagggcaguagcauuggaaaaauguucgaggcaacugccagaggcgcuaggcggauggccauccucggggauaccgcaugggacuuuggauccaucgguggcguguucacaucugucgggaagcuggugcaucagauuuuuggaacggcguacggcguacuuuucagcggugugucauggaccaugaaaaucgggauuggcguucuguugacuuggcucggacugaauagucgauccacuagcuuaucuaugaccuguauagcugucggccuggugacacuauaccucggggugaugguccaggccgauucaggaugcguuaucaacuggaagggccgcgaacugaagugugguagugggauuuuugugacuaaugaggugcacaccuggacggaacaguauaaauuccaagcagacagcccgaagagacuuuccgccgcuaucggaaaagccugggaggagggcguaugcgguaucaggucugcaacacgguuggaaaacauuauguggaagcagauaucgaacgagcugaaucauauccuccuggaaaacgacaugaaauuuaccgucgugguuggcgauguggcugggauuuuagcccagggaaagaaaaugauccgcccucagcccauggaguacaaguauagcuggaaguccuggggcaaagcgaagauuaucggggccgacguccaaaauacuaccuucauaaucgauggaccaaacacaccugaaugucccgacgaucagagagcuuggaauauuugggagguggaggacuacggcuuugguaucuucacuaccaacauuuggcugaaacuuagggauucauauacacagguuugcgaccaccguuugaugagugcagccaucaaggauucuaaagcugugcacgccgacaugggguacuggauagaaagcgagaagaaugaaacguggaagcucgcacgggcguccuucauugagguaaaaaccuguaucuggccaaagucacauacucuguggagcaacggaguccuagaaucugagaugauuauccccaaaauauauggcgguccuaucucccagcacaauuaccgaccaggcuacuuuacacaaaccgccgggccguggcaucugggaaagcucgagcuggauuucgaccuuugcgaaggcacuacagugguggucgaugagcacugcgggaacagaggacccaguuugaggaccacgacuguuaccggcaaaauuauccacgaaugguguugccgcagcuguacacugccuccauuacgguuuaagggugaggacgggugcugguauggaauggagauuagacccgugaaggaaaaagaggaaaaucucguaaagucuaugguguccgcuggcucaggugaggucgacaguuucagccugggccuucuguguaucucgauaaugauugaagaggugaugaggucccgcuggucucgaaaaauguugaugaccgggacucucgccguauuuuuccugcuaaucaucggacagcugacauggaacgaucucauucggcugugcaucauggugggcgcaaaugcuagcgaccguauggggaugggaaccacauaccuugccuugauggcaacuuuuaagaugagaccuauguucgccgucggccuguuauuuaggcgccucaccucacgggaggugcugcuucugacgauuggucuaagucucguugcuuccguggaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuaugguccugagcaucguaagucuuuuuccccucugucugucuaccacgucccagaaaacaaccugguugccggugcuguuaggcagccucgggugcaagccucugacuauguuccuuauugccgagaauaaaaucuggggaagaaggucguggccacugaacgaagguauaauggccguuggcaucgugucaauuuugcucucuagucugcuaaagaacgaugucccccuggcugggccucuuaucgcaggaggcaugcucauugccuguuacgugaucuccgguagcucugcggaccugagcuuggagaaagcugccgagguauccugggaagaggaagcagagcauucaggggccagucacaauauauuaguggaaguccaggaugacggaacaaugaagauuaaagaugaggagcgagacgauacccugacuauccuccugaaggcuacacuucuggcaguuagcggcguguaucccuugucuaucccagccacccuauucgugugguacuuuuggcagaagaaaaagcaacgcuccggcguccugugggacacgccuucacccccagaaguggagcgggcgguucucgaugacgggauuuauagaauaaugcagaggggacugcuuggucguagucagguaggcgugggggucuuccaggaaaacguguuucauacuauguggcacguuacccgcggagcuguguuaauguaccaaggcaaacggcuggagccgagcugggccuccgucaagaaagaccucaucucuuacggugggggauggagauugcagggcucguggaauacaggcgaggaagugcagguaauugcagucgagccugggaagaaccccaagaaugugcagaccgccccaggaacauucaaaacuagcgaaggugagguuggcgcuaucgcccuggauuuuaagcccgggaccucaggauccccuauugugaacagggaaggcaaaaucgucggucucuaugggaauggagugguuacgacaaguggcacuuacgugucugcaauagcucaagccaaggcgagccaggagggcccacugcccgagaucgaagacgaggucuuccgaaaacggaaccuuaccauuauggaucugcacccuggguccggaaagacacgcagauauuugccggccaucgugagggaagcaauuaagcggaaacuacgaacccugauccucgcuccaacuagaguaguggccucagagauggcugaagcauuaaaggguaugcccauacgcuaccagaccacagccguuaaaucugagcauacgggcaaggagauugucgaccugaugugccacgccacuuuuaccaugaggcuucugagcccugugcgugugccaaauuauaacaugaucaucauggaugaagcucauuucacagaccccaguuccauugcggcacggggguacaucagcaccagagucggaaugggcgaggccgcugccauauuuaugacugcaacaccuccggguucuguagaagccuucccccaaucaaaugcugugauucaggaugaggaaagggacaucccagagcgcuccuggaacaguggguaugaguggauuaccgauuuuccuggaaaaacgguuugguucgugcccagcaucaagucgggcaaugacauagcgaacugucuccgaaagaauggcaaaagagucauucaguugucucggaagacuuucgauacagaauaccagaaaaccaagaacaacgacugggacuacgugguuaccacugauaucuccgagaugggggccaauuuuagggcagaccgcgugaucgauccacguagaugccugaaaccugucauucucaaggacggacccgaacgggugauccuggcugguccaaugccgguaacaguggccagcgcagcccaaaggcgcggccgaauugggagaaaccacaauaaggagggagaucaguauauauacaugggccagccucuuaacaaugacgaggaucaugcucacuggaccgaagccaaaaugcuacuggacaacaucaauacacccgaggguauuaucccagcguuguucgaacccgagcgggaaaagucagcagccaucgauggggaguauagguuacgcggcgaggcuagaaaaacuuuuguugaacugaugaggcggggagaccucccugucuggcugaguuacaagguggccucugagggcuuccaguauuccgaucgucgcuggugcuuugacggggaacgaaacaaucaagugcuugaggaaaacauggaugucgagauuuggacgaaagagggagaaagaaagaaacugaggccacgguggcucgacgcucgcaccuacagcgaccccuuggcacugagagaguucaaggaauuugccgcugguaggcggucaguuaguggcgaucuaauacuggagaucgggaagcucccucagcaccuuacacagcgagcccagaaugcacuggacaacuuagugauguugcauaauagcgaacaaggaggcagagcguaucgccacgccauggaggagcugccggauacuauugaaacccucaugcugcuugcucugaucgccguacucacagguggggugaccuuguucuuucuguccggcaggggauuaggcaaaacuucuauugggcuacugugugucauggcaagcuccgugcuccuuuggauggcuucaguugagccacauuggaucgccgcaucuauaauccuggaguucuuuuugauggugcugcucauucccgagccugaccggcagcguacgccccaggauaaccagcuggccuacgucguaaucggacuucucuucaugauucugaccguggcugcgaaugagauggguuugcuggaaacaacuaagaaagacuuaggcaucgggcacguugccguggagaaccaccaucacgcagcuaugcuagaugucgaccugcauccagccagugccuggacccucuacgcaguggcuacaaccauaauuacuccuaugaugagacacacaaucgaaaacacgaccgccaauauuucgcuuacugcgaucgcuaaccaagccgcaauacugaugggauuggauaagggcuggcccaucagcaaaauggacauuggugucccacugcucgcccuggggugcuauucccaggugaauccucuuacauuaaccgcugcaguucugaugcucguggcccauuacgcgaucauuggcccgggauugcaggcuaaggccaccagggaggcacaaaagcgcacagccgcuggcaucaugaaaaaccccacuguagaugggauaguggccauugaccuggauccagucguuuaugacgcaaaguuugaaaaacagcuaggacagaucaugcugcucauccuuuguacgucucagauucuguugaugcggaccacaugggcucugugcgagucaaucacucucgccaccggcccucugacaaccuuaugggaggguagccccgggaaguucuggaauacuacgauagcgguguccauggccaacauuuuccgaggaaguuaccuugcaggcgcuggucuggccuuuucucucaugaaaagccuaggcgggggaagaaggggcacaggggcacaaggagaaacccugggcgagaaguggaagcgccaguugaaucagcugucaaaauccgaguucaacacuuauaagcggagugguaucauggaggucgacagaagcgaagcuaaagaggggcucaagcguggagagaccacaaaacacgccgugucuaggggcacugccaaacuucggugguuuguagaacgcaauuucgugaagccagaggguaaaguuauugaucugggcugugggcgaggaggcugguccuacuauugcgcgggguugaagaaagugaccgaagucaagggauacacaaaaggcgguccugggcacgaggaacccaucccgauggcuacguacggauggaaccuggugaagcuccauucaggcaaagacgucuuuuucauaccaccugagaagugugauaccuuacugugcgacaucggcgagagcucgcccaauccaacuauugaagaggggagaacacuuagggugcugaagaugguugaacccuggcuacggggaaaccaguuuuguaucaaaauucucaauccuuauaugccgucuguaguggagacccuggagcgcaugcaaagaaagcacgguggcauguuggucaggaacccccugagucgaaauuccacucaugaaauguacugggugagcugcgggacaggaaacaucguuucagcagugaauaugaccucccggaugcuccuuaaccguuucacgauggcccacagaaaaccaaccuaugagcgcgaugucgaccugggcgcugguacaaggcacguggccguagaaccugagguggcaaacuuagauauuaucgggcagcggauagaaaauauuaagcaugagcacaaacugacuuggcauuacgacgaggauaaccccuauaagaccugggccuaccacggaucuuaugaaguuaagccuagcggcagugcuuccagcauggucaauggcguggugaaauugcucacaaagccaugggacgucauccccaugguuacucagaucgcgaugaccgauacaaccccuuuugggcagcaaagaguguucaaagagaagguagacacucgcacgccaaaagccaagaggggaacagcacagauuauggaagugaccgcuaaguggcugugggguuuucuaucucgaaacaaaaagccccggauauguacuagagaggaguucaccaggaaaguccgcucaaaugccgcaaucggcgccguguuuguugacgagaaccaguggaauagugcuaaggaggccguggaagaugagcguuucugggaccuuguccaucgggaaagagagcugcacaaacaagggaagugcgcgacaugcguguacaacaugaugggaaagagggagaagaagcucggcgaguucgguaaagcaaaggggucccgcgccauuugguacauguggcugggagcucgauuuuuggaguucgaagcccugggcuuuaugaaugaggaucacugguucagccgggaaaacucucucucgggcguagagggggagggacuucauaaacuggguuauaucuuaagagacauuucaaagaucccgggcgggaauauguacgcagaugacacggcuggaugggauaccaggauaacugaagacgaucugcagaacgaggccaaaaucacagacauuauggaaccugagcacgcuuugcucgccaagagcaucuuuaagcugaccuaucagaauaaaguugugcgcguccagagaccagcaaagaacggcacugugauggaugugauuucccggagggaccaacgugguagugggcaggucggaacauacggccuaaauaccuucacaaacauggaagcgcagcuuauccgacagauggagucugagggcauauuuagccccuccgaacuggagacuccuaaccucgccgggcgcguucuggauugguuggaaaaacauggaguggagagauuaaagcggauggcuauuucaggugacgacuguguagugaaaccaaucgaugacagguucgccaccgcacugacggcucucaaugauaugggcaagguccgcaaggacaucccccaaugggaaccgaguaaaggguggaacgauuggcaacaggugccuuuuugcucucaccacuuccaucagcuuauuaugaaggacggaagagagauaguugugcccugucggaaucaagaugagcuggucggcagggcccgagugagccagggugcaggguggucccuacgugaaaccgccugccugggaaaaucauaugcgcagauguggcagcucauguacuuucacagacgcgacuugcggcuggcugccaacgcaaucuguagcgccguaccaguugauugggugccuacaucuaggacuaccugguccauucaugcucaccaucaauggaugacaacugaggacaugcuuagugucuggaauagaguguggaucgaagagaaccccuggauggaagauaagacccacauuagcucguggggcgacguuccauaucugggcaaacgcgaggaccaguggugcgggucccucaucggauuaacggcccgggcaacaugggcuaccaauauacagguggccaucaaccaagucaggcgacugauugguaaugagaacuacuuggauuacaugacuucuaugaagagauucaagaaugaaucagaccccgagggcgcgcugugguga

SEQ ID NO: 13867 - RNA, 9879 nt, Artificial Sequence
  derived and/or modified CDS sequence (opt3) from DENV-1__FJ898427__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauugugccuggaagacuauggcaaugguccugucaaucgcuagcuuguucccccugugcuuaaguaccacgucucagaagacaaccuggcucccgguacugcuuggcucccugggguguaaaccuuugacuauguuucucauuacagagaccaagaucuggggaagaaaaagcuggccacugaaugaagguauaauggccgugggcguugugucgauccuacugucaucucuucucaagaacgaugucccccuggccgggccuuugauugcuggaggcauguuaaucgcaugcuacgugauuagugguuccagcgccgaccugucucucgagaaagcggcugagguaagcugggaagaggaagccgagcacuccggggcaucacauaacauccugguggucguucaggaugacggaacuaugaagauaaaagaugaagagagggacgauacacuuaccauucuguugaaggccacgcuacuggcugugaguggcguguauccccucagcaucccagcaacucuguucgucugguacuuuuggcaaaagaaaaagcagcgaucuggcgugcuuugggacaccccuucacccccagagguugaacgcgccguauuagaugacgggaucuaucggauuaugcagagaggacugcucgguaggagccaggugggcgucgggguguuccaagagaauguuuuccacacaauguggcacgugacccguggagcggucuugauguaccagggcaaacgccuggaaccgaguugggcuagcgugaagaaagaccucauauccuauggugggggauggcggcugcagggcucuuggaacacaggcgaggagguacaggucaucgccguggaaccugggaagaaucccaagaacguucaaacugcaccaggaaccuuuaaaacgcccgagggugaagugggcgccauugcucuugauuucaagccugggacaucgggaagcccaaucgucaauagagagggcaaaauugugggucuguacgggaacggaguugugacuaccucaggcacauacgucuccgccaucgcacaggcuaaggccagucaggaaggccccuugccugagauagaggacgaaguguuuaggaaacgaaaucuaaccaucauggaucugcauccggggucuggaaagacucggcgcuaucucccagcgauuguaagagaggccaucaagaggaaauuacggacccugauucuugcacccacacgagugguugcuagcgaaauggccgaggcucugaaggguaugccuaucagauaccaaacgacugcagucaaauccgaacacaccggcaaggagauaguggaccucaugugucaugccacauucaccaugcgcuugcugucaccagugaggguccccaacuauaauaugauuaucauggaugaggcccacuuuacugacccuucuagcaucgcugcgcguggguacauuaguacacggguaggaaugggcgaagcagccgcuaucuucaugaccgccacgccgcccgguuccguggaggcauuuccacagagcaacgccguuauacaggaugaagagagagacauuccugaaaggucuuggaacucaggguaugaguggaucacugauuuccccggaaaaacagugugguuugucccauccauuaagaguggcaacgacaucgcuaauugccuccgcaagaacggcaaacgagugauacagcugagcagaaagaccuucgauaccgaguaccagaaaacuaagaauaacgacugggacuauguugugacaaccgauauuucggaaaugggggcgaacuuucgggccgacagggucaucgauccucgccguugccuuaaacccgugauccuaaaggacggaccagagagaguaauucuggcagguccgaugccugugacaguugcuucugccgcacagcggaggggccgcaucgggcgaaaucauaacaaggaaggagaucaguacauuuacaugggccagcccuugaauaacgacgaggaucacgcccacuggacugaggcuaaaauguuacuggacaauauaaacacgccagaagguaucauucccgcccucuucgagccugaaagagagaaguccgcggcaaucgauggggaauaucggcugaggggcgaggcccgcaaaaccuucgucgagcuuaugagaaggggagaccugccaguguggcucagcuacaagguggcuucagaaggcuuucaauauagugaucggcguugguguuucgacggggagcgcaauaaccaggucuuggaagagaauauggauguugaaaucuggacaaaagagggagagcgaaagaaacugagacccagguggcuagacgcccggacuuacucugacccucuggcucuccgcgaauuuaaggaguucgcagccgguagaagguccgugagcggcgaucuuauucuggaaauagggaaguuaccgcagcauuugacccagcgggcucaaaacgcccuggacaaucucguaaugcugcacaacucagagcagggaggccgagcauauagacaugcgauggaggaacuuccagauacaaucgagacccugaugcucuuggcccugauugcuguguuaacugguggggucacgcuauuuuuccugaguggccgcggacucggcaaaaccagcaucgggcuucugugcgugauggccuccucuguuuugcuguggauggcaagcguggaaccccacuggauugcugccuccaucauacucgaguuuuuccugaugguccuucucaucccugaacccgacaggcagcggacaccacaggauaaucaacuggcauacguagugauuggauugcuguuuaugaucuuaacuguugccgcuaacgagaugggucuacuggagaccacaaagaaagaccucggcauugggcacguggcggucgaaaaucaucaccaugccaccaugcuugauguggaccugcacccugcaucagcuuggacuuuguaugccgucgccacaacgaucauaacccccaugaugcgucauacuauugagaacacaaccgcaaacaucucucugaccgcuauugccaaucaggcggcuauccucaugggacuggauaagggcuggccaauaaguaaaauggacaucggugugccucuuuuagcccugggguguuacucgcagguuaacccgcucacauugacugcagccgugcugaugcuaguagcucacuacgcaauuaucggccccggacugcaagccaaggcgacgagagaagcucagaagaggaccgccgcaggcauuaugaaaaauccaacaguggaugggaucgucgccauagaccucgauccuguuguguaugacgcuaaguucgagaaacagcuuggacagauuaugcuguugauccugugcacuagccaaauccuccugaugcgcaccacaugggccuuaugugaauccauuacccuugcaacuggcccccugacgacacucugggaggguucuccagggaaguuuuggaacaccacuaucgcugucucaauggccaauauauuccggggaagcuaccuagcgggcgccggucuggcauuuuccuugaugaaaagucugggcgggggacgaagaggcaccggggcucagggagagacacucggcgaaaaguggaagaggcagcuuaaccagcugucuaaaagcgaguucaauauuuauaagcgcucagguaucauggaaguggaccgguccgaggccaaagaaggguugaagagaggagagacuacccgucacgcaguaaguaggggcacagcuaaacugcggugguucguggagcgcaaccucguuaagccugaagguaaggugauugauuuaggcugcgggcgaggaggcuggagcuacuauugugccgggcugaaaaaggucacggaggugaaaggauacaccaagggcggucccgggcaugaggagccgaucccaauggccacuuauggauggaaucuugucaaacugcacucuggcaaggacguguuuuucacaccucccgaaaaaugcgauacccuacucugugacauaggcgaguccucaccaaaccccacuaucgaggaagggagaacacugaggguuuugaagaugguagagccuuggcugcggggaaaucaauuuugcauuaagauccucaacccguacaugcccagcguggucgaaacccuugagcagaugcagcgcaaacaugguggcaugcuggugagaaauccauuaucgaggaacucuacgcacgagauguacuggguuaguugugggaccggaaauauuguguccgcggucaacaugacaagccgaaugcuguugaaucgguucacuauggcucaccguaagccuaccuaugaaagagauguggaccucggcgcagguacacgccauguagccguggagcccgaaguugcuaaccuggauaucauugggcagaggaucgagaacauaaaacacgaacauaagucaacuuggcacuacgacgaggauaauccuuauaaaaccugggccuaccauggauccuaugaggucaagccaucuggcagcgcaaguuccauggugaacggcguggucaagcuacuuacaaaacccugggacguuauuccuauggugacccaaaucgccaugacugauacgacaccauuugggcagcagcggguauucaaggaaaaaguggacaccagaacucccaaggcuaaacgcggaaccgcgcaaaucauggaggucacagccagguggcugugggguuuucucagccgaaauaagaagccgcggauuugcacgagagaagaguucaccaggaaagugcgcucuaacgcagcuauaggcgccguuuuuguggacgaaaaucaguggaacucagcaaaggaggccgucgaggaugaacguuucugggaccuggugcagaaagagcgggaauugcacaagcaggggaaaugcgcuacuuguguauacaauaugaugggaaagagagagaagaaacugggcgaauuugguaaggccaaagggaguagggcgaucugguauauguggcucggagcacgcuuccuugaguuugaggcccugggcuucaugaacgaagaucacugguucucccgagagaauagcuuaucuggcguugaaggggagggacugcauaaguuggguuacauucuccgggacaucucgaaaauuccuggcgggaacauguacgcugaugacacagccggaugggauaccagaaucacugaggacgaucugcaaaaugaagcaaagauaacagacaucauggagccagaacacgcucuacuugccaccucaauuuuuaaacugacauaucagaacaagguggucagggugcagcgccccgcuaagaauggcacugugauggaugucaucagcagacgggaccagagggguuccgggcaaguuggaaccuacggccucaacacguucaccaauauggaggcccagcugauucgucagauggaaagugagggcaucuuuuugccuucugaguuagaaacaccaaaccuggcagagcgagugcucgauuggcuugaaaaauaugggguagagcgccugaagagaauggcgauaagcggagacgacugcguggucaaacccauugaugaccgguucgccacugcucuaaccgcccugaacgauauggguaaggugaggaaagacaucccgcagugggaaccuuccaagggcuggaaugauuggcaacagguucccuuuuguucacaucacuuccaccagcucaucaugaaggacgggcgcgagauuguggucccaugcagaaaccaggaugaguuggugggacgggcaaggguaagucaaggcgcugguuggucucugcgagaaacagccugucuugggaaaagcuacgcacagauguggcagcugauguauuuucaucguagagaccuccgcuuagccgcgaaugcuauaugcuccgccguuccuguggauuggguccccacuucacggaccacguggagcauccacgcacaucaccaauggaugacaaccgaggacaugcugucuguguggaacaggguuuggauugaagagaauccauggauggaagauaagacucauguguccaguuggggagacguccccuacuugggcaaaagagaggaccagugguguggcagccugaucgggcucacagcccgcgcuaccugggccucgaacauucagguggcaaucaaucagguacggaggcuuauaggaaacgagaauuaucuggauuacaugacuuccaugaagcgauucaaaaacgaaggugacccugagggcgcucuaugguga

SEQ ID NO: 13868 - RNA, 9879 nt, Artificial Sequence
  derived and/or modified CDS sequence (opt3) from DENV-1__JF937599__SS-prME
agcgugaccaugcugcucaugcuuaugcccaccgcccuggcuuuccacuugacugccagaggaggggaaccucauaugaucgucuccaagcaggaaagaggaaaaucuuuacuguuuaagacgucagccgguguuaacaugugcacccuaauugcgauggaccucggcgaguucugugaagauaccaugacuuacaaaugcccacggauaaccgaagcugaaccggacgauguggacuguuggugcaaugccacagauaccuggguaacuuaugggacauguagucaaaccggagagcaccgccgagacaagcguagcguggcacuggcaccccaugucggccuuggucuggagacgagaacugaaaccuggauguccucugagggggcuuggaaacagauccagaggguggaaacaugggcauugcggcacccuggauuuacuguuauugcccucuuccuggcucaugccaucggcaccucgauuacacagaagggcaucauauuuauccugcucauguuagugaccccaucaauggcgaugcgcugcgucgggauuggaagcagagauuucguggagggucugaguggcgcaacguggguagacguugugcuugagcacggguccugugucacuacaauggccaaggauaaacccaccuuggacaucgaacugcuaaagacugaggugacaaacccugcugugcucaggaaacugugcauugaagccaagaucucuaauaccacgaccgauagccgguguccaacacaaggagaggcaacucuugucgaagaacaagacgcuaacuuuguuugccgccgaaccuucguggauagaggcugggguaauggguguggacuguuuggcaaaggcuccuugauaacaugcgccaaguucaagugcguaacuaaacucgaggggaagauugugcaguacgaaaaccugaaauauucagucaucgugaccguucacacaggagaccagcaucaaguggguaaugagaguaccgaacacggcacuacggcgacaauuacaccccaggccccuagcacugagauccaguuaaccgacuacggggcacugacacucgauuguucuccaaggaccggacuugacuuuaacgaaaugguccuguugacuaugaaggagaaauccuggcuagugcauaagcagugguuccuggaucucccgcugcccuggacaucaggcgcuagcacgagucaagagaccuggaaucggcaggaccuucugguaacuuuuaaaacagcccacgcuaagaagcaggaaguuguggucuuggguucucaagagggggccaugcacaccgcacucacaggcgccacugaagugcagaccuccggaacgaccacaaucuucgcuggccaucugaaaugccguuuaaagauggauaaacugacucuaaaggggaugagcuaugucauguguaccggaucguucaaacucgagaaggaaguggcggagacacagcacgguacuguucuggugcagauuaaguacgagggcaccgacgcaccuugcaaaauaccauuuucuacgcaagaugaaaaggggguaacacagaacggacgccuuaucaccgccaaucccauugucacugacaaagagaagccugugaacaucgaagcugagccacccuucggcgaguccuauauaguuauuggugccggggaaaaagcauugaagcugucaugguuuaagaaaggcaguagcaucggaaagauguucgaggccacagcuagaggcgccaggcggauggcaauccucggggauaccgcgugggacuuuggauccauugguggcguguucacuucugucgggaaacuggugcaucagaucuuuggaaccgcuuacggcguacuuuucagcggugugucauggacaaugaagauugggauaggcguucuguugacguggcucggacugaauagucgauccaccagcuuaucuaugacuuguaucgccgucggccuggugacacuauaccucggggugaugguccaggcagauucaggaugcguuauuaacuggaaaggccgcgaacugaagugugguagugggaucuuugugaccaaugaggugcacacauggacugaacaauauaaguuccaggccgacagcccgaaaagacuuuccgcugccaucggaaaggcaugggaggagggcguaugcgguauuaggucugcuacccgguuggaaaacauaauguggaaacagaucucgaacgagcugaaucauauucuccuggaaaacgacaugaaguuaacggucgugguuggcgauguggccgggauccuggcgcagggcaagaagaugauucgcccucaacccauggaguacaaauauagcuggaaguccuggggcaaggccaaaaucauaggggcugacguccagaauacaaccuuuaucauugauggaccaaacacuccugaaugucccgacgaucagagagcauggaauaucugggagguggaggacuacggcuucgguauuuuuaccacaaacaucuggcuuaaguugagggauucauauacucagguuugcgaccaccgucucaugagugccgcuauaaaagauucuaaggccgugcacgcagacaugggguacuggauugaaagcgagaaaaaugaaaccuggaagcuggcgcgggccuccuucaucgagguaaagacauguauuuggccaaaaucacauacgcuauggagcaacggaguccuggaaucugagaugaucauacccaagaucuauggcgguccuauuucccaacacaauuaccgaccaggcuacuucacccagacugcugggccguggcaucucggaaaacuggagcuugauuuugacuugugcgaaggcacaaccgugguggucgaugagcacugcgggaacagaggacccagucugaggacuacaaccguuacgggcaagaucauucacgaaugguguugccgcagcuguacuuuaccuccacuccgguucaaaggugaggacgggugcugguauggaauggagaucagacccgugaaggaaaaggaggaaaaucugguaaaaucuaugguguccgccggcucaggugaggucgacaguuuuagccuuggccuguuguguauaucgauuaugaucgaagaggugaugaggucccgcuggucucgaaagaugcucaugaccgggacacuggcaguuuucuuucuacugaucaugggacagcucaccuggaacgaucugauucggcuuugcaucauggugggcgcuaaugccagcgaccguauggggaugggaacuacauacuuggcacugauggccaccuucaaaaugagaccuauguuugcugucggcuuacucuucaggcgccugacaucacgggaggugcuucugcuaacuauuggucucagucugguugcguccguggaauugccaaacucucuggaggaauuaggggauggacucgccaugggcauaaugauccugaaacuucugaccgacuuucaaagccaucaguugugggcaacgcuccugucccuaacauucauuagaaccacuuuuucacugcacuaugcuuggaaaaccauggccaugguccuuagcaucguaagucucuucccccuguguuugucuacaacuucccagaagaccacguggcugccgguguuacucggcagccuggggugcaagccucuuacaauguuucugauugccgagaauaaaaucuggggaaggaagucguggccauugaacgaagguauaauggcuguuggcaucgugucaauucuccugucuagucuacugaaaaacgaugucccccuugcagggccucucaucgccggaggcaugcugauugcguguuacgugaucuccgguagcucugcugacuugagcuuagagaaggccgcagagguauccugggaagaggaagccgagcauucaggggcuagucacaauauacugguggaaguccaggaugacggaaccaugaaaauuaaggaugaggagcgagacgauacucucacaauccugcuuaaagcaacccuguuggccguuagcggcguguauccccuaucuaucccagcgacucuguucgugugguacuucuggcaaaagaagaaacagcgcuccggcguccucugggacacaccuucacccccagaaguggagcgggcuguucuggaugacgggauuuauagaauaaugcagaggggacuuuuaggucguagucagguaggcgugggggucuuucaagaaaacguguuccauaccauguggcacguuacgcgcggagccgugcugauguaccagggcaagcggcucgagccgagcugggcauccgucaaaaaggacuugaucucuuacggugggggauggagacugcagggcucguggaauacuggcgaggaagugcagguaauugccgucgagccugggaaaaaccccaagaaugugcaaaccgcuccaggaacauuuaagaccagcgaaggugagguuggcgccaucgcacucgauuucaaacccgggacaucaggauccccuauugugaacagggaaggcaagaucgucggucuguaugggaauggagugguuacuaccaguggcacguacgugucugcuauagcccaggcgaaagccagccaggagggcccacuucccgagaucgaagacgaggucuuucgaaagcggaaccugacaauuauggauuugcacccuggguccggaaaaacucgcagauaucuaccggcaaucgugagggaagcuauuaagcggcgacugagaacccucaucuuagccccaacacgcguaguggcuucagagauggcagaagcccugaaggguaugcccauaagguaccaaaccacugccguuaaaucugagcauaccggcaaggagauugucgaccuuaugugccacgcuacauucacgaugcgucugcucagcccugugcgggugccaaauuauaacaugaucaucauggaugaagcgcauuuuacugaccccaguuccauugcagccagaggguacaucagcaccagggucggaaugggcgaggcugccgcaauauucaugacagccaccccuccggguucuguagaggcuuuuccccagucaaaugcggugauucaggaugaggaacgcgacaucccagagcgauccuggaacaguggguaugaguggauuacugauuucccuggaaaaacaguuugguuugugcccagcaucaagucgggcaaugacauagccaacuguuugaggaaaaauggcaagcgggucauucagcugucuaggaagaccuucgauacggaauaccagaaaacuaagaacaacgacugggacuacgugguuacaaccgauaucuccgagaugggggcaaauuuccgcgcugaccgugugaucgauccaagacggugccucaaaccugucauucugaaggacggacccgaaagggugauccuugccgguccaaugccgguaaccguggcaagcgccgcucagcgccgaggcagaauugggcggaaccacaauaaagagggagaucaguauauauacaugggccagccucuaaacaaugacgaggaucaugcccacuggacugaagcgaagaugcuguuggacaacaucaauacacccgaggguauuaucccagcauuauuugaacccgagagggaaaagucagccgcuaucgauggggaguaucgccugagaggcgaggccaggaaaaccuucguugaacucaugcggcguggagaccugccugucuggcuuaguuacaagguggcuucugagggcuuucaauauuccgaucgccgauggugcuucgacggggaaagaaacaaucaggugcuggaggaaaacauggaugucgagauuuggacaaaagagggagaaaggaagaaacuccggccacgcugguuggacgcaagaacuuacagcgacccccuggcccuaagggaguuuaaggaguucgcugccggucggcgaucaguuaguggcgaucugauacucgagaucgggaaacuuccucagcaccugacgcagagagcacaaaaugcguuagacaacuuggugaugcugcauaauagcgaacagggaggccgcgccuauaggcacgcuauggaggagcucccggauaccauugaaacacugaugcuucuggcccucaucgcaguauugacugguggggugacccuguuuuucuuauccggccggggacuaggcaagacaucuauugggcugcucugugucauggcuagcuccgugcuucuguggauggccucaguugagccacauuggaucgcagccucuauaaucuuggaauuuuuccugauggugcuccugauucccgagccugaccgucagagaacaccccaggauaaccaacuugcuuacgucguaaucggacuccuguuuaugauuuugacuguggcggccaaugagaugggucuguuagaaacgaccaagaaagaccuaggcaucgggcacguugcaguggagaaccaccaucacgcugccaugcuggaugucgaccuccauccagccagugcauggacacuuuacgcuguggccacuaccauaauuacaccuaugaugaggcacaccaucgaaaacacuacagcgaauauuucgcugacggcuaucgccaaccaggcagccauauugaugggacuggauaagggcuggcccaucagcaaaauggacauuggugucccacuccuggcucuugggugcuauucccaggugaauccuuuaacccugacugcagccguucucauguugguggcgcauuacgcuaucauuggcccgggacugcaagccaaggcaacacgcgaggcccagaaacggaccgcugccggcaucaugaagaaccccaccguagaugggauaguggcaauugaccuagauccagucguuuaugacgcuaaguucgaaaaacagcugggacagaucaugcuccuuauccuguguacaucucaaauuuugcugaugcgaacuacgugggcccucugcgagucaaucacccuggcgacaggcccuuuaacuacccuuugggaggguagccccgggaaguuuuggaauacaaccauagccguguccauggcaaacauuuucagaggaaguuaccuggcuggcgccggucucgcauucucucuaaugaaaagccugggcgggggaaggcgcggcacuggggcucagggagaaacguugggcgagaaguggaaacggcagcugaaucagcucucaaagccagaauuuaacacauauaagagauccgguaucauggaggucgaccguagugaagccaaagaggggcuuaagaggggagagaccacuaaacacgccgugagccggggcaccgcgaagcugcgcugguucguagaacgaaauuuggugaaaccugaggguaagguuauugaucugggcugugggagaggaggcuggucuuacuauugcgcugggcucaagaaagugacagaagucaagggauacacuaaaggcggucccgggcacgaggaaccgaucccaauggcaaccuacggauggaacuuagugaagcugcauuccggcaaagacgucuuuuucauaccucccgagaagugugauacacuucugugcgacaucggcgagucaagcccaaaucccacgauugaagaggggaggacccuacgggugcucaaaaugguugaaccuuggcugcgcggaaaccaauuuuguaucaagauuuugaauccguauaugcccucgguaguggagacucuggagcagaugcagagaaagcacgguggcaugcucgucaggaacccacuuucucgaaauaguacacaugaaauguacuggguguccugcgggaccggaaacaucguuagcgccgugaauaugacuucacggaugcuguuaaaccguuucacaauggcucacagaaaaccuaccuaugagcgcgaugucgaccugggcgccgguacgaggcacguggcaguagaacccgagguggccaacuuggauauuaucgggcagcggauagaaaauauuaagcaugagcacaaauccaccuggcauuacgacgaggauaacccuuauaagacaugggcuuaccacggaucuuaugaaguuaaaccaagcggcagugcguccagcauggucaauggcguggugaagcuccugacuaagcccugggacgucaucccuaugguuacccaaaucgccaugacagauacuaccccauuugggcagcagagaguguucaaagagaagguagacacacgcacccccaaagcaaagaggggaacugcucaaauuauggaagugacggccaaauggcuaugggguuuucuuucucgaaacaagaagccgcggauauguacaagagaggaguucaccaggaaaguccgcucaaaugcagccaucggcgcuguguuuguugacgagaaccaguggaauagugccaaggaggcgguggaagaugagcguuucugggaccugguccaucgggaaagagagcuccacaaacaggggaagugcgcaacuugcguguacaacaugaugggaaaaagggaaaagaagcugggcgaguuugguaaagccaaggggucccgcgcuauuugguacaugugguugggagcccgauuccuggaguucgaagcacucggcuuuaugaaugaggaucacugguucagccgggaaaacucucuuucgggcguagagggggagggacugcauaaauuagguuauauccugagagacauuucaaagaucccuggcgggaauauguacgcugaugacaccgccggaugggauacaaggauaacggaagacgauuugcagaacgaggcuaaaaucaccgacauuauggaaccagagcacgcccuccuggcaaagagcaucuuuaaacuaacuuaucaaaauaagguugugcgcguccagagacccgcgaagaacggcacagugauggaugugauuucccggagggaccagcgugguagugggcaggucggaaccuacggccuuaauacuuucacaaacauggaagcccaacugauccgacagauggagucugagggcauauuuagcccuuccgaacucgagaccccaaaccuggcugggcgcguuuuggauugguuagaaaaacauggaguggagagacugaagcggauggccauuucaggugacgacuguguagugaaacccaucgaugacagguucgcaacagcucucacugcccuuaaugauaugggcaagguccgcaaagacaucccgcagugggaaccuaguaagggguggaacgauuggcagcaagugcccuuuugcucucaccacuuccaucagcugauuaugaaggacggaagagagauaguugugccaugucggaaucaggaugagcuagucggcagggcacgagugagccagggugccggguggucccugcgugaaaccgcgugccucggaaaaucauaugcucaaauguggcaguugauguacuuucacagacgcgaccugcggcuugccgcaaacgccaucuguagcgcuguaccuguugauugggugcccacgucuaggaccacaugguccauucaugcccaccaucaguggaugacuaccgaggacaugcugagugucuggaauagaguguggaucgaagagaacccauggauggaagauaagacacacguuagcucguggggcgacgugcccuaucucggcaaacgcgaggaccaauggugcggguccuuaauuggacugacugcacgggcuaccugggccacgaauauccaggucgcgauaaaccaggugaggcgauugcuggguaaugagaacuaccucgauuacaugacaucuaugaagagauucaaaaaugaaucagacccugagggcgcucuuugguga

SEQ ID NO: 13869 - RNA, 9879 nt, Artificial Sequence
  derived and/or modified CDS sequence (opt3) from DENV-1__FJ898431__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccgugcuguuucuacugaucaugggacagcucacauggaacgaucugauucggcuuugcaucaugguuggcgcaaaugcuagcgaccguauggggaugggaaccacauacuuggcccugauggcaacuuucaagaugagaccuauguuugccgugggcuuacucuucaggcgccugaccucacgggagguccuucugcuaacgauuggucucagucugguggcuuccguugaauugccaaacucucuggaggaauuaggggauggacucgcgaugggcauaaugauccugaaacuucugacagacuuucagagccaucaauugugggccacccuccugucccuaacuuucauuaagaccacauuuucacugcacuaugcauggaagacuauggcuauggugcuuagcaucgucagucucuucccccuguguuugucuaccacgucccagaaaacaaccuggcugccgguauuacucggcagccuggggugcaagccucuuacuauguuucugauugccgagaauaaaaucuggggaagaaagucguggccauugaacgaagguauaauggccgugggcaucguuucaauucuccugucuagucuacugaaaaacgaugugccccuugcugggccucucaucgcaggaggcaugcugauugccuguuacgucaucuccgguagcucugcggacuugagcuuagagaaggcugccgagguguccugggaagaggaagcagagcauucaggggccagucacaauauacugguagaagugcaggaugacggaacaaugaaaauuaaggaugaggagagggacgauacccucacuauccugcuuaaggcuacacuguuggcagucagcggcguuuauccccuaucuaucccagccacccuguucgugugguacuucuggcagaaaaagaaacaacgauccggcgugcucugggacacgccuucacccccagaagucgagcgcgcggugcuggaugacgggauuuaucggauaaugcagagaggacuuuuagguaggagucagguuggcguagggguguuucaggaaaacgucuuccauacuauguggcacgugacccguggagcuguucugauguaccaaggcaagcgccucgagccgagcugggccuccgugaaaaaggacuugaucucuuacggugggggauggcggcugcagggcucguggaauacaggcgaggaaguccaggugauugcaguagagccugggaagaaccccaaaaauguccagaccgccccaggaacauuuaagacuagcgaaggugaggugggcgcuaucgcccucgauuucaaacccgggaccucaggauccccuauuguuaacagagaaggcaagaucgugggucuguaugggaauggagucgugacgacaaguggcacuuacguuucugcaauagcucaagccaaagcgagccaggagggcccacuucccgagaucgaagacgagguguuuaggaagcgaaaccugaccauuauggauuugcacccuggguccggaaagacacggcgcuaucuaccggccaucgucagagaagcaauuaaaaggaagcugcggacccucaucuuagcuccaacucgagugguagccucagagauggcugaagcacugaaagguaugcccauaagauaccagaccacagccgugaagucugagcauacgggcaaagagauuguugaccuuaugugccacgccacuuucaccaugcgccugcucagcccugucagggugccaaauuauaacaugaucaucauggaugaagcucauuuuacagaccccaguuccauugcggcacguggguacaucagcacccgggugggaaugggcgaggccgcugccauauucaugacugcaacaccuccggguucugucgaagccuuuccccaaucaaaugcuguaauucaggaugaggaaagagacaucccagagagguccuggaacaguggguaugaguggauuaccgauuucccuggaaagacggugugguuuguucccagcaucaagucgggcaaugacauagcgaacuguuugcgcaaaaauggcaagcgagugauucagcugucuagaaaaacuuucgauacagaauaccagaagaccaaaaacaacgacugggacuacgucgugaccacugauaucuccgagaugggggccaauuuccgggcagacaggguuaucgauccacgccguugccucaagccugugauucugaaggacggacccgaaagagucauccuugcugguccaaugccggugacaguagccagcgcagcccaacggaggggccgcauugggcgaaaccacaauaaagagggagaucaguauauauacaugggccagccucuaaacaaugacgaggaucaugcucacuggaccgaagccaagaugcuguuggacaacaucaauacacccgaggguauuaucccagcguuauuugaacccgagagagaaaaaucagcagccaucgauggggaguaucggcugaggggcgaggcucgcaagacuuucguggaacucaugagaaggggagaccugccuguuuggcuuaguuacaaagucgccucugagggcuuucaguauuccgaucggcguuggugcuucgacggggaacgcaacaaucaagugcuggaggaaaacauggauguggagauuuggacgaaggagggagaacgaaagaaacucagaccaaggugguuggacgcucggaccuacagcgacccccuggcacuacgcgaguuuaaagaguucgccgcugguagaaggucagucaguggcgaucugauacucgagaucgggaaacuuccucagcaccugacacagcgggcccagaaugcauuagacaacuugguuaugcugcauaauagcgaacaaggaggccgagcguauagacacgccauggaggagcucccggauacuauugaaacccugaugcuucuggcucucaucgccguguugacaggugggguaacccuguuuuucuuauccggccgcggacuaggcaagacuucuauugggcugcucugugugauggcaagcuccguccuucuguggauggcuucaguggagccacauuggaucgccgcaucuauaaucuuggaauuuuuccugaugguucuccugauucccgagccugacaggcagcggacgccccaggauaaccagcuugccuacguggucaucggacuccuguuuaugauuuugaccguagcugcgaaugagaugggucuguuagaaacaacuaaaaaggaccuaggcaucgggcacguggccguugagaaccaccaucacgcagcuaugcuggauguggaccuccauccagccagugccuggacccuuuacgcagucgcuacaaccauaauuacuccuaugaugcgucacacaaucgaaaacacgaccgccaauauuucgcugacugcgaucgcuaaccaagccgcaauauugaugggacuggauaaaggcuggcccaucagcaagauggacauuggugugccacuccuggcccuugggugcuauucccaggucaauccuuuaacacugaccgcugcagugcucauguugguugcccauuacgcgaucauuggcccgggacugcaggcuaaggccaccagagaggcacaaaagaggacagccgcuggcaucaugaagaaccccacuguggaugggauaguagccauugaccuagauccaguggucuaugacgcaaaauucgaaaagcagcugggacagaucaugcuccuuauccuguguacgucucagauuuugcugaugcgcaccacaugggcucucugcgagucaaucacucuggccaccggcccuuuaacaacccuuugggaggguagccccgggaaauuuuggaauacuacgauagcgguuuccauggccaacauuuuccggggaaguuaccuggcaggcgcuggucucgccuucucucuaaugaaaagccugggcgggggacgaagaggcacaggggcacaaggagaaaccuugggcgagaaguggaaaaggcagcugaaucagcucucaaaguccgaauuuaacacuuauaaacgcagugguaucauggagguggaccggagcgaagcuaaggaggggcuuaaaagaggagagaccacaaagcacgccgucucucguggcacugccaagcugaggugguucguggaacggaauuugguaaaaccagaggguaaggugauugaucugggcugugggcgcggaggcugguccuacuauugcgcggggcucaaaaagguuaccgaagugaaaggauacacaaagggcgguccugggcacgaggaacccaucccgauggcuacguacggauggaacuuagucaaacugcauucaggcaaggacguguuuuucauaccaccugagaagugugauacccuucugugcgacaucggcgagagcucgcccaauccaacuauugaagaggggcgaacacuaagaguccucaaaaugguggaacccuggcugaggggaaaccaguuuuguaucaagauuuugaauccuuauaugccgucuguuguagagacccuggagcaaaugcagcggaaacacgguggcaugcucgugcgcaacccccuuaguagaaauuccacucaugaaauguacugggucagcugcgggacaggaaacaucgugucagcaguuaauaugaccuccaggaugcuguuaaaccgauucacgauggcccaccggaagccaaccuaugagcgugauguggaccugggcgcugguacaagacacgucgccguggaaccugagguagcaaacuuggauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaagcuccugacaaaaccaugggacgugauccccauggucacucagaucgcgaugaccgauacaaccccuuuugggcaacagaggguuuucaaggagaaaguggacacucggacgccaaaggccaagagaggaacagcacagauuauggaaguaaccgcuaaauggcuaugggguuuucuuucacgcaacaagaaacccaggauauguacucgagaggaguucacccggaaggugagaaguaaugccgcaaucggcgccgucuuuguggacgagaaccaauggaacuccgcuaaagaggccguugaagaugagagguucugggaccuggugcaucgcgaacgugagcuccacaagcaggggaagugcgcgacaugcgucuacaacaugaugggaaaacgggaaaagaaacugggcgaguuugguaaggcaaaagggagcagagccauuugguacaugugguugggagcuagguuccuggaguucgaagcccucggcuuuaugaaugaggaucacugguucucucgcgaaaacucgcuuucaggcguggagggggagggacugcauaaguuagguuauauccugcgagacauuagcaaaaucccgggcgggaauauguacgcagaugacacggcuggaugggauacccggauaacugaagacgauuugcagaacgaggccaagaucacagacauuauggaaccugagcacgcucuccuggccaaguccaucuuuaaacuaaccuaucagaauaagguaguuagagugcaaaggccagccaagaauggcacugucauggaugugauuagucgcagagaccagcgggguucuggacaggugggaacauacggccuuaauaccuucacaaacauggaagcgcagcugaucaggcaaauggagagcgagggcauauuuucccccucagaacucgagacuccuaaccuggccgggcgugucuuggauugguuagaaaagcauggaguugagcgacugaaacgcauggcuauuaguggugacgacugugugguaaagccaaucgaugacagauucgccaccgcacucacggcucuuaaugauaugggcaaggugcggaaagacaucccccagugggaaccgucuaagggguggaacgauuggcagcaggucccuuuuugcagccaccacuuccaucaacugauuaugaaagacggaagggagauagugguucccugucgcaaucaggaugagcuagugggcagagcccgggucucccagggugcaggguggucacugagggaaaccgccugccucggaaagagcuaugcgcagauguggcaauugauguacuuucaccgacgugaccugagacuugcugccaacgcaaucuguucugccgugccaguagauuggguuccuacaucccgcacuaccuggaguauucaugcucaccaucaguggaugacaacugaggacaugcugagcguguggaaucgggucuggaucgaagagaaccccuggauggaagauaaaacccacauuucguccuggggcgacgugccauaucucggcaagagggaggaccaguggugcgggucuuuaaucggacugacggccagagcaacaugggcuaccaauauacaaguugccaucaaccaggugcgccgguugauugguaaugagaacuaccuggauuacaugacuucaaugaagagguucaaaaaugaaagcgaccccgagggcgcgcucugguga

SEQ ID NO: 13870 - RNA, 9879 nt, Artificial Sequence
  derived and/or modified CDS sequence (opt3) from DENV-1__GU131678__SS-prME
agcgugacaaugcugcucaugcuuaugcccacagcacuggcuuuccacuugacuacgagaggcggggaaccucauaugaucgucuccaagcaggaaaggggaaaaucuuuacuguuuaagaccucagccgguguuaacaugugcacacugauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcugcucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcaugaccaaauuagaagggaagauaguacaguacgagaaccugaaauauucagugauugucacagugcacaccggagaucagcaucaaguugguaaugaaaguacugagcacggcacgacagccaccaucacuccccaggcgccuaccacagaaauucagcucaccgacuacggggcccuuacucuggacuguagcccaaggacaggauuggauuucaacgagauggugcuacugacgaugaaggagaaaucuuggcucguccauaagcagugguuucuggaccuuccgcugcccuggaccuccggcgcaucaacuagccaagaaacauggaaucggcaggauuugcucgugaccuucaaaacagcucacgccaagaagcaggagguaguugugcuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugucauguguacugguagcuucaaacuugaaaaggagguggcugagacccagcacggaacggucuuggugcagauuaaguacgaaggcacagaugcgccuugcaaaauaccauucucgacccaagacgagaaggggguuacucagaacggacgccugaucacagcaaaucccauugugaccgauaaagaaaagccuguaaacaucgaggccgagccacccuuuggcgaaucuuauauagucauuggugcuggggagaaagcccucaagcuguccugguucaagaaaggcucaaguaucggaaagauguuuaaagcaacugccagaggcgcuaggcggauggccauccuuggggacaccgcaugggauuucggaagcauugguggcguguuuacauccguugggaagcuggugcaucagaucuucggaacggcguacggcgucuuguuuucuggugugagcuggaccaugaaaauugggauaggcguacuccugacuugguuaggacuaaauucacgaaguacaucccuaagcaugaccuguaucgcugugggccucguuacacuguaccuuggggucauggugcaggccgacucuggaugcgugauuaacuggaagggccgcgaauugaagugugguucagggaucuucgucacuaaugagguucacaccuggacggaacaauauaaauuucaggcagauaguccgaagagacugagcgccgcuaucggaaaagccugggaggagggcgugugcgguauuagguccgcaacacggcucgaaaacauaauguggaagcagaucucuaacgagcugaaucauauuuuacuggaaaacgacaugaaauucaccgugguagucggcgacguggcugggauccuuguucagggaaagaaaaugauucgcccucaacccauggaguacaaguauucguggaaguccuggggcaaagccaagaucauaggggcggaugugcaaaauuccacuuuuaucauugacggaccaaacaccccugaaugucccgaugaccagagagccuggaauaucugggaggucgaggauuacggcuucgguauuuuuacaacuaacaucugguugaaacucagggacucauauacccaggugugcgaucaccgucugaugagugcugcaauaaaggacucuaaagccguucacgcugauaugggguacuggauugaaagcgagaagaaugaaacauggaagcuagcccgggcauccuucaucgaggugaaaacguguauuuggccaaagucacauacccuguggagcaacggaguacucgaaucugagaugaucauacccaaaauccacggcgguccuauuucccaacauaauuaucgaccaggcuacuucacucagacagcggggccguggcaccugggaaaacuugaguuggacuuugaucugugcgaaggcaccacugucgugguggacgagcacugcgggaacagaggacccaguuuaaggacaaccacggucacuggcaaaaucauucaugaaugguguugccgcagcuguacccucccuccacugcgguucagaggugaggaugggugcugguacggaauggagaucaggcccguuaaggaaaaggaggaaaaucuugugaaaucuaugguauccgccggcucaggugagguggacaguuuucuguugggccuccuguguauaagcauuaugaucgaagaggucaugcgcucgcgauggucccggaagaugcuaaugacagggacccuggcuguguucuuucuccugaucaugggacagcuuacuuggaacgacuugauucgucugugcaucaugguuggcgccaaugcaucugauagaauggggaugggaacaaccuauuuagcucucauggccacauucaaaaugaggccuauguuugcagugggccugcuuuuccgccggcugacuagcagagagguccuacuccugaccauugguuugucacugguggccaguguugaauuaccaaacucccucgaggaacugggggacggacuugcuaugggcauaaugauccugaaguugcucacggauuuucaaucuuaccagcugugggcgacacuacugagccuuaccuucauuaaaacuaccuuuucccuccacuaugccuggaagacaauggcaauggugcugucaaucgucagcuuguucccccuguguuuaaguacuaccucucagaagacgacauggcucccgguacugcuuggcucccuggggugcaaaccuuugaccauguuucucauugcugagaauaagaucuggggaaggaaaagcuggccacugaacgaagguauaauggccgugggcaucguuucgauucuacugucaucucuucucaagaacgacgugccccuggccgggccuuugaucgcuggaggcauguuaauugcauguuacgucaucagugguuccagcgccgaucugucucucgagaaagcggcugaggugagcugggaagaggaagccgagcauuccggggcaucacacaauauacugguagaagugcaggacgauggaacuaugaagauuaaagacgaggagcgagaugacacacuuaccauccuguugaaggccacucuacuggcugucaguggcguuuauccccucagcaucccagcaacacuguucguguggcauuucuggcaaaagaaaaagcagcgcucuggcgugcuuugggauaccccuucacccccagaagucgagcgggccguguuagacgaugggauuuacagaauaaugcagaggggacugcucggucguagccagguuggcguagggguguuucaagaaaacgucuuccacacgauguggcacgugacucgcggagcgguuuugauguaucagggcaaacggcuggagccgaguugggcuagcgugaagaaagaccucaucuccuacggugggggauggagauuucagggcucuuggaauaccggcgaggaaguccaggugauugccguagagccugggaagaaccccaagaauguccaaacagcaccaggaaccuucaaaacacccgaaggugaggugggcgccaucgcucuggacuuuaagccugggacuucgggaagcccaauuguuaacagggaaggcaaaaucgugggucuuuacgggaauggagucgugaccacgucaggcacauauguuuccgccauagcacaggcuaaggccagucaggagggcccccugccugagaucgaagaugagguguuccgaaaacggaacuugacuauuauggaccuacauccggggucuggaaagacccgcagauaccugccagcgaucgucagggaagccauuaagcggaaacuccgaacauuaauccuggcacccaccagagugguagcuagcgagauggccgaagcucuuaaggguaugccuauacgcuaucaaacuaccgcagugaaauccgagcacacaggcaaggagauuguugaucugaugugccaugccacguuuacuaugaggcucuugucaccaguccgugugcccaauuacaacaugaucaucauggacgaagcccacuucaccgauccuucuagcauugcugcgcggggguauaucaguacaagagugggaaugggcgaggcagccgcuauauuuaugaccgccacuccgcccgguuccauggaagcauucccacagagcaaugccgucauucaggacgaggaaagggauaucccugagcgcucuuggaacucaggguacgaguggauuacagacuuucccggaaaaaccguaugguucgugccauccaucaaggcuggcaaugauauagcgaacugucugcgaaagaauggcaaaagaguuauucagcucagucggaagacguucgacacugaauaucagaagacuaagaacaacgauugggacuacguggucaccaccgacaucagcgagaugggggccaauuuuagggcagaucgcgugaucgacccucguagaugccugaaacccguuauucuuaaggauggaccagaacgggugauccuagcugguccgaugccugucacuguggccucggcagcccagaggcgcggccgaauugggagaaaccccaauaaggagggagaccaguacauauauaugggccagccacugaacaaugaugaggaccaugcucacuggacagaagccaaaauguuguuagauaacaucaauacccccgaggguauuaucccugcgcuguucgaaccagagcgggaaaagucugcagccaucgacggggaguacaggcuccgcggcgaggcuagaaaaacauuuguagaacugaugaggcggggagaucuucccguguggcuguccuauaagguugccagcgagggcuuccaauacucagaccgucgcuggugcuuugcuggggaacgaaacaaucagguccucgaggaaaacauggauguggagauuuggacuaaagagggagaaagaaagaaauugcugccuagguggcuagacgcacggacguauagugauccgcuggcccuccgcgaguucaaggaauuugcugccgguagaaggucuguguccggcgaccuuauacuggagaucgggaaguuaccacagcacuugacccagcgggcacaaaaugcgcuggacaaccucgucaugcugcauaauagcgaacagggaggccgagccuacagacacgcuauggaggagcuucccgauacaauugaaacucugaugcucuuggcccugaucgcaguuuuaaccgguggggugacacuauucuuucugucaggcaaaggacucggcaagaccaguauugggcuucuguguguaauggcuagcuccguguugcuguggaugggaucugucgagccucauuggaucgccgcaagcauaauccucgaguucuuucugauggugcuucucauucccgagccagaccgccagaggacuccucaggauaaccaacuggccuauguugugaucgguuugcuguucaugauuuuaacggucgcugcgaaugagaugggccuacuggaaaccaccaaaaaggaccucgggaucggacacguagccguggagaaccaccaucacgcagcuaugcuugauguugaccugcaucccgccuccgccuggacuuuguacgcaguggcuaccacaauaauuaccccaaugaugcggcacacuaucgaaaacacaacggccaauauuucacugaccgcgaucgcuaaccaggccgcaauacucaugggccuggccaaagguuggccuaucucuaagauggauauuggggucccgcuuuuagcucugggcugcuacagucaggugaauccccucacuuugacagcagccguccugaugcuaguggcgcauuaugcuaucauuggaccaggccugcaagccaaggcaacccgugaggcccagaaaagaaccgcugccgggaucaugaagaacccuacaauagacggaauuguugcaaucgaucucgaccccgugguauacgaugcuaaauuugaaaagcagcuuggccagaucaugcuguugauucuguguacuucgcaaauccuccugaugaggacgaccugggccuuaugcgagagcauaacacuugcgacugguccacugaccacacucugggagggguccccuggaaaauucuggaauaccacuauugccgugucuauggcaaacaucuuccgcggcucauaucuagcuggugccggccuggcauuuagcuugaugaagucccuagggggaggccggcgagggacgggagcucagggcgaaacacucggugagaaguggaaaagacagcuuaaucagcugaguaagucugaguucaacaccuacaaaaggagcgggauuauggaagucgaccgcucagaagccaaggagggauugaaacggggcgagacuaccaagcacgccguuuccagaggucccgcgaagcugcguugguuuguggaaaggacacucgucaauccggagggcaaagugaucgcuuuaggguguggacggggcgcauggaguuauuacugcgccgggcugaagaaaggaacugaaguaaagggcuauaccaaaggugggccaggacacgaggaaccuauacccauggcuacauacggcugggaucuugugaagcugcauagcggcaaagacguuuucuuuaucccacccgagaagugugacacgcuacucugcgauauuggggagucuuccccuaacccgaccaucgaagagggacgcacucugcgaguguugaagauggucgaacccuggcugagagguaaucaauucuguauuaaaauccucaacccauacaugccuucaguggucgagacacuugagcagaugcagaggaagcacggcgggaugcuggugcggaaucccuuaagccgcaacucgacccaugaaauguauuggguuucuugcggaacuggcaauauuguaagugccgugaacaugacauccagaaugcuguugaauagguuuaccauggcacaccgaaaaccuacguacgagcgggacgucgaucucggugccgggacccgucacguggcuguugacccagaaguggcgaaccuggauaucauaggacagagaauugagaacaucaagcaugaacacaaaagcacauggcauuaugacgaggauaaucccuacaagacuugggccuaucacggcucauacgaggucaagccuuccggcucugcaagcaguauggugaacgggguagugaaacuacuuaccaagccaugggacguuauccccauggucacacaaauugcuaugacugauaccacaccguucggacagcagcgcguguuuaaagaaaagguggacaccaggacuccuaaagccaagcgggguacggcacaaauaauggaggucacagccagauggcuguggggcuuccucucccgcaauaagaaaccaaggaucuguacccgagaagaguuuacucggaagguuagaagcaacgcugccauuggggcgguguucguagaugaaaaucaguggaacucugcaaaagaggccguggaggacgacagguuuugggaucugguccaucgcgaacgugaguugcacaagcagggaaaaugcccuaccugcguguauaauaugaugggcaagcgggaaaagaaacugggugaguucgggaaggcuaaaggaucaagacccaucugguacauguggcucggcgccagguuccuugaauuugaggcacugggcuucaugaacgaggaccacugguuuagucgcgaaaauuccuuaagcgggguugagggagaagcucugcauaaguuggguuacauucuccgagauaucucuaaaauaccaggcgggaacauguaugccgacgauacagcuggaugggacacgcggaucaccgaggaugaccugcagaaugagggcaagauuacugauaucauggaacccgagcacgcccuacuugcaaaaucgauuuucaagcugacauaccaaaacaagguggucagagugcagaggccggcgaaaaaugguaccguaauggacguuaucucacgcagagaucagcgggggagcggacaggugggcacuuauggccucaacacauuuaccaauauggaagcccaacugauaaggcagauggaguccgaagggauuuucuugccuaacgaguuagagacacccaaccuggcuggacguguccucgacuggcuugaaaaguacgguguggagcgacugaaacgcauggccaucaguggcgaugacuguguggucaagccaaucgacgauagauuugcaacugcucuaaccgcccugaaugacauggggaaaguucggaaggauauuccucagugggaacccucuaagggauggaacgacuggcagcaagugccauucugcagccaucacuuucaccagcucauaaugaaagauggcagggagaucguagugcccugucgcaaucaggacgaauuggucgguagagcacgggugucccagggggccggauggacgcugagggagaccgcgugccuuggcaagucauaugcucaaauguggcagcugauguacuucccucgacgugcccucagauuagcagccaacgcuauuuguagugccguuccaguggauugggucccgacaucucgcacuaccuggagcauccaugcacaccaucaguggaugacaacugaggacaugcuguccguguggaaucggguauggauugaagagaaccccuggauggaagauaaaaccaggaucucaagcugggaggacguuccuuauuugggcaagagagaagaucaauggugcgggucucugauaggacucacgccacgcgcuacauggcccaccaauauccagguggccauuaaccagguccggaggcuuaucgguaaugagaacuacuccgacuacaugacaaguaugaaacgauuuaagaaugagagcgaaccugagggcgcgcugugguga

SEQ ID NO: 13871 - RNA, 9879 nt, Artificial Sequence
  derived and/or modified CDS sequence (opt3) from DENV-1__GU131679__SS-prME
agcgugaccaugcugcuaaugcuuaugcccaccgcacuggcuuuccacuugacuacgcgaggcggggagccucauaugaucgucuccaagcaggaaaggggaaaaucuuuacuguuuaagaccucagccgguguuaacaugugcacccugauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaagcauggcuagugcauaagcagugguuccuggaucucccgcugcccuggaccuccggcgcuucaacuagccaagagacauggaaucggaaagaccuucugguaaccuuuaagacagcccacgcuaagaaacaggaaguuguggucuuggguagucaggagggggccaugcacacugcacucaccggcgccacggaaauccaaaccucuggaacaacuaccaucuucgcuggccaucugaagugccguuuaaaaauggauaagcugacacuaaaagggauguccuaugugauguguacugggagcuucaagcucgagaaggaagucgcggagacccagcacgguacggugcugguucagauuaaauacgagggcacagacgcaccuugcaagauaccauuuucgacccaggaugaaaaaggggugacucaaaacggacgccuuaucacagccaaucccauuguaaccgacaaggagaaaccugucaacaucgaagcugagccacccuucggcgagucuuauauagugauuggugccggggaaaaggcauugaagcuguccugguuuaaaaagggcucaaguaucggaaaaauguucgaggccacugcuagaggcgccaggcggauggcaauccucggggauaccgcgugggacuuuggaagcauugguggcguuuucacauccguggggaagcugguccaucagaucuuuggaacggcuuacggcgugcuuuucucugguguaagcuggaccaugaaaauugggauaggcgugcuguugacuuggcucggacuaaauucacgaaguacauccuuaagcaugaccuguaucgccguuggccuggucacacuauaccucggggugauggugcaggcagauucuggaugcgucauuaacuggaagggccgcgaacugaagugugguucagggaucuuuguuacuaaugaggugcacaccuggacggaacaguauaaauuccaagccgacaguccgaagagacuuagcgcugccaucggaaaagcaugggaggagggcgugugcgguauuagguccgcuacacgguuggaaaacauaauguggaagcagaucucuaacgagcugaaucauauucuccuggaaaacgacaugaaauuuaccguagucgugggcgauguugccgggaucuuagcgcagggaaagaaaaugauucgcccucagcccauggaguacaaguauucguggaaaagcuggggcaaagccaagaucauaggggcugacgugcaaaaugcaacuuucaucauugauggaccaaacaccccugaaugucccgacgaucagagagccuggaauaucugggaggucgaggacuacggcuuugguauuuucacaacuaacaucuggcugaaacuuagggauuccuauacccaggugugcgaccaccguuugaugucagcugccauaaaggauaguaaagcaguucacgcggacaugggguacuggauugaaucugagaagaaugaaacauggaagcucgcccgggcuagcuucaucgaggugaaaacguguauuuggccaaagucccauacccuguggucaaacggaguacuagaaagcgagaugaucauacccaaaaucuauggcgguccuauuucucagcacaauuaccgaccaggcuacuuuacucaaacagccgggccguggcaucugggaaagcucgagcuggauuucgaccuuugcgaaggcaccacugucgugguggaugagcacugcgggaacagaggacccuccuugaggacaaccacggucacuggcaaaaucauucacgaaugguguugccgcaguuguacccugccuccauuacgguuuaagggugaggacgggugcugguauggaauggagaucagacccguuaaggaaaaagaggaaaaucucgugaaguccaugguaucugcaggcuccggugagguggacucauucagucugggccuucuguguauaagcauuaugaucgaagaggucaugaggucgcgcuggucccgaaaaauguugaugacagggacccucgcuguguuuuuccugcuaaucaugggacagcugacuuggaacgaucucauucggcugugcaucaugguuggcgccaaugcaucugaccguauggggaugggaacaaccuaccuugccuugauggcuacauuuaagaugagaccuauguucgcggugggccuguuauuuaggcgccucacuagccgggagguccugcuucugaccauuggucuaucacucguggccaguguugaacugccaaacuccuuggaggaacugggggauggauuagcaaugggcauaaugauccucaaacugcuuacggacuuccagucucaucaacugugggcuacauugcucagccugaccuuuauuaagacuaccuucucccuacacuaugccuggaagacaauggccauggugcugucaaucgucagccuuuuuccccucugucugaguacuaccucucagaaaacgacaugguugccgguacuguuaggcucccucgggugcaagccucugaccauguuccuuauugcugagaauaaaaucuggggaagaaagagcuggccacugaacgaagguauaauggcagugggcaucguuucgauuuugcucucaucucugcucaagaacgaugugccccuggccgggccucuuaucgcgggaggcaugcucauugcuuguuacgucaucagugguuccagcgccgaccugucuuuggagaaggcagccgaggugagcugggaagaggaagcugagcauuccggggcaucacacaauauauuaguagaagugcaggaugacggaacuaugaaaauuaaggaugaggagagggacgauaugcugacaauccuccugaaggccacccuucuggcggucaguggcguuuaucccuugagcaucccagcuacucuauucgugugguacuuuuggcagaaaaagaaacaacgaucuggcgugcugugggacacaccuucacccccagaagucgagcgcgccgugcucgaugacgggauuuaucggauaaugcagagaggacugcuugguaggagccagguuggcguagggguguuccaggaaaacgucuuucauaccauguggcacgugacgcguggagcaguuuuaauguaccaaggcaagcgccuggagccgaguugggccagcgugaaaaaggaccucaucuccuacggugggggauggcgguugcagggcucuuggaauacuggcgaggaaguccaggugauugcuguagagccugggaagaaccccaaaaauguccagaccgccccaggaacauucaagaccucggaaggugaggugggcgcaaucgcucuggauuuuaaacccgggacaagcggaucaccuauuguuaacagagaaggcaagaucgugggucucuaugggaauggagucgugacuaccuccggcacguacguuagugccauagcgcaagccaaagcaucucaggagggcccacugcccgagaucgaagacgagguguucaggaagcgaaaccuuacaauuauggaucugcacccugggagcggaaagacucggcgcuauuugccggcuaucgucagagaagccauuaaaaggaagcuacggacccugauccucgcuccaacacgagugguagcauccgagauggccgaagccuuaaaagguaugcccauaagauaccagaccacugcugugaagucagagcauaccggcaaagagauuguugaccugaugugccacgcgacauuuacgaugcgccuucugucuccugucagggugccaaauuauaacaugaucaucauggaugaagcacauuucacugaccccagcaguauugccgcucguggguacaucuccacccgggugggaaugggcgaggccgcagccauauuuaugacagcuaccccuccggguagcgucgaagcguucccccaaucuaaugccguaauucaggaugaggaaagagacaucccagagaggucauggaacuccggguaugaguggauuacugauuuuccuggaaagacagugugguucguucccaguaucaagagcggcaaugacauagcaaacugucuccgcaaaaauggcaagcgagugauucaguugucgagaaaaaccuucgauacggaauaccagaagacuaaaaacaacgacugggacuacgucgugacaaccgauaucucugagaugggggcuaauuuucgggccgacaggguuaucgauccacgccguugccugaagccugugauucucaaggacggacccgaaagagucauccuggcagguccaaugccggugaccguagccuccgcugcccaacggaggggccgcauugggcgaaaccacaauaaagagggagaucaguauauauacaugggccagccucuuaacaaugacgaggaucaugcgcacuggacugaagcaaagaugcuacuggacaacaucaauacacccgaggguauuaucccagccuuguucgaacccgagagagagaaaagcgcugccaucgauggggaguaucgguuaaggggcgaggcucgcaagaccuuuguggaacugaugagaaggggagaccucccuguuuggcugucauacaaagucgcaagugagggcuuccaguauucugaucggcguuggugcuuugacggggaacgcaacaaucaagugcuugaggaaaacauggauguggagauuuggacaaaggagggagaaagaaagaagcugagaccaagguggcucgacgcccggacuuacuccgaccccuuggcucugcgcgaguucaaggaauuugccgcagguagaaggagcgucucaggcgaucuaauacuggagaucgggaaacucccucagcaccuuacgcagcgggcgcagaaugcccuggacaacuuaguuauguugcauaauagugaacaaggaggccgagcuuauagacacgccauggaggagcugccggauaccauugaaacacucaugcugcuugcacugaucgcugugcucacuggugggguaaccuuguucuuucugagcggccgcggauuaggcaagacauccauugggcuacugugugugauggccucuagcguccuccuuuggauggcauccguggagccacauuggaucgccgcuucaauaauccuggaguucuuuuugaugguucugcucauucccgagccugacaggcagcggacaccccaggauaaccagcuggcguacguggucaucggacuucucuucaugauucugacuguagccgcaaaugagauggguuugcuggaaacgaccaaaaaggacuuaggcaucgggcacguggcuguugagaaccaccaucacgccgccaugcuagauguggaccugcauccagcaucugcuuggacacucuacgccgucgcgacuaccauaauuacaccuaugaugcgucacaccaucgaaaacacuacagcuaauauuagucuuacggccaucgcaaaccaagccgcuauacugaugggauuggauaaaggcuggcccaucucgaagauggacauuggugugccacugcucgcacuggggugcuauagccaggucaauccucuuaccuuaacugccgcggugcugaugcucguugcucauuacgccaucauuggcccgggauugcaggcaaaggccacaagagaggcucagaaaaggaccgccgcaggcaucaugaagaaccccaccguggaugggauaguagcuauugaacuggacccaguggucuaugauacaaaauuugagaagcagcuaggacagaucaugcugcucauccuuuguacuucccagauucuguugaugcgcacgaccugggcccugugcgagucuaucacacucgcgacuggcccucugaccacauuaugggaagguucacccgggaaauucuggaauaccacuauagccguuagcauggcaaacauuuuccggggauccuaccuugcuggcgccggucuggcauuuagucucaugaagucucuaggcgggggacgaagaggcacgggggcucaaggagagacacugggcgaaaaguggaaaaggcaguugaaucagcugagcaagucagaguucaacaccuauaaacgcuccgguaucauggaaguggaccggagugaggccaaggaggggcucaaaagaggagaaacuaccaagcacgccgucagccguggcacagcgaaacuuaggugguuuguggagcggaaucugguaaaaccagaagguaaggugauugacuugggcugugggcgcggaggcuggucuuacuauugcgcugggcugaaaaagguuacugaggugaaaggauacaccaagggcgguccugggcacgaagaacccaucccgauggcaacauacggauggaaccucgucaaauuacauuccggcaaggauguguucuuuauaccaccugagaagugugacacgcugcuuugcgauaucggcgaaucaagccccaauccaaccauugaggaagggcgaacucugagaguccuaaaaaugguggagcccuggcucaggggaaaccaguucuguaucaagauucugaauccuuauaugccgucgguuguagagacauuggaacaaaugcagcggaaacacgguggcaugcuggugcgcaacccccucucuagaaauaguacccaugagauguacugggucuccugcgggacuggaaacaucgugagcgccguuaauaugacaucaaggaugcuucugaaccgauuuaccauggcucaccggaagccaacguaugaacgugacguggauuuaggcgccgguaccagacacgucgcaguggagccugaaguagccaaccuggacauuaucgggcagcgcauagagaauauuaaacaugagcacaaguccacauggcauuacgaugaagacaaccccuauaagacuugggcuuaccacggaucuuaugaggugaaaccuagcggcagugcguccagcaugguuaauggcgucgugaaguugcucaccaaaccaugggaugugauccccauggucacacagaucgccaugacugacaccacaccuuucgggcaacagaggguuuuuaaggaaaaaguggauacccggacuccaaaggcaaagagaggaacggcucagauuauggagguaacagccaaauggcugugggguuuccuaucucgcaacaagaaacccaggauauguacccgagaagaguuuacucggaaggugagaucaaaugcagccaucggcgcugucuucguggacgagaaccaauggaauagugccaaagaagcgguugaggacgaaagguuuugggaucuugugcaucgcgagcgugaacugcacaagcaggggaagugcgcaaccugcgucuacaacaugaugggaaaacgggagaagaaacucggcgaguucgguaaggccaaaggguccagagcuauuugguacauguggcugggagccagguucuuggaauuugaggcacugggcuucaugaaugaagaccacugguuuagccgcgagaacucucucucgggcguggagggggaaggacuucauaagcuggguuauaucuuacgagauauuucaaaaaucccgggcgggaauauguacgcugacgauacagccggaugggacacgcggauaaccgaggaugaccugcagaacgaagcuaagaucacugauauuauggagccugaacacgccuugcucgcaaagagcaucuucaaacugacauaucagaauaagguaguuagagugcaaaggccagcgaaaaacggcaccgucauggacgugauuucccgcagagaucagcgggguaguggacaggugggaacuuacggccuaaauacauuuaccaacauggaggcccagcuuaucaggcaaauggagucugaaggcauauucagccccuccgagcuggaaacaccuaaccucgcugggcguguccuggacugguuggagaagcauggaguugaacgauuaaaacgcauggccauuucaggugaugacugugugguaaagccaaucgacgauagauuugcaacugcucugaccgcccucaaugacaugggcaaggugcggaaagauaucccccagugggagccgaguaagggguggaacgacuggcagcaggucccuuucugcucucaccacuuucaucaacuuauuaugaaagauggaagggagauagugguucccugucgcaaucaggacgaacuggugggcagagcacgggucagccagggugccggguggucccuaagggagacggcgugccugggaaagucauaugcucagauguggcaacucauguacuuccaccgacgugauuugagacuggccgcaaacgccaucuguagcgcugugccaguagacuggguuccuaccucucgcacaacuugguccauucaugcccaccaucaguggaugaccacagaagauaugcuuaguguguggaaucgggucuggaucgaggaaaaccccuggauggaggacaaaacucacauuagcucguggggcgaugugccauaucugggcaagagggaggaccaguggugcgggucccucaucggauuaaccgcaagagcuacgugggccacaaauauacaaguugcgaucaaccaggugcgccggcugauugguaaugaaaacuacuuggacuacaugaccucuaugaagagguuuaaaaaugagaucgaucccgaaggcgcucugugguga

SEQ ID NO: 13872 - RNA, 9879 nt, Artificial Sequence
  derived and/or modified CDS sequence (opt3) from DENV-1__GU131680__SS-prME
agcgugaccaugcugcucaugcuuaugcccacagcccuggcuuuccacuugacuacgagaggcggggagccucauauggucguuuccaagcaggaaaggggaaaaucuuuacuguuuaagaccucagcaggugugaacaugugcacacuaaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagagaagcguagcgucgcccuugcaccccaugugggccuggguuuggaaacuagaaccgagacauggauguccucugaaggggccuggaaacagauacagaggguugagacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagacuuuguagagggucuuaguggcgcgacuuggguugauguggucuuggaacacggguccugugugacaaccauggcaaaggacaaacccacucuggauauugagcuacucaagacagaagugaccaacccugccguccugaggaaacuuugcaucgaggcuaagauuucuaauacgaccacagacagccgguguccaacucaaggagaagccacccugguugaggagcaggaugcaaacuucgugugccgccgaacauuuguagacagaggcugggguaauggguguggauuguucggcaaaggcucccuccugacuugcgcuaaguuuaagugcgugaccaaauuagaagggaagaucguccaguacgagaaccugaaauauucagugauaguuacagugcacaccggagaucagcaucaagucgguaaugaaaguacugagcacggcacgacagccaccauuacuccccaggcgccuaccacagaaauccagcucaccgacuacggggcccuuacucuggacuguagcccaaggacaggauuggauuucaacgagauggugcuacugacgaugaaggagaaaucuuggcucguacauaagcagugguuucuggaccuuccgcugcccuggaccuccggcgcaucaacuagccaagaaacauggaaucggcaggauuugcucguuaccuucaaaacagcucacgccaagaagcaggagguggucgugcuggguagucaagaaggggcuaugcacacugccuuaaccggcgcaacggagauucagaccucuggaacaacuaccaucuuugccggccaucugaaaugccgucuaaagauggacaaacucacacugaaggggauguccuaugucauguguacuggaagcuucaaacuugaaaaggagguggcugagacccagcacgguacgguuuuggugcagaucaaguacgaaggcacagaugcgccuugcaaaauuccauucucgacccaagacgagaaggggguaacucagaacggacgccugauaacagcaaaucccaucgucaccgauaaagaaaagccugugaacauugaggccgagccacccuuuggcgaaucuuauaucguuauaggugcuggggagaaagcccucaagcuguccugguucaagaaaggcucaaguauuggaaagauguuugaagcaacugccagaggcgcuaggcggauggccauccuuggggacaccgcaugggauuucggaagcaucgguggcguguuuacauccgucgggaaacuggugcaucagauuuucggaacggcguacggcguauuguuuucuggugugagcuggaccaugaagaucgggauuggcguucuccugacuugguuaggacugaauucacgaaguacaucccuaagcaugaccuguauagcugucggccucgugacacuguaccuuggggugaugguccaggccgacucuggaugcguuaucaacuggaaaggccgcgaguugaagugugguucagggauuuucgugacuaaugaagugcacaccuggacggagcaauauaaguuucaggcagauaguccgaaaagacugagcgccgcuaucggaaaggccugggaggaaggcguaugcgguaucagguccgcaacacggcucgagaacauuauguggaaacagauaucuaacgaacugaaucauaucuuacuggagaacgacaugaaguucaccgucgugguuggcgacguggcugggauucuuguccagggaaaaaagaugauccgcccucaacccauggaauacaaauauucguggaagagcuggggcaaggccaaaauuaucggggcggaugugcagaauuccacuuuuauaaucgacggaccaaacaccccugagugucccgaugaccagagagccuggaauauuugggagguugaagauuacggcuucgguaucuuuacaacuaacauuugguugaagcucagggacucauauacccaggugugcgaucaccgucugaugagugcugcaaucaaagacucuaaggccguacacgcugauaugggguacuggauagagagcgaaaaaaaugagacauggaagcuagcccgggcauccuucauugaagucaagacguguaucuggccaaaaucacauacccuguggagcaacggagugcucgagucugagaugauuauccccaagauacacggcgguccuaucucccaacauaauuaucgaccaggcuacuucacucagacagcggggccguggcaccugggaaaacuugaauuggacuuugaucugugcgagggcaccacuguggucguugacgaacacugcgggaacagaggacccaguuuaaggacaaccacggugacuggcaagauuauccaugagugguguugccgcagcuguacccucccuccacugcgguucagaggugaggaugggugcugguacggaauggaaauuaggcccguaaaagagaaggaagagaaucuugugaagucuauggucuccgccggcucaggugaaguggacaguuuuagccugggcuugcucuguaucucgauaaugauugaggagguuaugcgcucccgauggucucggaaaaugcugaugacagggacccuagcuguguucuuucugcucaucaugggacagcugacuuggaacgaccuuauccguuugugcauuauggucggcgccaaugcaagcgauagaauggggaugggaacaaccuaucuggcuuuaauggccacauucaagaugaggccuauguuugcagugggccuccuguuccgccggcuuacuucaagagaaguucugcuacucaccaucggucugaguuugguggccuccgucgagcugccaaacucuuuagaagagcucggggacggacuggcuaugggcauuaugauacuuaaacuguugacggauuuucaaagcuaccagcucugggcgacacugcuaucccugaccuucaucaagacuaccuuuucacuucacuaugccuggaaaacaauggcaaugguacucagcauugugagucuguuccccuugugucugucuacuaccucccagaagacgacaugguuaccgguucuccugggcagccuugggugcaagccucugaccauguuuuugaucgcugaaaauaaaauuuggggaaggaagucguggccacucaacgaggguaucauggccgugggcauagucucaauccugcuaucuagucugcuuaaaaacgacgugccccucgccgggccucugauugcuggaggcauguugaucgcauguuacguaauuuccgguagcucugccgauuuaagccuggagaaggcggcugaaguguccugggaggaagaggccgaacauucaggggcaagucacaauauccucgucgagguucaggacgauggaacuaugaaaauaaaggacgaggaacgagaugacacacugaccauucuucugaaagccacuuugcuagcugugagcggcguguauccccugucuaucccagcaacacucuucgucuggcauuucuggcaaaagaagaaacagcgcuccggcgugcugugggauaccccuucacccccagagguugaacgggccguacuugacgaugggaucuacagaauuaugcagaggggauuacugggucguagucaggugggcgucgggguguuucaagagaacguuuuccacacgauguggcacgugacucgcggagcgguccucauguaucagggcaagcgguuggagccgagcugggcuuccgugaaaaaggaccugauaucuuacggugggggauggagauuucagggcucguggaauaccggcgaagagguacaggucaucgccguggaaccugggaaaaaccccaagaauguucaaacagcaccaggaaccuucaagacacccgagggugaagugggcgccauugcucucgacuuuaaaccugggacuagcggaucaccaaucgucaacagggagggcaagauugugggucuguacgggaauggaguugugaccacguccggcacauaugucagugccaucgcacaggcuaaagccucucaggagggcccccuuccugaaauagaggaugaaguguuccgaaagcggaaccugacuaucauggacuugcauccggggagcggaaaaacccgcagauaccuaccagcgauuguaagggaggccaucaagcggaagcugcgaacacucauuuuagcacccaccagagugguugcuuccgaaauggccgaggcucugaaagguaugccuauccgcuaucaaacuaccgcagucaagucagagcacacaggcaaagaaauaguggaucuuaugugccaugccacguuuacuaugaggcugcucucuccagugcguguccccaauuacaacaugauuaucauggacgaggcccacuucaccgauccuagcaguaucgcugcgcggggguauauuuccacaagaguaggaaugggcgaagcagccgcuaucuuuaugaccgccacuccgcccgguagcauggaggcauucccacagucuaaugccgugauacaggacgaagagagggauauuccugagcgcucauggaacuccggguacgaauggaucacagacuuucccggaaagaccguuugguucgugccaaguauuaaagcuggcaaugauaucgcgaacuguuugcgaaagaauggcaagagagucauacagcugagccggaaaacguucgacacugaguaucaaaagacaaaaaacaacgauugggacuacgugguuaccaccgacauuucggaaaugggggccaauuuuagggcagaucgcgugaucgacccucguagaugccucaagcccgucauccugaaagauggaccagagcgggugauucuugcugguccgaugccuguaacuguggccucugcagcccagaggcgcggccgaaucgggagaaaccauaauaaggagggagaccaguacauuuauaugggccagccccuaaacaaugaugaagaccacgcucacuggacagaggccaagaugcuguuggauaacauaaauaccccagaagguaucauucccgcguuauucgagccugaacgggagaaauccgcagccaucgacggggaguacaggcugcgcggcgaagcuagaaagacauuuguugagcucaugaggcggggagaucugccagucuggcuuagcuauaaaguggccucagaaggcuuccaauacagugaccgucgcuggugcuuugauggggagcgaaacaaucaggugcuggaagagaacauggacgucgagaucuggacuaaggaaggagagagaaaaaagcucaggccccggugguuggaugcucgcacguauucugacccucuggcacuaagagaauucaaagaguuugccgcugguaggcgguccguuagcggcgaccugauucucgaaauagggaagcuuccgcagcaucugacccagcgagcccaaaaugcauuagauaacuuggugaugcugcacaauucagagcagggaggcagagcguaccgccaugccauggaggaacucccagacacaaucgagacucugaugcuucuggcucucauugccguauugaccgguggggugacacuguucuuuuuaaguggcaagggacuaggcaaaaccagcaucgggcugcucugugucauggcauccucugugcuucuguggauggcuagcguugaaccccacuggauugccgcauccaucauauuggaguucuuucugauggugcuccugaucccugagcccgauaggcagcggacuccacaggacaaccaacuugccuaugucguaauuggacuccuguucaugaucuugacgguggcugcgaaugaaaugggucuguuagagaccacaaagaaagaucuaggcauugggcacguugccguggaaaaccaucaccaugcagcuaugcuggacgucgaucuccacccugccucagccuggacucuuuacgcaguggcuaccacaaucauaacccccaugaugcgucauacuauugagaacacaacggccaauaucucucugaccgcgauugcuaaccaggccgcaaucuugaugggacuggacaagggcuggccaauaaguaaaauggauaucggugucccucuccuggcccuugggugcuacucgcaggugaauccguuaacucugacagcugcaguucucauguugguggcccacuaugcgauuaucggccccggacugcaagcuaaggccaccagagaagcacagaagaggaccgccgcuggcauuaugaaaaacccaacaaucgacgggauaguagccauugaucuagacccuguggucuacgaugcaaaguuugagaaacagcugggacagaucaugcuccuuauccuguguacuagccaaauuuugcugaugcgcacgaccugggcucucugcgaguccaucacacuggccacuggccccuuaaccacacuuugggaagguucuccagggaaguucuggaauaccacuauagcgguuucaauggccaacauuuuccggggaagcuaucuggcaggcgcuggucucgccuuuucccuaaugaaaagucugggcgggggacgaagaggcacgggggcacagggagagacauugggcgaaaaguggaagaggcagcugaaucagcucucuaaaagcgaguucaacaccuacaagcgcucagguaucauggaaguggaccgguccgaggcuaaagaggggcuuaagagaggagaaacuaccaaacacgccgucagucguggcacagccaagcugaggugguuuguggagcggaauuugguaaagccugaagguaaagugauugaccugggcugugggcgcggaggcuggagcuauuacugcgcggggcucaagaaaguuacugaggugaagggauauaccaaaggcggucccgggcaugaagagccgaucccaauggcuacauacggauggaacuuagucaagcugcacucuggcaaagauguguucuuuauaccucccgagaagugugacacgcuucugugcgauaucggcgaauccucaccaaaucccaccauugaggaagggcgaacucuaagaguccucaagaugguggagccuuggcugaggggaaaccaauucuguaucaaaauuuugaauccguacaugcccagcguuguagagacacuggaacagaugcagcggaagcaugguggcaugcucgugcgcaacccacuuucgagaaauucuacccacgagauguauugggucaguugcgggacuggaaacaucguguccgcaguuaauaugacaagcaggaugcuguuaaaccgauuuaccauggcccaccggaaaccuacguacgaacgugacguggaucugggcgcugguaccagacaugucgccguggagcccgaaguagcaaacuuggacauuaucgggcagcgcauagagaauauuaagcacgagcauaaaucaacauggcacuaugaugaagacaacccuuacaagacuugggccuaucauggauccuacgaggugaagccaucuggcagcgcuaguuccaugguuaauggcgucgugaaacuccugaccaagcccugggaugugaucccuauggucacacaaaucgcgaugacugacaccacaccauucgggcagcagaggguuuuuaaagaaaagguggauacccggacucccaaagccaagagaggaacggcacaaauuauggagguaacagcucgcuggcuaugggguuuccuuagcaggaacaagaaaccgcgaauauguacccgggaagaguuuacuagaaaggugaggucuaaugccgcaaucggcgccgucuucguggacgagaaccaguggaauucagcuaaagaagccguugaggacgaucgcuuuugggaccuggugcaccgugaacgggagcuccacaagcaggggaaaugcgcgaccugcgucuauaacaugaugggaaagagagaaaagaaacugggcgaguucgguaaggcaaaagggaguagggccauuugguacaugugguugggagcucgcuuccuggaguuugaagcccucggcuucaugaaugaggaucauugguuuucccgagaaaacagccuuucuggcguggagggggagggacugcacaaguuagguuacauccugcgggacauuucgaaaaucccuggcgggaauauguaugcagaugacacagcuggaugggauacgagaauaaccgaagacgauuugcagaacgaggccaagaucacugacauuauggaaccagagcaugcucuccuggccaaaucaaucuucaagcuaacauaccaaaauaagguaguuagggugcagcgccccgcaaaaaacggcaccgucauggaugugauuagcagacgggaccagagggguuccgggcaggugggaacuuauggccuuaauacauuuaccaacauggaagcgcaacugauccgucagauggagagugagggcauauuccucccuaacgaacuggagacaccaaauuuggccgggcgagucuuagauuggcuggaaaaguacggaguugagcgccucaaaagaauggcuauuucuggugacgacugugugguaaagcccaucgaugaccgguuugccacugcacuuaccgcucugaacgauaugggcaaagugaggaaggacaucccgcagugggaaccuagcaagggguggaaugauuggcagcaaguccccuucugcucccaccacuuucaucagcuaauuaugaaagacggacgcgagauagugguuccauguagaaaccaggaugagcuggugggccgggccagggucucacagggugcaggguggagucuccgagaaacggccugcuugggaaagucuuaugcgcaaauguggcagcugauguacuuccaccguagagaccuucgccuggcugccaaugcaaucuguagcgccgugccuguagauuggguucccaccucccggacaacuuggucaauucaugcucaccaucaguggaugaccacagaggacaugcucagcguguggaacagggucuggaucgaagagaauccauggauggaagauaaaacuagaauuucuuccugggaggacgugcccuauuuaggcaagcgcgaggaccaauggugcggcagucugaucggguugaccgcccgggcaacgugggcuacaaacauacagguugccaucaaucaggugaggcgacugauuggaaacgaaaauuacagcgauuacaugaccucgaugaaaagauuuaagaacgaguccgaaccugagggugcgcucugguga

SEQ ID NO: 13873 - RNA, 9879 nt, Artificial Sequence
  derived and/or modified CDS sequence (opt3) from DENV-1__GU131681__SS-prME
agcgugaccaugcugcucaugcuuaugcccaccgcacuggcuuuccacuugacuacgaggggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaaggugcucaugaccgggacucuggcuguuuuccuacugcucauuaugggacagcugacauggaacgaucuuauccgguugugcauuauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauaggucugucauugguugccaguguggaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaaugguccugucaauugucagcuuguucccccuguguuuaaguaccacgucucagaagacaaccuggcucccggugcugcuuggcucccuggggugcaaaccuuugacuauguuucucaucgcugagaauaagauauggggaagaaaaagcuggccacugaacgaagguaucauggccguuggcguggucucgauucuacugucaucucuucucaagaacgaugugccccuggccgggccuuugaucgcuggaggcauguuaauugcauguuauguaaucagugguuccagcgccgaccugucucucgagaaagcggcugaggugagcugggaagaggaagccgagcacuccggggcaucacauaauauacuggucgaaguucaggaugacggaacaaugaagauuaaagaugaggagagggacgauacccuuacuauccuguugaaggccacacuacuggcugugaguggcguguacccccucagcaucccagcaacccuguucgucugguauuuuuggcaaaagaaaaagcagcgaucuggcgugcuuugggacacgccuucacccccagaaguugagcgcgccguauuagaugacgggauuuaccggauaaugcagagaggacugcucgguaggagccaggugggcgucgggguguuccaagaaaacguuuuccacacuauguggcacgugacccguggagcggucuugauguaucagggcaaacgccuggagccgaguugggcuagcgugaagaaagaccucaucuccuacggugggggauggcggcugcagggcucuuggaauacaggcgaggaaguacaggucauugccguggagccugggaagaaccccaagaauguucaaaccgcaccaggaacauuuaaaacucccgaaggugaggugggcgccaucgcucuugauuucaagccugggaccucgggaagcccaauugucaacagagaaggcaaaaucgugggucuguacgggaauggaguugugacgacaucaggcacuuaugucuccgccauagcacaggcuaaggccagucaggagggccccuugccugagaucgaagacgagguguuuaggaaacgaaaccuaaccauuauggaucugcauccggggucuggaaagacacggcgcuaccucccagcgaucguaagagaagccauuaagaggaaauuacggacccugauccuugcacccacucgagugguugcuagcgagauggccgaagcucugaaggguaugccuauaagauaucaaaccacagcagucaaauccgagcacacgggcaaggagauuguggaccucaugugccaugccacuuucaccaugcgcuugcugucaccagugaggguccccaauuacaacaugaucaucauggaugaagcccacuuuacagacccuucuagcauugcugcgcguggguauaucaguacccggguaggaaugggcgaggcagccgcuauauucaugacugccacaccgcccgguuccguggaagcauuuccacagagcaaugccguuauucaggaugaggaaagagacaucccugagaggucuuggaacucaggguacgaguggauuaccgauuuccccggaaaaacggugugguuugucccauccaucaagaguggcaaugacauagcuaacugucuccgcaagaauggcaaacgagugauucagcugagcagaaagacuuucgauacagaauaucagaaaaccaagaacaacgacugggacuacguugugaccacugauaucucggagaugggggcgaauuuucgggccgacagggucaucgauccucgccguugccuuaaacccgugauucuaaaggacggaccagaaagaguaauccuggcagguccgaugccugugacaguugcuucugccgcacagcggaggggccgcauugggcgaaaccauaauaaggagggagaucaguacauauauaugggccagcccuugaacaaugacgaggaucacgcccacuggaccgaagcuaaaauguuacuggacaacaucaauacaccagaggguauuauccccgcccucuucgaaccugagagagaaaaguccgcggcaaucgauggggaguaccggcugaggggcgaggcccgcaaaacuuucgucgaacuuaugagaaggggagaccugccaguguggcucagcuauaagguggcuucagagggcuuucaauacagugaucggcguuggugcuucgacggggaacgcaacaaucaggucuuggaggaaaacauggauguugagauuuggacgaaagagggagaacgaaagaaacugagacccagguggcuagacgcccggaccuauucugacccucuggcucuccgcgaguuuaaggaguucgcagccgguagaagguccgugagcggcgaucuuauacuggagaucgggaaguuaccgcagcauuugacacagcgggcucaaaaugcccuggacaaccucguaaugcugcacaauucagaacagggaggccgagcauacagacaugcgauggaggagcuuccagauacuauugaaacccugaugcucuuggcccugaucgcuguguuaacagguggggucacccuauuuuuccugaguggccgcggacucggcaaaacuagcauugggcuucugugugugauggccuccucuguuuugcuguggauggcaagcguggagccccacuggaucgcugccuccauaauccucgaauuuuuccugaugguccuucucauuccugagcccgacaggcagcggacgccacaggauaaccaacuggcauauguagugaucggauugcuguuuaugauuuuaaccguugccgcuaaugagaugggucuacuggaaacaacuaagaaagaccucggcaucgggcacguggcggucgagaaccaucaccaugccaccaugcuugauguggaccugcacccugcaucagcuuggacauuguacgccgucgccaccacuauaauuacacccaugaugcgucauacgaucgaaaacaccacugcaaauauuucucugacagcuaucgccaaccaggcggcuauacucaugggacuggauaagggcuggccaaucaguaaaauggacauuggugugccucuuuuagcccuggggugcuacucgcagguuaauccgcucaccuugaccgcagccgugcugaugcuaguagcucacuaugcaaucauuggccccggacugcaagccaaggcgacaagagaggcucagaagaggacugccgcaggcaucaugaaaaacccaacgguggaugggauagucgccauugaccucgauccuguuguguacgacgcuaaguucgaaaaacagcuuggacagaucaugcuguugauccuguguaccagccaaauucuccugaugcgcacaacuugggccuuaugcgaguccaucacccuugcaacaggcccccugaccacucucugggaggguucuccagggaaguuuuggaauacgacaauagcugucucaauggccaacauuuuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacaucuacaagcgcucagguauuauggagguggaccgguccgaagccaaagagggguugaagagaggagagaccacacgucacgcaguaaguaggggcacugcuaaacugcggugguucguggaacgcaaucucguuaagccugaggguaaggugaucgauuuaggcugugggcgaggaggcuggagcuauuacugcgccgggcugaaaaaggucaccgaagugaaaggauauacaaagggcggucccgggcaugaggaaccgauaccaauggccacguacggauggaaccuugucaaacugcacucuggcaaggacguguuuuucaccccucccgagaaaugugauacucuacucugcgacaucggcgaguccucaccaaaucccacaauugaagaggggagaacccugaggguuuugaagaugguagaaccuuggcugcggggaaaccaauuuuguaucaagauucucaauccguacaugcccagcguggucgagacucuugagcagaugcagcgcaaacaugguggcaugcuggugagaaacccauuaucgagaaauucuacacacgaaauguauuggguuaguugcgggaccggaaacaucguguccgcggucaauaugacgagccgaaugcuguugaaccgguucaccauggcucaccguaagccuacauacgagagagauguggaccucggcgcagguacucgccauguagccguggaacccgagguugcuaaccuggauauuaucgggcagaggauagaaaauauuaaacacgagcauaagucaaccuggcacuaugacgaggauaacccuuacaaaacaugggccuaucauggauccuacgaagucaagccaucuggcagcgcaaguuccauggugaauggcguggucaagcuacuuacuaaacccugggacguuaucccuauggugacccaaaucgccaugacagauaccacuccauuugggcagcagcggguauucaaggagaaaguggacacgagaacacccaaggcuaaacgcggaaccgcgcaaauuauggaagucacugccagguggcugugggguuuucucagccgaaacaagaagccgcggauauguaccagagaggaguucacaaggaaagugcgcucuaaugcagcuaucggcgccguuuuuguggacgagaaccaguggaacucagcaaaggaggccgucgaagaugagcguuucugggaccuggugcagaaagaacgggaguugcacaagcaggggaaaugcgcuacgugcguauauaacaugaugggaaagagagaaaagaaacugggcgaguuugguaaggccaaagggaguagggcgauuugguacauguggcucggagcacgcuuccuugaguuugaagcccugggcuucaugaaugaggaucacugguucucccgagaaaacagcuuaucuggcguugagggggagggacugcauaaguuggguuacauccuccgggacauuucgaaaaucccuggcgggaauauguaugcugaugacaccgccggaugggauacuagaauaacagaagacgaucugcaaaacgaggcaaagaucaccgacauuauggaaccagagcacgcucuacuugccacuucaaucuuuaaacugacauaccagaauaagguggucagggugcagcgccccgcuaagaacggcaccgugauggaugucauuagcagacgggaccagagggguuccgggcaaguuggaacauauggccucaauacuuucaccaacaugggcgcccagcugauccgucagauggaaagugaggggauauuuucuccuagcgaguuggaaauuccaaacuuagcagagcgagugcuggauuggcucgaaaaauacggaguagagcgccuuaagagaauggcgaucuccggugacgacuguguggucaaacccaucgaugaccgguucgccacggcucugaccgcccuaaaugauaugggcaaggugaggaaagacguuccgcagugggaaccuucaaagggguggaacgauuggcaacaggugcccuuuugcagucaucacuuccaccagcugauuaugaaggacggacgcgagauagucgugccauguagaaaucaggaugagcucguaggccgggcaaggguuucucaaggugcuggguggagcuugcgagaaacagccugccugggaaaauccuaugcacagauguggcagcuuauguacuuucaucguagagaccugcgccucgccgcgaacgcuaucuguucagccgugccugucgauugggugcccacuagccggaccacauggucuauucacgcacaucaccaauggaugacuaccgaggacauguuauccguuuggaauaggguguggaucgaagagaacccauggauggaagauaagacgcaugucaguagcuggggcgacgugcccuaucugggcaaaagagaggaccaguggugcgggucguugauuggacugacagcccgcgcuaccugggccuccaauauccagguagcaauaaaccaggugcggaggcucaucgguaaugagaacuaccuugauuacaugacuucuaugaagcgauucaaaaaugaaggcgacccugagggggcucugugguga

SEQ ID NO: 13874 - RNA, 9879 nt, Artificial Sequence
  derived and/or modified CDS sequence (opt3) from DENV-1__GU131682__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaagacgcuaacuucgugugccgccgaacuuuuguagauagaggcugggguaauggguguggauuguucggcaaaggcucccucauaaccugcgccaaguuuaagugcgugacaaaacuggaggggaagauuguccaguacgaaaacuuaaaauauucagugaucguuaccgugcacacuggagaccagcaucaagucgguaaugagaguacggaacacggcacaaccgcaacuauuacaccccaagcuccuaccaccgagauccagcugacugacuacggggcccucacacuugauuguagcccaaggacgggacuggacuucaacgaaaugguguugcuaaccaugaaggagaaaucuuggcugguacauaagcagugguuucucgaucugccgcuucccuggacuuccggcgcgucaacaagccaagagaccuggaaucggcaggaccuguugguuacauucaaaacugcccacgcaaagaagcaggaaguggucgugcucgguagucaagagggggcuaugcacaccgcccugacgggcgcuaccgaaauccagacaucuggaacuaccacaauuuuugccggccauuuaaaaugccgucugaagauggauaaacuaacucucaaggggauguccuaugucauguguaccgggagcuucaaacuggagaaggaaguggcagagacgcagcacgguacaguucuugugcagauaaaguacgagggcaccgacgccccuugcaaaaucccauucucgacucaagaugaaaaggggguaacacagaacggacgcuugauuaccgcuaaucccaucgucacugacaaagagaagccugugaacauagaagcggagccacccuuuggcgagucuuauauuaucaucggugcaggggaaaaagcccugaagcucuccugguucaagaaaggcucaaguauuggaaagauguuugaggcuaccgccagaggcgcaaggcggauggccauccugggggauacagcuugggacuucggaagcauugguggcguuuuuacguccguggggaaacuuguccaucagauauucggaaccgccuacggcgugcuguuuucugguguaagcuggacuaugaagaucgggauuggcguguugcucacauggcugggauuaaauucacgaaguaccucccugagcaugacauguaucgcaguuggccuagucacucucuaccugggggugauggugcaggcggauucuggaugcgucaucaacuggaaaggccgcgaacuuaagugugguucagggauuuucguuaccaaugaggugcacacguggacagaacaauauaaguuucaggcugacaguccgaaaagauugagcgccgcaauaggaaaggccugggaggagggcgugugcgguaucagguccgcuacccggcuggaaaacauuauguggaaacagaucucuaacgagcucaaucauauucuguuagaaaacgacaugaaguucacuguagucgugggcgauguugccgggauccuggcacagggcaaaaagaugauacgcccucaacccauggagcacaaauacucguggaaaagcuggggcaaggcuaagaucauuggggccgacgugcagaauaccacauuuaucauugauggaccaaacacuccugaaugucccgacgaucagagagcguggaauaucugggaggucgaggacuauggcuucgguauauuuaccacaaacauuuggcuuaaguugagggauuccuacacacaggugugcgaccaccgucucaugucagccgcuaucaaagauaguaaggcaguucaugccgacaugggguauuggauugaaucugagaaaaaugaaaccuggaagcuggcucgggccagcuucaucgaggugaagacuuguauauggccaaaaucccacacacuauggucaaacggaguacuggaaagcgagaugaucauucccaagaucuacggcgguccuauuucucaacauaauuaucgaccaggcuacuucacccagacugcagggccguggcaccucggaaaacuggagcuugauuuugacuugugcgaaggcacaaccgucgugguggaugagcacugcgggaacagaggacccucccugaggacgacuaccgucacaggcaagaucauacaugaaugguguugccgcaguuguaccuuaccuccacuccgguucagaggugaggacgggugcugguacggaauggagauuaggcccguuaaagaaaaggaggaaaaucuggugaaguccaugguaucugcgggcuccggugagguggacucauuuagucuuggccuguuguguaucagcaucaugauugaagaggucaugcgcucgcgauggucccggaaaaugcucaugacugggacacuggccguguucuuucuacugaucaugggacagcucaccuggaacgaucugauucgucuuugcauaaugguuggcgcuaaugccucugacagaauggggaugggaacaacuuauuuggcacugauggcuaccuucaagaugaggccuauguuugccgugggcuuacucuuccgccggcugacgagcagagagguccuucugcuaacaaucggucucucacugguggcaaguguugaauugccaaacucccuggaggaauuaggggauggacucgccaugggcauuaugauccugaaacuucugaccgacuuucaaucucaccaguugugggcuacucuccugagccuaaccuucauuaagacaacuuuuucccugcauuacgcguggaaaaccauggccauggugcuuucaaucgucagccucuucccccuguguuugaguacgacaucucagaagaccacuuggcugccgguauuacucggcucccuggggugcaagccucuuacaauguuucugauagcagagaauaaaaucuggggaaggcgaagcuggccauugaacgaagguauuauggcugugggcaucguuucgauucuccugucaucucuacugaagaacgaugugccccuugccgggccucucaucgccggaggcaugcugauagcuuguuaugucauuagugguuccagcgcagacuugucuuuagagaaagccgcggaggugagcugggaagaggaagcugagcacuccggggccucacauaauauccugguagaagugcaggaugacggaaccaugaagaucaaagaugaggagcgcgacgauacucucacaauucugcuuaaggcaacccuguuggccgucaguggcguuuacccccuaagcauaccagcuacgcuguucgugugguauuucuggcagaaaaagaagcagcggucuggcgugcucugggacacuccuucacccccagaagucgagagagcagugcuggaugacgggaucuacaggauuaugcagcguggacuuuuaggucgcagccagguuggcguagggguguuucaagaaaacgucuuccacaccauguggcacgugacacggggagccguucugauguaucagggcaaaagacucgagccgaguugggcgagcgugaagaaagacuugaucuccuacggugggggauggaggcugcagggcucuuggaauaccggcgaggaaguccaggugauugcuguagagccugggaagaaccccaaaaauguccaaacagccccaggaacuuuuaagacccccgaaggugaggugggcgcaaucgcccucgauuucaagccugggacgucgggaagcccaauaguuaaccgagaaggcaaaaucgugggucuguacgggaauggagucgugacaacuucaggcaccuauguuuccgcuauugcccaggcaaaggcuagucaggagggcccccuuccugagaucgaagacgagguguuucggaaacgcaaccugacaauuauggauuugcauccggggucuggaaagaccagaagguaccuaccagccaucguccgggaagcgauaaaacgaaagcugagaacucucauuuuagcccccacccgcgugguagcaagcgagauggcugaagcccugaaggguaugccuaucagguaucaaacaacggcugugaaauccgagcacacuggcaaggagaucguugaccuuaugugccaugcaaccuucacaaugcgucugcucucaccaguccgggugcccaauuacaacaugauuaucauggaugaagcccacuuuaccgacccuucuagcauagccgcuagaggguauauuaguacuagggugggaaugggcgaggcggcagccaucuucaugacagcuaccccgcccgguuccgucgaagccuuuccacagagcaaugcaguaauucaggaugaggaacgcgacaucccugagcgaucuuggaacucaggguacgaguggauaacggauuuccccggaaaaacugugugguuuguuccauccauuaagaguggcaaugacaucgccaacuguuugaggaaaaauggcaagcgggugauccagcugagcaggaagacauucgauaccgaauaucagaaaaccaagaacaacgacugggacuacgucgugacuacagauauuucggagaugggggcuaauuuccgcgcggaccguguuaucgauccuagacggugccucaaacccgugauucugaaggacggaccagaaagggucauacuugccgguccgaugccugugaccguagcaucugcugcccagcgccgaggcagaaucgggcggaaccauaauaaagagggagaucaguacauuuauaugggccagccccuaaacaaugacgaggaucacgcacacuggacagaagccaagaugcuguuggacaacaucaauacuccagaggguaucauucccgcuuuauuugaaccugagagggaaaaguccgccgcgauagauggggaguaccgccugagaggcgaggcaaggaaaacguucguggaacucaugcggcguggagaccugccaguuuggcuuagcuauaaggucgccucagagggcuuucaauacagugaucgccgauggugcuucgacggggaaagaaacaaucaggugcuggaggaaaacauggauguggagaucuggaccaaagagggagaaaggaagaaacuccggccccgcugguuggacgcuagaacauauucugacccucuggcccuaagggaguuuaaggaguucgcugcaggucggcgauccgucagcggcgaucugauucucgagaucgggaaacuuccgcagcaucugacucagagagcccaaaaugcuuuagacaacuugguuaugcugcacaauucagaacagggaggccgcgccuacaggcaugcaauggaggagcucccagauaccauugaaacacugaugcuucuggcgcucaucgccguguugaccggugggguaacucuguuuuucuuaaguggccggggacuaggcaagacgagcauagggcugcucugugugauggcuuccucuguccuucuguggauggccagcguggagccccacuggaucgcagcuuccauuaucuuggaauuuuuccugaugguucuccugauuccugagcccgaccgucagagaaccccacaggauaaccaacuugccuauguggucaucggacuccuguuuaugauauugacaguagcagccaaugagaugggucuguuagaaacuaccaagaaagaccuaggcauugggcacguggcuguugagaaccaucaccaugcggccaugcuggauguggaccuccacccugcaucagcuuggacacuuuacgccgucgccaccacuaucauuacacccaugaugaggcauacgaucgaaaacaccacugcaaauauaucucugacagcuaucgccaaccaggcggcuauuuugaugggacuggauaagggcuggccaaucaguaaaauggacauuggugugccucuccuggcccuugggugcuacucgcaggucaauccguuaacccugaccgcagccgugcucauguugguugcucacuaugcaaucauaggccccggacugcaagccaaggcgacacgcgaggcucagaaacggacugccgcaggcauuaugaagaacccaacgguggaugggaucguagccaucgaccuagauccuguggucuacgacgcuaaguucgaaaaacagcugggacagauuaugcuccuuauccuguguaccagccaaauauugcugaugcgaacaacuugggcccucugcgaguccauuacccuggcaacaggccccuuaaccacucuuugggaggguucuccagggaaguuuuggaauacgacaaucgcuguuucaauggccaacauuuucagaggaagcuaucuggcgggcgccggucucgcauucucccuaaugaaaagucugggcgggggaaggcgcggcaccggggcucagggagaaacuuugggcgagaaguggaaacggcagcugaaucagcucucuaagagcgaauuuaacaccuacaagagaucagguaucauggagguggaccguuccgaagccaaagaggggcuuaagaggggagagacaacuaaacacgcagucagucggggcaccgcuaagcugcgcugguucguggaacgaaauuugguaaaaccugaggguaaggugauagaucugggcugugggagaggaggcuggagcuauuacugcgccgggcucaagaaaguuacagaagugaagggauauacgaaaggcggucccgggcaugaggaaccgaucccaauggccaccuacggauggaacuuagucaagcugcacucuggcaaagacguguuuuucauuccucccgagaagugugauacucuucugugcgacaucggcgaguccucaccaaaucccacaauugaagaggggaggacccuacggguccucaaaaugguggaaccuuggcugcgcggaaaccaauuuuguaucaagauuuugaauccguacaugcccagcguuguagagacucuggagcagaugcagagaaagcaugguggcaugcucgugaggaacccacuuucgcgaaauucuacacacgaaauguauugggucaguugcgggaccggaaacaucguguccgcgguuaauaugacgagccggaugcuguuaaaccguuucaccauggcucacagaaaaccuacauacgagcgcgauguggaccugggcgcagguacuaggcaugucgccguggaacccgagguagcuaacuuggauauaauugggcagcggaucgaaaauaucaagcacgagcauaaaucaaccuggcacuaugacgaggauaacccuuacaagacaugggccuaucauggauccuacgaagugaaaccaucuggcagcgcaaguuccaugguuaauggcgucgugaagcuccugacuaagcccugggacgugauuccuauggucacccaaauagccaugacagauaccacuccauuugggcagcagagaguuuucaaagagaagguggacacgcgcacacccaaagcuaagaggggaaccgcgcaaaucauggaaguaacugccaaauggcuaugggguuuucuuagccgaaacaagaagccgcggauuuguaccagagaggaguucacaaggaaagugcgcucuaaugcagcuaucggcgccgucuuuguggacgagaaccaguggaacucagcaaaggaggccguugaagaugagcguuucugggaccuggugcaccgggaaagagagcuccacaaacaggggaagugcgcuacgugcgucuauaacaugaugggaaaaagggaaaagaagcugggcgaguuugguaaagccaaggggagucgcgcgauuugguacaugugguugggagcacgauuccuggaguucgaagcccucggcuuuaugaaugaggaucauugguucucccgggaaaacagccuuucuggcguggagggggagggacugcacaaauuagguuacauccugagagacauaucgaagaucccuggcgggaauauguaugcugaugacaccgccggaugggauacuaggauuacagaagacgauuugcagaacgaggcacgcaucaccgacauuauggaaccagagcaugcucuccuggccaaaucaaucuuuaagcuaacuuaccaaaauaaaguaguuagagugcagcggcccgcuaagaacggcacagucauggaugugauaagcaggcgugaccagcgagguuccggacaggugggaaccuauggccuuaauacauucacuaacauggaagcccaacugauucgccagauggagagugagggcaucuuuucuccuagcgaacucgagaccccaaaccuggcagaaagagucuuggauugguuagagaaguacgggguugaacggcugaaaaggauggcgaucuccggagacgacugugugguaaagcccauugaugaccgcuucgccacggcucucaccgcccuuaaugauauggguaaagugagaaaggacauaccgcagugggagccuucaaaaggcuggaacgauuggcagcaaguccccuuuugcagucaccacuuccaucagcugaucaugaaggacgggcgggagauugugguuccauguaggaaucaggaugagcuagugggacgagcacgugucucucagggcgcugguuggagccugagagagacagccugccucgggaaguccuaugcacaaauguggcaguugauguacuuucaccgccgggaccugaggcuugccgcgaacgcuaucuguucagccgugccuguagauuggauucccacuagcagaaccacauggucuauccaugcacaccaucaguggaugacuaccgaagacaugcuguccguuuggaaucgcguguggauagaggaaaacccauggauggaggauaaaacgcacaucaguagcuggggagacguccccuaucucggcaagcgggaggaccaauggugcggcucguuaauugggcugacagccagggcuaccugggccacuaauauccagguggcaauuaaccagguucgaagauugaucggaaaugaaaacuaccuggauuacaugacauccaugaaacgguucaagaaugagucugacccugaaggugcucucugguga

SEQ ID NO: 13875 - RNA, 9879 nt, Artificial Sequence
  derived and/or modified CDS sequence (opt3) from DENV-1__GU131683__SS-prME
agcgugaccaugcugcucaugcuuaugcccaccgcacuggcuuuccacuugacuacgagaggaggggaaccucauaugaucgucuccaagcaggaaagaggaaaaucuuuacuguuuaagaccccagccgguguuaacaugugcacgcuaauugccauggaccucggcgaacugugugaagauacuaugaccuacaaaugcccgcggaucacagagaccgaacccgacgauguggacuguuggugcaaugcgacugauacauggguaaccuaugggacguguucacaaacuggagagcaccgccgagacaagcguaguguggcucuugccccucaugucggccuggguuuggagaccagaacagaaacuuggaugagcuccgagggggcauggaaacagauccagaggguggaaaccugggcccuccggcacccaggauucacaguuauugcucuguuucuggcacaugccaucggcaccucuauuacgcagaagggcaucauauucauccucuuaaugcuggugacucccucgauggcuaugcgcugcgucgggauuggaucaagagauuuuguggagggucuuagcggcgccacauggguagacguuguguuggagcacgggaguugugucaccacuauggcgaaggauaaaccuacacuggacaucgaacuacucaagaccgaggugacgaacccagcagugcugaggaaacuuugcauugaagccaagaucuccaauaccacaacugauucucggugucccacccaaggagaggcuacacuggucgaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuaccccucaggccccaacaaccgagauccagcugacugacuacggggcgcucacacuugauuguaguccgaggacgggacuggacuucaacgaaauggucuugcuaaccaugaaggagaaaagcuggcuggcccauaagcagugguuucucgaucugccccuuccuuggacuucuggcgcauccacaucacaagagaccuggaaucggcaggaccuguuggugacauucaaaacugcucacgccaagaagcaggaaguaguugugcucgguagccaagagggggcuaugcacaccgcccugacgggcgcaaccgaaauccagacaaguggaacuaccacaauuuuugccggccauuuaaaaugccgucugaagauggauaaacuaacucucaaggggaugucuuaugucauguguaccggauccuucaaacuggagaaggaacuugcugagacgcagcacgguacaguguugguccagauaaaguacgagggcaccgacgcgccaugcaaaauccccuucagcacucaagaugaaaagggggugacacagaacggacgccugauuaccgcaaauccuaucguuacugacaaagagaagccagugaacauagaagccgagcccccguuuggcgagucguauauuguaaucggugcuggggaaaaagcccucaagcugucuugguucaagaaaggcuccucaaucggaaagauguuugaggcaaccgccagaggcgcuaggcggauggccauucuuggggauacagcaugggacuucggaaguaucgguggcgucuuuacgagcgcggggaaacuggugcaucagauuuucggaaccgcuuacggcguuuuguuuuccggugugucuuggacuaugaagauagggaucggcguccuccugacaugguuaggacugaauagccgaucaaccagucuauccaugacauguauugccgugggccucguaacucuguaccuuggggugaugguucaggcagauagcggaugcgucaucaacuggaaaggccgcgaauugaagugugguucugggaucuucgugaccaaugaggugcacacguggacagaacaauauaaguuucaggccgacucaccuaaaagacugagugcugccauuggaaaggcaugggaggagggcgucugcgguauaaggagcgcuacccggcucgaaaacaucauguggaaacagauuuccaacgagcugaaucauaucuuacuggaaaacgacaugaaguucacuguuguggugggcgauguagccgggauucuugcgcagggcaagaaaaugauccgcccccaaccaauggaguacaaauauucuuggaagucguggggcaaggccaaaauaaucggggcugacguccagaauaccacauuuauuaucgauggaccuaacacucccgaauguccagacgaucagagagcauggaauauuugggagguggaggacuacggcuucgguaucuuuaccacaaacauaugguugaagcucagggauagcuauacgcagguuugcgaccaccgucugauguccgccgcuauuaaagauucaaaggccgugcacgcagacaugggguacuggaucgaaagugagaaaaaugaaaccuggaagcuagcgcgggccuucuucauugaggucaagacuuguaucuggcccaaaucucauacacuguggagcaacggagugcucgaauccgagaugauaaucccuaagauuuauggcgguccaaucucacaacacaauuaccgaccgggcuacuuuacccagacugcugggcccuggcaucugggaaaacuugaguuggauuucgaccugugcgaaggcacaaccguugugguagaugagcacugcgggaacagaggaccuagcuuaaggacgacuaccgucacaggcaagauuauccacgaaugguguugccgcucuuguacccucccaccccugcgguuuagaggugaggacgggugcugguauggaauggagauaaggccugugaaagaaaaggaggaaaaucuugugaaguccauggucagugccggcagcggugagguugacucuuucucccugggcuugcucuguauuucaaucaugaucgaagaggugaugcgcagucgauggagccggaaaaugcugaugacugggacacuagcaguauuuuuccugcucauuaugggacagcugaccuggaacgaucuuauccguuugugcauuauggugggcgcuaaugccucggacagaauggggaugggaacaacuuaccuggcauuaauggccaccuuuaagaugaggccaauguucgcugucggccuccuguuucgccggcuuacguccagagaggugcugcuacucacaauaggucugucuuugguugcgagcguggaacugcccaacucauuagaggaacucggggauggacuggccaugggcaucaugauucuuaaacuguugaccgacuuccaaagucaucagcucugggcaacucugcuaucccugaccuuuaucaagacaacuuucucucuucacuaugcuuggaaaaccauggccaugguccucagcauugugucccuguuuccguugugucugucaacgacaagccagaagaccacuugguuaccuguucuccugggcagucuugggugcaagccacugacaauguucuugaucgccgagaauaaaauauggggaaggcgaucuuggccccucaacgaagguaucauggcugugggcauugucuccauccugcuaagcucgcugcuuaagaacgauguaccucucgcagggccccugauugccggaggcauguugaucgcguguuacgugauaucagguucuagugcugacuuaucccuggagaaagccgcagagguuagcugggaagaggaagccgagcauucuggggcuagccacaauauucucguggaaguccaggaugacggaaccaugaagaucaaagaugaggagcgcgacgauacucugacaauccuucugaaggcaaccuugcuagccguguccggcguauauccacugucaauuccugcgacacucuucgugugguacuuuuggcagaagaagaagcagcggaguggcguccugugggacacucccagcccaccggaaguugagagagcugugcuugaugacgggauauauaggaucaugcagcguggauuacugggucgcucucaggugggcgucgggguguuccaagaaaacguuuuucauaccauguggcacguaacacggggagccgugcucauguaccagggcaaaagauuggagccuuccugggcaucagucaagaaagaccugauuaguuacggugggggauggaggcuccagggcagcuggaauaccggcgaggaagugcagguuaucgccguggagcccgggaagaaccccaaaaauguccaaacagcucccggaacuuucaagaccccugaaggugaggugggcgccauugcacuggauuuuaagccagggacguccggaucucccaucguaaaccgagaaggcaaaauagucggucuuuaugggaauggagugguuacaacuucgggcaccuacgugagcgcuaucgcccaggcgaaggccucacaggagggcccucugccggagauugaagacgaggucuuccggaaacgcaacuugacaaucauggaucuacacccaggguccggaaagaccagaagguaucugcccgcaauugugcgggaagcuaucaaacgaaagcucagaacuuuaauacuggccccuacccgcguuguggcuagugagauggcagaagcccuuaaggguaugccaauuagguaccaaacaacggccgucaaaucugagcauacuggcaaggagaucguggaccugaugugccacgcuaccuuuacaaugcgucucuugagccccguacgggugccuaauuauaacaugaucauuauggaugaagcgcauuucaccgacccguccucaaucgcagccagaggguacauaucuacuaggguuggaaugggcgaggcugccgcaauuuuuaugacagccacaccaccagguagcgucgaggcuuucccucagaguaaugcggugauccaggaugaggaacgcgacauucccgagcgauccuggaacagcggguaugaguggaucacggauuuuccaggaaaaacugugugguucgucccuucuauaaagucaggcaaugacauugccaacugucugaggaaaaauggcaagcggguaauccagcucuccaggaagacauucgauaccgaauaccagaaaaccaagaacaacgacugggacuacgugguuacuacagauaucagugagaugggggcaaauuuucgcgcugaccgugugauugaucccagacggugccugaaaccagucauccuuaaggacggaccggaaagggugauucuagccgguccuaugcccguuaccguggcaagcgccgcucagcgccgaggcagaauagggcggaaccacaauaaagagggagaucaguauaucuacaugggccagccacugaacaaugacgaggaucaugcccacuggacagaagcgaagauguuguuagacaacauuaauacucccgaggguaucaucccugcacuguucgaaccagagagggaaaagucggccgcuauugauggggaguaucgccucagaggcgaggccaggaaaacguuugucgaacugaugcggcguggagaccuucccguguggcugucuuacaagguagcuuccgagggcuuccaauauagcgaucgccgauggugcuuugacggggaaagaaacaaucaggugcucgaggaaaacauggauguugagauauggaccaaagagggagaaaggaagaaauugcggccucgcuggcuggacgcaagaacauacucagacccgcuagcccugagggaguucaaggaauuugcugccggucggcgaagugucucuggcgaucucauccuugagauugggaaacugccacagcacuuaacucagagagcacaaaaugcguuggacaaccuggugaugcuccauaauuccgaacagggaggccgcgccuauaggcacgcuauggaggagcugcccgauaccaucgaaacacuuaugcugcucgccuugauugcagugcugaccgguggggucacuuuauucuuucuaagcggccggggacugggcaagacgucaaucgggcuccuuuguguuauggcuaguagcgugcuguuguggauggccuccguagagccucauuggauagcagccucuaucauucuggaguucuuucucauggugcugcuuauccccgagccagaccgucagagaaccccucaggauaaccaacucgcuuacgucgugauuggacuguuguucaugauccugacaguugcggccaaugagauggguuuacuagaaacuaccaagaaagaccugggcauagggcacguggcagucgagaaccaccaucacgcugccaugcucgauguagaccuucaucccgccagcgcauggacacuguacgcuguggccaccacuauuaucacaccaaugaugaggcacacgauugaaaacaccacugcgaauaucuccuugacagcuauagccaaccaggcagccauccugaugggacucgauaagggcuggccuauuucaaaaauggacaucgguguuccgcugcuugcuuuagggugcuauucucaggugaauccccugacccucaccgcagccgucuugaugcugguggcgcauuacgcuauuaucggcccaggacuacaagccaaggcaacacgcgaggcccagaaacggacugcugccggcauaaugaagaacccuacggucgaugggauuguggcaaucgaccuggaucccguuguguaugacgcuaaguuugaaaaacagcucggacagaucaugcuucugauuuuguguaccagucaaauccugcucaugcgaacaacuugggcccugugcgagucgauaaccuuagcgacaggcccacuuaccacucugugggaggguagcccugggaaguucuggaauacgacaauugccguauccauggcaaacaucuucagaggaucuuaccucgcuggcgccggucuagcauuuucacugaugaaguccuugggcgggggaaggcgcggcaccggggcucagggagaaacucugggcgagaaguggaaacggcagcucaaucagcuuagcaagagugaguucaacaccuauaagagaucugguauuauggagguggaccguagcgaagccaaagaggggcugaagaggggagagacaacuaaacacgccgucucacggggcaccgcgaaguugcgcugguuuguugaacgaaaucuggugaaacccgaggguaaggucaucgaucucggcugugggagaggaggcugguccuacuauugcgcuggguuaaagaaagugacagaaguaaagggauacacgaaaggcgguccggggcacgaggaaccaauaccuauggcaaccuacggauggaaccuggugaaacuucauaguggcaaagacguuuucuuuauacccccagagaagugugauacucugcuaugcgacauuggcgagagcucucccaauccuacaaucgaagaggggaggacccuccgggugcugaaaauggucgaaccgugguugcgcggaaaccaauucuguauuaagauccugaaucccuauaugccauccguggucgagacucucgagcagaugcagagaaagcacgguggcaugcuugugaggaacccucugucacgaaauagcacacaugaaauguacuggguuucgugcgggaccggaaacauuguaucugccgugaauaugacgagucggauguuacugaaccguuuuaccauggcucacagaaaacccacauaugagcgcgaugucgacuugggcgccgguacuaggcacguggcaguugaaccugagguggccaaccucgauaucauagggcagcggauugaaaauaucaagcaugagcacaaauccaccuggcauuacgacgaggauaacccauauaagacaugggcuuaccacggaagcuaugaagucaaacccucaggcuccgcgucuagcauggugaauggcguagugaagcugcuaacuaagccuugggacguuaucccaauggucacccaaauugccaugacagauaccacucccuucgggcagcagagaguguuuaaagagaagguggacacgcgcacaccgaaagcaaagaggggaaccgcucaaauaauggaagucacugccaaauggcuuugggguuuccugagucgaaacaagaagccucggaucuguaccagagaggaauuuacaaggaaaguucgcuccaaugcagccauuggcgcuguguucguagacgagaaccaguggaauagcgccaaggaggcgguggaagaugagcguuuuugggaccucguccaucgggaaagagagcugcacaaacaggggaagugcgcaacgugcguguacaacaugaugggaaaaagggaaaagaaguugggcgaguucgguaaagccaaggggucucgcgcuaucugguacauguggcugggagcccgauuccucgaguuugaagcacuuggcuucaugaaugaggaucacugguuuucacgggaaaacagucuguccggcguugagggggagggauuacauaaacuggguuauauuuugagagacaucagcaagauaccaggcgggaauauguacgcugaugacaccgccggaugggauacuaggaucacagaagacgaucuccagaacgaggcucgcauuaccgacaucauggaacccgagcacgcccugcuagcaaaaucuauuuucaaacuuacuuaucaaaauaaaguggucagagugcagcggccugcgaagaacggcacaguaauggauguuaucucgaggcgugaccagcgagguucagggcaagugggaaccuacggccugaauacauuuacuaacauggaagcccaacucauacgccagauggagagcgagggcauuuucuccccaagugaacuggagacccccaacuuggcugaaagagucuuagauuggcuggagaaguaugggguggaacggcucaaaaggauggccaucucuggagacgacuguguggucaagccgaucgaugaccgcuuugcaacggcucuuaccgcccugaaugauauggguaaaguuagaaaggacauuccucagugggagcccagcaaaggcuggaacgauuggcagcaagugccauucugcucccaucacuuucaccagcuaauaaugaaggacgggcgggagaucguagugccuuguaggaaucaggaugaacuggucggacgagcacgugugucacagggcgccgguuggagucucagagagacagcgugcuuggggaagucuuacgcucaaauguggcagcugauguauuuccaucgccgggaccuuaggcuggccgcaaacgccauuuguagcgcuguucccguggauuggaucccaacuuccagaaccacauggucaauucacgcccaucaccaguggaugacuaccgaagacaugcucagcgucuggaaucgcguguggaucgaggaaaaccccuggauggaggauaaaacgcauauaucuuccuggggagacguaccuuacuuaggcaagcgggaggaccaauggugcggcagucugaucggguugacagcaagggcuaccugggccacuaauauucagguugcgaucaaccaggugcgaagacugauuggaaaugaaaacuaccucgauuauaugacaagcaugaaacgguuuaagaaugagucggacccagaaggugcucuuugguga

SEQ ID NO: 13876 - RNA, 9879 nt, Artificial Sequence
  derived and/or modified CDS sequence (opt3) from DENV-1__GU131684__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaagguauccgcuggcucaggugagguggacaguuuuagccuuggccuguuguguauuucgaucaugaucgaagaggucaugaggucccgcuggucucgaaaaaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaagaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaaacuucugacggacuuucaaagccaucaguugugggccacacuccugucccuaaccuucaucagaacuaccuuuucacugcacuaugcauggaagacaauggcuauggugcuuagcauugucagucucuucccccuguguuugucuacuaccucccagaagacgacauggcugccgguauuacucggcagccuggggugcaaaccucuuaccauguuucugaucgccgagaauaagauauggggaaggaaaucguggccauugaacgaagguaucauggccgugggcauuguuucaauccuccugucuagucuacugaagaacgaugugccccuugcugggccucucauugcaggaggcaugcugaucgccuguuacgucauauccgguagcucugcggacuugagcuuagagaaagcugccgugguauccugggaggaagaggcagaacauucaggggccagucacaauauucugguggagguccaggaugacggaacuaugaagaucaaagaugaagagcgagacgauacacucaccauccugcuuaaggcuacucuguuggcaguuagcggcguguauccccuaucuauuccagccacacuguucgugugguacuucuggcaaaagaaaaagcagcgcuccggcguccucugggacaccccuucacccccagagguggaacgggcgguucuggaugacgggauauauagaaucaugcagaggggacuuuuaggucguagucagguaggcgugggggucuuucaagagaacguguuccauacgauguggcacguuacucgcggagcugugcugauguaccagggcaaacggcucgaaccgagcugggccuccgucaagaaagacuugauuucuuacggugggggauggagacugcagggcucguggaauaccggcgaggaggugcagguaaucgcagucgaaccugggaagaaccccaagaaugugcaaacagccccaggaaccuuuaaaacaagcgagggugaaguuggcgcuauugcccucgauuucaagcccgggacuucaggauccccuaucgugaacagggagggcaaaauagucggucuguaugggaauggagugguuaccacgaguggcacauacgugucugcaaucgcucaggccaaggcgagccaggaaggcccacuucccgagauugaggacgaagucuuucgaaaacggaaccugacuaucauggauuugcacccuggguccggaaagacccgcagauaucuaccggccauugugagggaggcaaucaagcggaaacugcgaacacucauauuagcuccaaccagaguaguggccucagaaauggcugaggcacugaaggguaugcccauucgcuaccaaacuaccgccguuaaaucugaacauacaggcaaggagaucgucgaccuuaugugccacgccacguucacuaugaggcugcucagcccugugcgugugccaaauuauaacaugaucauuauggaugaggcucauuuuaccgaccccaguuccaucgcggcacggggguacauaagcacaagagucggaaugggcgaagccgcugccauuuucaugaccgcaacuccuccggguucuguagaggccuuuccccagucaaaugcugugauccaggaugaagagagggacauuccagaacgcuccuggaacaguggguaugaguggaucacagauuucccuggaaaaaccguuugguuugugcccagcauaaagucgggcaaugacauugcgaacuguuugcgaaagaauggcaaaagagucauccagcugucucggaagacguucgauacugaguaccaaaaaacaaagaacaacgacugggacuacgugguuaccaccgauaucuccgaaaugggggccaauuucagggcagaccgcgugauugauccacguagaugccucaaaccugucauccugaaggacggacccgagcgggugauucuugcugguccaaugccgguaacuguggccagcgcagcccagaggcgcggccgaauagggagaaaccacaauaaggaaggagaucaguauaucuacaugggccagccucuaaacaaugacgaggaucaugcucacuggacagaggccaaaaugcuguuggacaacauuaauacccccgaagguaucaucccagcguuauuugagcccgaacgggagaagucagcagccauugauggggaauauaggcugcgcggcgaggcuagaaaaacauucguugagcucaugaggcggggagaccugccugucuggcuuaguuacaagguggccucugaaggcuuucaauauuccgaucgucgcuggugcuucgacggggagcgaaacaaucaggugcuggaagagaacauggaugucgaaauauggacuaaagagggagagagaaagaaacucaggccacggugguuggacgcucgcacguacagcgacccccuggcacuaagagaauuuaaggaguucgccgcugguaggcggucaguuaguggcgaucugauccucgaaauugggaagcuuccucagcaccugacccagcgagcccaaaaugcauuagacaacuuggugaugcugcauaauagcgagcagggaggcagagcguaucgccacgccauggaagagcucccggauacaaucgagacucugaugcuucuggcucucauugccguauugaccgguggggugacacuguuuuucuuauccggcaggggacuaggcaaaaccucuaucgggcugcucugugucauggcaagcuccgugcuucuguggauggcuucaguugaaccacauuggauagccgcaucuaucauuuuggaguuuuuccugauggugcuccugauccccgaaccugaccggcagcguacuccccaggauaaccaacuugccuacgucguaauuggacuccuguuuaugaucuugacgguggcugcgaaugagaugggucuguuagagaccacaaagaaagaccuaggcauagggcacguugccguggaaaaccaccaucacgcagcuaugcuggaugucgaccuccauccagccagugccuggacucuuuacgcaguggcuaccacaauuaucaccccuaugaugagacacacuauugagaacacaacggccaauaucucgcugaccgcgauagcuaaccaggccgcaaucuugaugggacuggauaagggcuggcccauuagcaaaauggacaucggugucccacuccuggcccuugggugcuauucccaggugaauccuuuaacucugacagcugcaguucucauguugguggcccauuacgcgauuaucggcccgggacugcaagcuaaggccaccagggaagcacagaagcgcaccgccgcuggcauaaugaaaaaccccacaguagaugggauuguggccaucgaccuagauccagucguuuaugacgcaaaguucgagaaacagcugggacagaucaugcuccuuauucuguguacuucucaaaucuugcugaugcggacgaccugggcucucugcgaaucaauaacacuggccacuggcccuuuaaccacacuuugggaggguagccccgggaaguuuuggaauaccacuauugcgguguccauggccaacaucuuccgaggaaguuaccuggcaggcgcuggucucgccuucucucuaaugaaaagccugggcgggggaagaaggggcacgggggcacagggagagacauugggcgaaaaguggaagcgccagcugaaucagcucucaaaauccgaguuuaacaccuauaagcggagugguauuauggaagucgacagaagcgaggcuaaagaagggcuuaagcguggagagacuaccaaacacgccgugucuaggggcacagccaagcugcggugguucguagagcgcaauuuggugaagccagaagguaaaguuaucgaucugggcugugggcgaggaggcugguccuacuauugcgcggggcucaagaaagugacugaggucaagggauacaccaaaggcgguccugggcacgaagagcccauaccgauggcuacauacggauggaacuuagugaagcugcauucaggcaaagacgucuuuuucaucccaccugaaaagugugauacgcuucugugcgacauuggcgagagcucgcccaauccaaccaucgaggaagggagaacucuaagggugcucaagaugguugagcccuggcugcggggaaaccaauuuuguauuaaaaucuugaauccuuauaugccgucuguaguggaaacacuggagcagaugcagcgcaagcacgguggcaugcucgucagaaacccccuuaguaggaauuccacccaugagauguacugggugagcugcgggacuggaaacauuguuucagcagugaauaugacaucccgaaugcuguuaaaccgguucaccauggcccaccguaaaccaacguaugaaagagaugucgaccugggcgcugguacccgccacguggccguagagccugaaguggcaaacuuggauaucauagggcagaggauugagaauaucaagcaugaacacaaaucuacauggcauuacgacgaggauaaccccuauaagacuugggccuaccacggaagcuaugagguuaagccuaguggcuccgcuagcucuauggucaauggcguggugaaacuccugaccaagccaugggacgucauccccaugguuacacaaauugcgaugacugauaccacaccuuuugggcagcagcggguguucaaagaaaagguagacaccagaacuccaaaagccaagcgcggaacggcacaaauaauggaggugacagcuaaguggcuaugggguuuucuuucaaggaacaaaaagccccgaaucuguacccgggaagaguucacuagaaaagucaggaguaaugccgcaauuggcgccguguuuguugacgaaaaccaguggaauuccgcuaaggaggccguggaggaugaacgcuucugggaccugguccaucgugagcgggaacuccacaaacaggggaagugcgcgaccugcguguacaacaugaugggaaagagagagaaaaagcugggcgaauuugguaaagcaaaggggagcagggccaucugguacaugugguugggagcucgcuuccuggaguucgaggcccucggcuuuaugaaugaagaucacugguucucucgagagaacucgcuuucaggcguagaaggggagggacugcauaaauuagguuauauucugcgggacaucagcaagauaccgggcgggaauauguacgcagaugacacagcuggaugggauacgagaaucaccgaggacgauuugcagaacgaagccaaaauuacugacaucauggagccugaacacgcucuccuggccaaguccauuuuuaagcuaacauaucaaaauaaaguugugaggguccagcgcccagcaaagaacggcaccgugauggaugugaucaguagacgggaccagagggguucugggcaggucggaacuuacggccuuaauacauucaccaacauggaggcgcaacugauacgucagauggaaagcgagggcauuuuuucccccucagagcucgaaacaccuaaccuggccgggcgaguuuuggauugguuagagaaacauggaguggaacgccugaagagaauggcuaucaguggugacgacuguguagugaaaccaaucgaugaccgguucgccacugcacucaccgcucuuaaugauaugggcaaggucaggaaggacauuccccagugggagccgucuaaaggguggaacgauuggcagcaagugccuuuuugcagccaccacuuccaucagcugauaaugaaggacggacgcgaaaucguugugcccuguagaaaucaggaugagcuagucggccgggccagggugucccagggugcaggguggucacugcgagagacggccugccucggaaaaagcuaugcgcaaauguggcaguugauguacuuucaccguagagaccugcgccuugcugccaacgcaauuuguucugccguaccaguugauugggugccuaccucccggacaacuuggaguauccaugcucaccaucaguggaugaccacagaagacaugcugagcgucuggaauaggguguggauugaggaaaaccccuggauggaggauaagacucacaucucguccuggggcgacguuccauaucucggcaaaagagaagaccaauggugcgggucuuuaauaggacugaccgcccgcgcaacgugggcuacaaauauccagguggccauuaaccagguccggagguugcuggguaaugagaacuaccucgauuacaugaccucaaugaagcgauucaagaaugagagcgaccccgaaggcgcgcuuugguga

SEQ ID NO: 13877 - RNA, 9879 nt, Artificial Sequence
  derived and/or modified CDS sequence (opt3) from DENV-1__GU131685__SS-prME
agcgugaccaugcugcucaugcuuaugcccacagcccuggcuuuccacuugacuacgagaggcggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggagaaacuaacucucaaggggauguccuaugugauguguaccggaucguucaaacuggaaaaggaggucgccgagacgcagcacgguacagugcuuguucagauaaaguacgaaggcaccgaugcuccuugcaaaaucccauucucgacucaagacgagaagggggugacacagaacggacgcuugauuaccgcgaaucccaucguaacugauaaagaaaagccugucaacauagaggcagagccacccuuuggcgaaucuuauauugugaucggugccggggagaaagcucugaagcucuccugguucaagaaaggcucaaguaucggaaagauguuugaagccaccgcaagaggcgccaggcggauggcuauucugggggacacagccugggauuucggaagcaucgguggcguuuuuacguccguggggaaacuuauucaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugacucuggaugcgugaucaacuggaaaggccgcgagcuuaagugugguucagggauuuucgucaccaaugaaguucacacguggacagagcaauauaaguuucaggccgauaguccgaaaagauugagcgcagccauaggaaaggcuugggaggaaggcgugugcgguaucagguccgccacccggcuggagaacauuauguggaaacagaucucuaacgaacucaaucauauucuguuagagaacggcaugaaguucacugugguagucggggacguggcaggaauccuggcucagggcaaaaagaugauacgcccucaacccauggaauacaaauauucguggaaaagcugggggaaggccaagaucauuggagcggacguucagaauaccacauuuaucauugauggcccaaacacuccugagugucccgacgaucagagagccuggaauaucugggagguggaagacuacgguuucgggauauuuaccacaaacauuuggcuuaaguugagggauuccuauacgcaggucugcgaccaccgucucaugucagcugcaaucaaagauaguaaggccgugcacgcugacaugggauacuggauugagucugagaaaaaugagaccuggaagcuggcccgggcauccuucaucgaaguuaagacuuguauauggccaaaaucccauacacuauggucaaacggcgugcuggagagcgagaugaucauucccaagaucuaugguggcccuauuucucaacacaauuaccgaccaggguacuucacccagacugcgggaccguggcaucucggcaaacuggaacuugauuuugacuugugcgaggggacaaccguagucguggaugaacacugcggaaacagaggccccucccugaggacgacuaccgugacagguaagaucauacacgagugguguugccgcaguuguaccuuaccuccacuccgguucagaggggaggacggaugcugguauggcauggaaauuaggcccgucaaagagaaggaagagaaucugguuaagagcauggugucugccgguuccggcgaaguagauucauuuagucuugggcuguuguguaucagcaucaugauugaggaggugaugcgcucgcgauggucccggaaaaugcucaugacuggaacacuggcugucuucuuucuacugaucaugggccagcucaccuggaacgaccugauucgucuuugcauaauggugggggccaaugcaucugacagaaugggaaugggcacaacuuacuuggcucugauggccaccuucaagaugaggccuauguuugcaguugguuuacucuuccgccggcugacgagcagagaagugcuucugcuaacaaucgggcucucacuggucgccaguguggaguugccaaacucccuggaagaguuaggagauggccucgcuaugggcauuaugauccugaaacuucugaccgacuuucaaucucaucaguugugggcgacucuccugagccuaaccuucauuaagacaacuuuuucccugcacuaugccuggaaaaccauggcaaugguucuuucaaucgugagccucuucccccuguguuugaguacgacaucucagaagaccacuuggcugccggucuuacucgggucccugggaugcaagccucuuacaauguuucugauagcugaaaauaaaaucugggguaggcgaagcuggccauugaacgagggcauuauggccguagggaucgugucgauucuccugucaucucuacugaagaacgauguuccccuugccggaccucucaucgcuggcgguaugcugauagcauguuacgugauuaguggguccagcgccgacuugucuuuagagaaagcggcugaagucagcugggaggaagaggccgaacauuccggagcaucacacaauauccugguggagguacaggaugacggcaccaugaagaucaaagaugaggaacgcgacgauacucucacaauucugcuuaaggccacccuguuggcugugaguggcgucuauccccuaagcauaccagcaacgcuguucguuugguacuucuggcagaaaaagaagcagcggucuggggugcucugggacacuccuucacccccagagguggaaagagccguccuggaugacggaaucuauaggauuaugcagcguggucuuuuaggccgcagccagguggggguuggaguauuucaagagaacguguuccauaccauguggcacgucacacggggcgcggugcugauguaccaggguaaaagacucgagccgaguugggcuagcguuaagaaagauuugaucuccuacgggggaggcuggaggcugcagggcucuuggaauaccggggaagaggugcaggucauugccguggaaccuggaaagaaccccaaaaauguacaaacagcaccagguacuuuuaagacccccgagggcgaagucggggccaucgcucucgacuucaagccuggaacgucgggcagcccaauagugaaccgagaggguaaaaucguugggcuguauggaaauggcguggucacaacuucaggcaccuacguguccgccauugcacaggcuaaggccagucaggaggggccccuuccugaaaucgaggacgaaguuuuucggaaacgcaaccugacaauuauggauuugcacccgggaucugguaagaccagaagguaucuaccagcgaucgugcgggaggccauaaaacgaaagcugagaacucucauuuuagcacccacccgcgucguggcuagcgaaauggccgaggcucugaagggcaugccuaucagguaccaaacaacggcaguaaaauccgagcauacugggaaggaaaucguggaccuuaugugccacgccaccuucacaaugcgucugcucucaccaguucggguccccaauuauaacaugauuaucauggaugaggcccauuuuaccgacccuucuagcauagcugcgagaggauacauuaguacuagggugggcaugggugaagcagccgcuaucuucaugacagccaccccgcccggguccguggaggcauuuccacagagcaaugccgucauucaggaugaagaacgcgacaucccugagcgaucuuggaacucaggauaugaauggauaacggauuuccccggcaaaacuguaugguuugugccauccauuaagaguggcaaugacaucgcuaacuguuugaggaaaaaugggaagcggguuauccagcugagcaggaagacauucgauaccgaguaccagaaaaccaagaacaacgacugggauuacguggucacuacagacauuucggaaaugggagcgaauuuccgcgccgaccgugugaucgauccuagacggugccucaaacccguuauucugaaggacgguccagagagggugauacuugcaggcccgaugccugucaccguggcuucugccgcacagcgccgagggagaaucggacggaaccacaauaaagagggcgaucaguauauuuacaugggucagccccuaaacaaugacgaagaucaugcccacuggacagaggcuaagaugcuguuggacaacaucaauacuccagaagggaucauucccgccuuauuugagccugaaagggagaaguccgcggcaauagauggcgaguaucgccugagaggagaagccaggaaaacguucguagagcucaugcggcguggcgaccugccaguguggcuuagcuacaagguugcuucagaaggguuucaauauagugaucgccgauggugcuucgacggagagagaaacaaucagguccuggaagagaacauggauguggagaucuggaccaaagaaggugagaggaagaaacuccggccccgcugguuggacgccagaacauacucugauccucuggcucuaagggaauuuaaggaguucgcagccggccggcgauccgugagcggggaccugauucucgaaaucggaaaacuuccgcagcaccugacucagagagcucaaaaugccuuagacaacuuggucaugcugcauaauucagagcagggcggucgcgcauauaggcacgcgauggaggaacucccagauaccauugagacacugaugcuucuggcccucaucgcuguuuugaccgggggcgugacucuguuuuucuuaaguggacggggccuagggaagacgagcauaggacugcucuguguaauggccuccucugugcuucuguggauggcaagcgucgaaccccauuggaucgcugccuccauuaucuuggaguuuuuccugauggugcuccugauuccugagcccgaccgucagagaaccccacaggauaaccaacuugcauacguugugaucggucuccuguuuaugauauugacagucgccgcuaaugaaaugggccuguuagagacuaccaagaaagaccuagggauuggacacguagcgguggaaaaccaccaucacgccgcaaugcuggauguugaccuccauccugcuucagccuggacacuuuacgccguggcaaccacuaucauuacacccaugaugaggcacacgaucgagaacaccacugcuaauauaucucugacagccaucgcgaaccaggcugccauuuugaugggccuggauaaggguuggccaaucaguaaaauggacauuggggucccucuccuggcacuuggcugcuauagccaggugaauccguuaacccugaccgccgcuguccucauguugguggcacauuacgccaucauaggacccggccugcaagcgaaggcuacacgcgaagcccagaaacggacugcagccgggauuaugaagaacccaacgguugauggaaucguggcuaucgaccuagauccuguaguguaugacgccaaguucgagaaacagcugggccagauuaugcuccuuauccuguguaccagccaaauauugcugaugcgaacaacuugggcacucugcgaguccauuacccuggcuacaggucccuuaaccacucuuugggaagggucuccaggaaaguuuuggaauacgacaaucgccgucucaauggcgaacauuuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggaucauggaaguugaucguuccgaggcaaaagagggacuuaagaggggcgaaacaacuaaacacgcugugagucgggguaccgccaagcugcgcugguucgucgagcgaaauuuggugaaaccugaaggcaagguaauagaccugggguguggaagaggcggguggagcuacuauugcgccggacucaagaaagugacagagguuaagggcuacacgaaaggugggcccggacacgaggaaccgaucccaauggcgaccuacggcuggaacuuagugaagcugcauucuggcaaagacgucuuuuucauuccucccgagaagugugauacucuucugugcgacaucggggaauccucaccaaaucccacaauugaggaaggaaggacccuacgggugcucaaaauggucgagccuuggcugcgcgguaaccaauuuuguaucaagauuuugaauccguauaugcccagcgugguugagacucuggaacagaugcagagaaagcacggcgggaugcucguaaggaacccacuuucgcgaaauucuacacaugagauguacugggugaguugcggaaccggcaacaucgucuccgcugugaauaugacgagccggaugcuguuaaaccguuucaccauggcacacagaaaaccuacauaugaacgcgauguugaccugggugccgggacuaggcacguggcugucgagcccgaaguggccaacuuggauauaauuggacagcggaucgagaauaucaagcaugagcacaaaucaaccuggcauuacgacgaagauaacccuuauaagacaugggcauaccacggcuccuaugagguaaaaccaucuggcagcgccaguuccauggugaaugggguugucaagcuccugacuaagcccugggacgugauuccuauggugacccaaauagcuaugacagauaccacuccauuuggacagcagagagucuucaaagaaaagguugacacgcgcacacccaaagcgaagagggguaccgcccaaaucauggaggugacugcaaaauggcuauggggcuuucuuagccgaaacaagaagccgcggauuuguaccagagaagaguucacaaggaaaguacgcucuaaugcugccaucggggcaguguuugucgaugagaaccaguggaacucagccaaggaagcuguggaggacgaacguuucugggaccugguucaucgggagagagaacuccacaaacagggaaagugcgccacgugcguguacaacaugaugggcaaaagggagaagaagcugggugaguuugggaaagcgaagggaagucgcgcaauuugguacaugugguugggcgcccgauuccuggaguucgaggcucucggcuuuaugaaugaagaucacugguucucccgggagaacagccuuucuggggucgagggagaaggucugcauaaauuaggcuauauccugagagacauaucgaagaucccugggggaaauauguacgccgaugacaccgcaggcugggauacuaggauuacagaggacgauuugcagaacgaagcucgcaucaccgacauuauggagccagaacacgcccuccuggcuagaucaaucuuuaaacuaacuuaucaaaauaaggugguacggguucagaggcccgccaaaaacgguacagugauggaugucauaagccgucgagaccagcgcggguccggacaggugggcaccuacggccuuaauacauucacuaacauggaggcacaacugauuagacagauggagagugaagggaucuuuucuccuagcgagcucgaaaccccaaaccuggcggagcggguguuggauugguuagaaaaguauggagucgagaggcugaagcgcauggccaucuccggugacgauuguguugugaaacccauugacgacagauucgcuacggcccucaccgcacuuaaugauaugggcaagguacggaaagacauaccgcagugggagccuucaaagggguggaacgauuggcagcaagugcccuuuugcagucaucacuuccaccagcugaucaugaaagacggaagggaaauugucgugccaugucgaaaucaggaugagcuaguuggccgugcuagagugucucagggugccggguggagccugcgcgaaacagcaugccucggaaaguccuacgcccaaauguggcaguugauguauuuucaucggagggaccugagacuugcggcuaacgccaucuguucagcagucccuguggauuggauucccacuagccgcaccacauggucuauccacgcccaucaccaguggaugacuaccgaggacaugcuguccguauggaaucggguuuggauagaagagaacccauggauggaggauaagacgcauaucaguagcuggggcgacgugcccuaccucggcaaaagggaagaucaauggugcgggucguuaauuggacugacagcucgagccaccugggcaacuaauauccaggucgcuauuaaccaggugagacgguugaucgguaaugagaacuaccuggacuauaugacauccaugaagagguucaaaaaugaaucugacccugagggcgcccucugguga

SEQ ID NO: 13878 - RNA, 9879 nt, Artificial Sequence
  derived and/or modified CDS sequence (opt3) from DENV-1__GQ868614__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaucugcagguguuaacaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagagcaggacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuaccccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaccuuucaaacuggagaaggaaguggcugagacccagcacgguacgguccuugugcagauaaaguacgagggcacagacgcgccaugcaaaauccccuucagcacccaagaugaaaaggggguuauucagaacggacgcuugaucacugcaaauccuauagugacagacaaagagaagccaguaaacauugaagccgagcccccguuuggcgagucguauaucgucaucggugugggggaaaaagcucugaagcucucuugguucaagaaaggcuccucaauuggaaagauguuugaggccaccgcaagaggcgccaggcggauggcuauccugggggauacugccugggacuucggaaguauugguggcguuuuuaccagcguggggaaacuuguccaucagauauucggagcagcguacggcgugcuguuuuccgguguaucuuggacaaugaagaucgggauuggcguguugcucacguggcugggauuaaauagccgaucaaccagucuguccaugacuuguaucgcuguuggccuagucacacucuaccugggggugauggugcaggccgauagcggaugcgucaucaacuggaaaggccgcgaacuuaagugugguucugggauuuucguuaccaaugaggugcacacauggacugaacaauauaaguuucaggcagacucaccuaaaagauugagugccgcuauaggaaaggccugggaggagggcgugugcgguaucaggagcguaacccggcuggaaaacauuauguggaaacagaucuccaacgagcucaaucauauucuguuagaaaacgacaugaaguucacggucgugguuggcgauguggucgggauccuggcacagggaaaaaagaugauacgcccccaaccaauggagcacaaauacucuuggaagucguggggcaaggcuaaaaucauuggggccgacgugcagaauacaaccuuuaucauugauggaccuaacacucccgaauguccagacgaucagagagcguggaauaucugggagguugaggacuauggcuucgguauauuuaccacaaacauuuggcuuaaguugagggauagcuacacucaggccugcgaccaccgucucauguccgcugcaaucaaagauucaaaggccgugcaugcugacaugggguauuggauugaaagugagaaaaaugaaaccuggaagcuggcccgggcaucuuucaucgagguaaagacauguauauggcccaaaagccacacgcuaugguccaacggaguccuggaaucagagauggugaucccuaagauuuacggcgguccaaucagccaacauaauuaucgaccgggcuacuucacccagacugcggggcccuggcaccucggaaaacuggagcuugauuuugacuugugcgaaggcacaaccguggucguugaugagcacugcgggaacagaggaccuucucugaggacuacaaccgugacgggcaagauuauccaugaaugguguugccgcuccuguacuuuaccaccccuccgguucaaaggugaggacgggugcugguacggaauggagauaagaccuguaaaggaaaaggaggaaaaucuggugaaaaguauggucagcgccggcucuggugagguggacuccuuuucacuuggccuguuguguauuaguaucaugaucgaagagguuaugaggagccgcuggucgcgaaagaugcucaugaccgggacacuggcuguguuccuacugcucauuaugggacagcugaccuggaacgaucuuauccgguugugcauuauggucggcgccaaugcauccgaccguauggggaugggaacuacauaucuggcuuuaauggccaccuuuaaaaugagaccaauguucgcagugggccuccuguuuaggcgccuuacaucucgggagguucugcuacucacuauaggucugagcuugguggccucagucgaacugcccaacaguuuagaggaacucggggauggacuggcuaugggcaucaugauucuuaagcuguugaccgacuuccaaucccaccagcucugggcgacgcugcuaucucugacauuuaucaaaaccacucuuagccuccauuacgccuggaagaccauggcaaugguacuguccauugugucauuguucccgcuguguuuaagcacaacuagucagaagaccacguggcucccuguucugcuuggcucucuggggugcaaaccauugacaauguuucucaucgcugagaauaagauauggggaagaaaauccuggccccugaacgaagguaucauggccgugggcgucgugagcauucuacugucgucacuucucaagaacgauguaccucuggccgggcccuugaucgcuggaggcauguuaauugcauguuaugugaucucugguaguuccgccgaccugagccucgagaaagcggcugaggucucuugggaagaggaagccgagcacagcggggcaucccauaauauacugguugaagugcaggaugacggaaccaugaagauuaaagaugaggagagggacgauacucuuacaauccuguugaaggccacccuacuggcugugucaggcgucuacccacucaguaucccugcaacucuguucgugugguauuuuuggcaaaagaaaaagcagcgaagcggcguucuuugggacacacccucuccaccggaaguagagcgcgccguguuagaugacgggauuuaccggauaaugcagagaggacugcucgguaggucccaggucggcguggggguuuuccaagaaaacguguuccacaccauguggcacgucacgcguggagcgguguugauguaucagggcaaacgccuggagccuucaugggcuaguguaaagaaagaccucaucagcuacggugggggauggcggcugcagggcuccuggaauacuggcgaggaaguccaggugauugccguugagcccgggaagaacccaaagaaugugcaaaccgcacccggaacauuuaaaaccccugaaggugaggucggcgccaucgcucuugauuucaagccagggacaucuggaucgcccauugugaacagagaaggcaaaaucguuggucuguacgggaauggaguggucacuaccagcggcacguaugugucagccauagcacaggcuaaggccucccaggagggcccuuugccggagaucgaagacgagguauuuaggaaacgaaaccuaacaauuauggaucugcauccagggaguggaaagacucggcgcuaccuccccgcgaucgugagagaagccauuaagaggaaauuacggacccugauccuugcaccuacacgaguugucgcuucugagauggccgaagcucugaaggguaugccaauaagauaucaaaccacugcagugaaaagcgagcacaccggcaaggagauuguggaccucaugugccaugccacauucacgaugcgcuugcugucccccgucaggguaccuaauuacaacaugaucaucauggaugaagcccacuuuacugacccgucaucuauugcugcgcguggguauaucagcacccgggugggaaugggcgaggcagccgcuauauucaugacagccacccccccagguaguguugaagcauuuccucaguccaaugccgugauucaggaugaggaaagagacauccccgagaggagcuggaacucuggguacgaguggauuacugauuucccaggaaaaacagucugguuugugccuucaaucaaguccggcaaugacauagcuaacugucuccgcaagaauggcaaacgaguuauucagcugaguagaaagaccuucgauacggaauaucaaaaaacuaagaacaacgacugggacuacguggucacaaccgauaucagcgagaugggggcgaauuuucgggccgacagggugaucgauccccgccguugccuuaaaccaguaauucuaaaggacggaccggaaagagugauccuggcagguccuaugcccguuaccgucgcuucggccgcacagcggaggggccgcauugggcgaaaccauaauaaggagggagaucaguacauauauaugggccagccauugaacaaugacgaggaucacgcccacuggacugaagcuaaaauguuacuggacaacaucaauacacccgaggguauuaucccugcccucuucgaaccagagagagaaaagucugcggcaaucgauggggaguaccggcugaggggcgaggcccgcaaaaccuucguggaacuuaugagaaggggagaccugcccguguggcucuccuauaaggucgcuagcgagggcuuucaauacucagaucggcguuggugcuucgacggggaacgcaacaaucagguuuuggaggaaaacauggauguggagauuuggacaaaagagggagaacgaaagaaacugagaccuagguggcuagacgcccggacuuauagugacccgcuggcucuccgcgaguuuaaggaauucgcagccgguagaaggucuguauccggcgaucuuauacuggagaucgggaaguuaccacagcauuugacgcagcgggcucaaaaugcccuggacaaccucgugaugcugcacaauagcgaacagggaggccgagcauacagacaugcgauggaggagcuucccgauaccauugaaacacugaugcucuuggcccugaucgcugucuuaacugguggggugacccuauuuuuccugucaggccgcggacucggcaaaacaaguauugggcuucuguguguuauggccagcuccguguugcuguggauggcaucugucgagccucacuggaucgcugccagcauaauccucgaauuuuuccugaugguacuucucauucccgagccagacaggcagcggaccccucaggauaaccaacuggcauaugugguuaucggauugcuguuuaugauuuuaacuguggccgcuaaugagaugggucuacuggaaacgaccaagaaagaccucggcaucgggcacgucgcgguggagaaccaucaccaugccacaaugcuugaugucgaccugcaccccgcauccgcuuggacuuuguacgccguggccaccacaauaauuaccccaaugaugcgucauacuaucgaaaacacaacggcaaauauuucacugaccgcuaucgccaaccaggcggcuauacucaugggacuggauaagggcuggccuaucucuaaaauggacauugguguuccgcuuuuagcccuggggugcuacagucaggugaauccccucacuuugacagcagccguacugaugcuaguggcucacuaugcaaucauuggcccaggacugcaagccaaggcgaccagagaggcucagaagaggaccgccgcaggcaucaugaaaaacccuacagucgaugggauaguugccauugaccucgaucccguggucuacgacgcuaaguucgaaaaacagcuuggacagaucaugcuguugauccuguguacuucgcaaauucuccugaugcgcacgaccugggccuuaugcgagagcaucacacuugcaacuggcccacugaccacacucugggaggguuccccugggaaguuuuggaauaccacuauagcugugucuauggccaacauuuuccggggaucauaucuagcgggcgccggucuggcauuuagcuugaugaaaucccugggcgggggacgaagaggcacgggggcucagggagaaacacucggcgagaaguggaagaggcagcuuaaucagcugaguaaaucugaauucaacaucuacaagcgcagcgguauuauggagguagaccggucagaagccaaagagggguugaagagaggagagaccacucgucacgcaguguccaggggcaccgcuaaacugcggugguucguugaacgcaaucucgugaagcccgaggguaaggucaucgauuuaggcugugggcgaggaggcuggaguuauuacugcgccgggcugaaaaaggugacagaagucaaaggauauacuaagggcgguccggggcaugaggaaccaauaccuauggccaccuacggauggaaccuugugaaacugcacagcggcaaggacguuuuuuucacacccccagagaaaugugauacgcuacucugcgacaucggcgagucuucccccaauccuaccauugaagaggggagaacucugaggguauugaagaugguggaaccguggcugcggggaaaccaauuuuguaucaagauucucaaucccuacaugccaucagucguggagacacuugagcagaugcagcgcaaacaugguggcaugcugguuagaaacccuuuaagcaggaauucgacccacgaaauguauugggugucuugcgggacuggaaacaucgucagugcggugaauaugacaucccgaaugcuguugaaccgguucaccauggcucaccguaagcccacguacgagagagauguagaccucggcgcagguacccgccauguggccguugaaccugaggucgcuaaccuggauauuaucgggcagaggauagaaaauauuaaacacgagcauaagagcacauggcacuaugacgaggauaacccauacaaaacuugggccuaucauggaucauacgaagugaagcccuccggcucugcaagcaguauggugaauggcgucguuaagcuacuuaccaaaccuugggacgugaucccaaugguaacacaaaucgccaugacugauaccacacccuuugggcagcagcggguguucaaggagaaagucgacaccagaacuccgaaggcuaaacgcggaacggcgcaaauuauggaagugacagccagguggcugugggguuuucucucccgaaacaagaagccucggauauguaccagagaggaauucacuaggaaaguucgcagcaaugcagcuaucggcgccguguuugucgacgagaaccaguggaauucugcaaaggaggccguggaagaugagcguuucugggaccugguacagaaagaacgggaguugcacaagcaggggaaaugcgcuaccugcguuuauaacaugaugggaaagagagaaaagaaacugggcgaguuugguaaggccaaagggucaagggcgauuugguacauguggcucggagcacgcuuccuugaguuugaagcccugggcuucaugaaugaggaucacugguucagucgagaaaacuccuuaagcggcguggagggggagggacugcauaaguuggguuacauccuccgggacauuucuaaaaucccaggcgggaauauguaugcugaugacacagccggaugggauacgagaauaaccgaagacgaucugcaaaacgaggcaaagaucacugacauuauggaacccgagcacgcucuacuugccacaucgaucuuuaaacugaccuaccagaauaaggucgugagggugcagcgcccugcuaagaacggcacugucauggauguuauuucaagacgggaccagagggguagcgggcaagugggaacauauggccucaauaccuucacaaacauggaagcccagcugauccgucagauggaguccgagggcauauuuuugccaagugaauuagagacucccaaccuggcagaacgaguacucgauuggcuugagaaacaugggguggaacgccugaagagaauggcgauuucuggagacgacugugucgugaaaccgaucgaugaccgguucgccaccgcucuaacggcccugaaugauauggguaagguuaggaaagacaucccucagugggagcccagcaagggcuggaacgauuggcaacaggugccauuuugcucccaccacuuccaucagcucauuaugaaggacgggcgcgagauagucgugccuuguagaaaucaggaugaauugguaggacgggcaaggguuucacaaggcgcugguuggagucugcgagagaccgccugccuugggaaaucuuacgcacagauguggcagcugauguauuuucaccguagagaccuccgcuuagccgcgaacgcuaucuguagcgccgugcccgucgauugggugccaacaucccggacuaccuggucaauucaugcacaccaucaauggaugacaacugaagacaugcugagcguuuggaauaggguguggaucgaggaaaaccccuggauggaggauaagacccacgucucuuccuggggagacgugccuuacuugggcaaaagagaggaccaguggugcggcagucugauugggcucacggcccgcgcuacaugggccagcaauauccagguagcaauaaaccaggugcggaggcuuaucggaaaugaaaacuaucuggauuacaugaccucgaugaagcgauucaaaaaugagggugacccagaaggcgcucuaugguga

SEQ ID NO: 13879 - RNA, 9879 nt, Artificial Sequence
  derived and/or modified CDS sequence (opt3) from DENV-1__GU131688__SS-prME
uccgugacaaugcugcuaaugcuuaugcccacagcacuggcuuuccacuugacuacgcgaggcggggaaccucauaugaucgucuccaagcaggaaagggggaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccgauccugccgugcucaggaaacugugcauugaagcuaagaucucuaacacgaccacagacagccgguguccaacucaaggagaggccacccuugucgaagaacaagaugcaaauuuuguuugccgccgaacauucguggacagaggcugggguaacggguguggacuguuuggcaaaggcuccuugaugacuugcgcuaaguucaagugcguaaccaaacucgaggggaagauagugcaguacgaaaaucugaaauauucagucauugugacaguucacaccggagaccagcaucaaguggguaacgagaguacugaacacggcacgacagccaccaucacuccccaggcgccuagcaccgagauucaguuaacagauuacggggcccugacccucgacuguucuccaaggacuggacuugauuuuaaugaaaugguccuguugacaaugaaggagaaauccuggcuagugcauaagcagugguuccuggaccucccgcugcccuggacgucaggcgcaagcaccagucaagagacuuggaaccggaaagaucuucugguaacauuuaagaccgcucacgccaagaaacaggaaguuguggucuuggguucucaggagggggcuaugcacacagcccucacuggcgcaaccgaaauccaaacguccggaaccacaacuaucuucgccggccaucugaagugccguuuaaaaauggacaagcugacccuaaaagggaugagcuaugugauguguacaggaucguucaagcucgagaaggaagucgcugagacucagcacgguaccgugcugguucagauuaaauacgagggcacggaugcgccuugcaagauaccauuuucuacacaggacgaaaaaggggugacccaaaauggacgccuuaucacugcaaaccccauuguaacagauaaggagaaaccugucaauaucgaagccgagccacccuucggcgaguccuauauagugauuggugcuggggaaaaggccuugaagcugucaugguuuaaaaagggcaguagcaucggaaaaauguucgaggcaaccgccagaggcgcuaggcggauggccauccucggggacacugcaugggauuuuggauccauugguggcguuuucaccucuguggggaagcugguccaucagaucuuuggaacagcguacggcgugcuuuucagcgguguaucauggacgaugaaaauugggauaggcgugcuguugaccuggcucggacugaacagucgauccacuagcuuaucuaugacauguaucgcuguuggccuggucacccuauaccucggggugauggugcaggccgacucaggaugcgucauuaauuggaagggccgcgaacugaagugugguagugggaucuuuguuacaaacgaggugcacacuuggaccgaacaguauaaauuccaagcagacagcccgaagagacuuuccgccgcuaucggaaaagccugggaggagggcgugugcgguauuaggucugcaacgcgguuggaaaauauaauguggaagcagaucucgaacgagcugaaccauauucuccuggaaaaugauaugaaauuuacaguagucgugggcgacguugcugggaucuuagcccagggaaagaaaaugauucgcccucagcccauggaguacaaguauagcuggaaguccuggggcaaagcgaagaucauaggggccgaugugcaaaacaccacuuucaucauugacggaccaaauaccccugaaugucccgaugaccagagagcuuggaacaucugggaggucgaggauuacggcuuugguauuuucacaacuaauaucuggcugaaacuuagggacucauauacccaggugugcgaucaccguuugaugagugcagccauaaaggacucuaaagcuguucacgccgauaugggguacuggauugaaagcgagaagaacgaaacauggaagcucgcacgggcguccuucaucgaggugaaaacguguauuuggccaaagucacauacccuguggagcaauggaguacuagaaucugagaugaucauacccaaaaucuauggcgguccuauuucccagcacaacuaccgaccaggcuacuuuacucaaacagccgggccguggcaucugggaaagcucgagcuggacuucgaucuuugcgaaggcaccacugucgugguggacgagcacugcgggaauagaggacccaguuugaggacaaccacggucacuggcaaaaucauucacgaaugguguugccgcagcuguacccugccuccauuacgguuuaagggugaggacgggugcugguauggaauggagaucagacccguuaaggaaaaagaggaaaaccucgugaagucuaugguauccgcuggcucaggugagguggauaguuucagccugggccuucuguguauaucgauuaugaucgaagaggucaugaggucccgcuggucucgaaaaauguugaugacagggacccucgccguguuuuuccugcuaaucaugggacagcugacuuggaaugaccucauucggcugugcaucaugguuggcgcaaacgcuagcgaucguauggggaugggaacaaccuaccuugccuugauggcaacauuuaagaugagaccuauguucgccgugggccuguuauuuaggcgccucacuucacgggagguccugcuucugaccauuggucuaagucucguggcuuccguugaacugccaaauucuuuggaggaacugggggacggauuagcgaugggcauaaugauccucaaacugcuuacggauuuccagagccaucaacugugggccacauugcucucccugaccuuuauuaagacuaccuucucacuacacuaugcauggaagacaauggcuauggugcugagcaucgucagucuuuuuccccucugucugucuacuaccucccagaaaacgacaugguugccgguacuguuaggcagccucgggugcaagccucugaccauguuccuuauugccgagaacaaaaucuggggaagaaagucguggccacugaaugaagguauaauggccgugggcaucguuucaauuuugcucucugcucugcucaagaaugacgugccccuggcagggccucuuaucgccggaggcaugcucauugcguguuacgucaucagugguuccagcgcugaucugucuuuggagaaggccgcagaggugagcugggaagaggaagccgagcauuccggggcuucacacaacauauuaguagaagugcaggacgauggaacuaugaaaauuaaggacgaggagagggaugacacacugaccauccuccugaaggcaacucuucuggccgucaguggcguuuaucccuugagcaucccagcgacacuauucgugugguacuuuuggcagaaaaagaaacaacgaucuggcgugcugugggauaccccuucacccccagaagucgagcgcgcugugcucgacgacgggauuuaucggauaaugcagagaggacugcuugguaggagccagguuggcguagggguguuccaggaaaaugucuuucauacgauguggcacgugacucguggagccguuuuaauguaccaaggcaagcgccuggagccgaguugggcaagcgugaaaaaggaucucaucuccuacggugggggauggcgguugcagggcucuuggaacaccggcgaggaaguccaggugauugccguagagccugggaagaaucccaaaaacguccagacagcuccaggaaccuucaagacaucggaaggugaggugggcgccaucgcacuggacuuuaaacccgggacuagcggaucaccuauuguuaauagagaaggcaagaucgugggucucuaugggaacggagucgugaccacguccggcacauacguuagugcuauagcccaagcgaaagccucucaggagggcccacugcccgagaucgaagaugagguguucaggaagcgaaaucuuacuauuauggaccugcacccugggagcggaaagacccggcgcuauuugccggcaaucgucagagaagcuauuaaaaggaagcuacggacacugauccucgccccaacccgagugguagcuuccgagauggcagaagccuuaaaagguaugcccauaagauaccagacuaccgccgugaagucagagcauacaggcaaagagauuguugaucugaugugccacgcuacguuuacuaugcgccuucugucuccugucagggugccaaacuauaauaugaucaucauggacgaagcgcauuucaccgaucccagcaguauugcagcccguggguacaucuccacacgggugggaaugggcgaggcugccgcaauauuuaugaccgccacuccuccggguagcgucgaggcuuucccccaaucuaacgcgguaauucaggacgaggaaagagauaucccagagaggucauggaacuccggguaugaguggauuacagacuuuccuggaaagaccgugugguucguucccaguaucaagagcggcaacgauauagccaauugucuccgcaaaaacggcaagcgagugauucaguugucgagaaaaacguucgacacugaauaccagaagaccaaaaauaacgacugggauuacgucgugaccaccgacaucucugagaugggggcaaacuuucgggcugauaggguuaucgacccacgccguugccugaagccugugauucucaaggauggacccgaaagagucauccuggccgguccaaugccggugacuguagcauccgccgcucaacggaggggccgcauugggcgaaaucacaacaaagagggagaccaguauauauacaugggccagccucuuaauaacgaugaggaccaugcccacuggacagaagcgaagaugcuacuggauaauaucaacacccccgaggguauuaucccagcauuguucgaacccgagagagagaaaagcgccgcuaucgacggggaguaucgguuaaggggcgaggcccgcaagacauuuguggaacugaugagaaggggagaucucccuguuuggcugucauacaaagucgcuagugagggcuuccaguauucugaccggcguuggugcuuugauggggaacgcaauaaccaagugcuugaggaaaauauggacguggagauuuggacuaaggagggagaaaggaaaaagcugagaccaagauggcucgacgcacggacguacuccgaucccuuggcccugcgcgaguucaaggaauuugcugccgguagaaggagcgucucaggcgaccuaauacuggagaucgggaaacucccucagcaccuuacccagcgggcacagaacgcgcuggauaauuuaguuauguugcauaacagugaacaaggaggccgagccuauagacacgcuauggaggagcugccggacacaauugaaacucucaugcugcuugcccugaucgcagugcucaccggugggguaacauuguucuuucugagcggccgcggauuaggcaagaccuccauugggcuacugugugugauggcuucuagcguccuccuuuggauggccuccguggagccacauuggaucgcagccucaauaauccuggaguucuuuuugaugguucugcucauucccgagccugauaggcagcggacuccccaggacaaucagcuggcuuacguggucaucggacuucucuucaugauucugacgguagcggccaacgagauggguuugcuggaaaccaccaaaaaggauuuaggcaucgggcacguggcaguugagaaucaccaucacgcugccaugcuagacguggaucugcauccagccucugcauggacucucuacgcugucgccaccacaauaauuaccccuaugaugcgucacacuaucgaaaacacaacggcgaacauuagucuuaccgcuaucgccaaucaagcagccauacugaugggauuggacaaaggcuggcccaucucgaagauggauauuggugugccacugcucgcucuggggugcuauagccaggucaacccucuuacuuuaacagcagccgugcugaugcucguugcgcauuacgcuaucauuggcccgggauugcaggccaaggcaaccagagaggcccagaaaaggaccgcugccggcaucaugaagaaucccacaguggacgggauaguagcaauugaucuggacccaguggucuaugacgcuaaauuugaaaagcagcuaggacagaucaugcugcucauccuuuguacuucccagauucuguugaugcgcacgaccugggcccugugcgagucuaucacacucgcgacuggcccucugaccacauuaugggaggguucacccgggaaauucuggaacaccacuauagccguuagcauggcaaauauuuuccggggauccuaccuugcuggcgccggucuggcauuuagucucaugaagucucuaggcgggggacgaagaggcacgggggcucaaggagaaacacugggcgagaaguggaaaaggcaguugaaccagcugagcaagucagaguucaauaccuauaaacgcuccgguaucauggagguggaucggagugaagccaaggaggggcucaaaagaggagagacuaccaagcacgccgucagccguggcacagcgaaacuuaggugguuuguggaacggaaccugguaaaaccagaggguaaggugauugacuugggcugugggcgcggaggcuggucuuacuauugcgcugggcugaaaaagguuacugaagugaaaggauacaccaagggcgguccugggcacgaggaacccaucccgauggcaacauacggauggaaucucgucaaauuacauuccggcaaggauguguucuuuauaccaccugagaagugugacacgcugcuuugcgauaucggcgagucaagccccaacccaaccauugaagaggggcgaacucugagaguccuaaaaaugguggaacccuggcucaggggaaaucaguucuguaucaagauucugaacccuuauaugccgucgguuguagagacauuggagcaaaugcagcggaaacacgguggcaugcuggugcgcaauccccucucuagaaacaguacccaugaaauguacugggucuccugcgggacuggaaauaucgugagcgccguuaacaugacaucaaggaugcuucugaaucgauuuaccauggcucaccggaagccaacguaugagcgugacguggauuuaggcgccgguaccagacacgucgcaguggaaccugagguagccaaccuggacauuaucgggcagcgcauagaaaacauuaaacaugagcacaaguccacauggcauuacgaugaggacaaucccuauaagacuugggcuuaccacggaucuuaugaagugaaaccuagcggcagugcguccagcaugguuaacggcgucgugaaguugcucaccaaaccaugggaugugauccccauggucacacagaucgccaugacugacaccacaccuuucgggcaacagaggguuuuuaaggagaaaguggacacccggacuccaaaggcaaagagaggaacggcucagauuauggaaguaacagccaaauggcugugggguuuccuaucucgcaauaagaaacccaggauauguacccgagaggaauuuacucggaaggugagaucaaacgcagccaucggcgcugucuucguggaugagaaucaauggaacagugccaaagaggcgguugaagacgagagguuuugggaucuugugcaucgcgaacgugagcugcacaagcaggggaagugcgcaaccugcgucuacaauaugaugggaaaacgggaaaagaaacucggcgaguucgguaaggccaaaggguccagagcuauuugguacauguggcugggagccagguucuuggaguuugaagcacugggcuucaugaacgaggaccacugguuuagccgcgaaaauucucucucgggcguggagggggagggacuucauaagcuggguuauaucuuacgagauauuucaaaaaucccgggcgggaacauguacgcugacgauacagccggaugggacacgcggauaaccgaagaugaccugcagaaugaggcuaagaucacugauauuauggaaccugagcacgccuugcucgcaaagagcaucuucaaacugacauaucagaacaagguaguuagagugcaaaggccagcgaaaaauggcaccgucauggacgugauuucccgcagagaucagcgggguaguggacaggugggaacuuacggccuaaacacauuuaccaauauggaagcccagcuuaucaggcaaauggagucugagggcauauucagccccuccgaacuggagacaccuaaccucgcugggcguguccuggacugguuggaaaagcauggaguugagcgauuaaaacgcauggccauuucaggugacgauugugugguaaagccaaucgacgauagauuugcagcugcccugacugcacucaacgacaugggcaaggugcggaaagauaucccccagugggaaccgaguaagggguggaaugacuggcagcaggucccuuucugcucucaccacuuucaucaacuuauuaugaaagauggaagggagauagugguucccugucgcaaccaggacgagcuggugggcagagcccgggucagccagggugcgggguggucccuaagggaaaccgcuugccugggaaagucauaugcccagauguggcaacucauguacuuccaccgacgugauuugagacuggcagccaaugcuaucuguagcgccgugccaguagacuggguuccuacgucucgcaccacaugguccauucaugcacaccaucaguggaugacuaccgaggauaugcuuaguguguggaaccgggucuggaucgaagagaaucccuggauggaagacaaaacacacauuagcucguggggcgacgugccauaucugggcaagagggaggaucaguggugcgggucccucaucggauuaacugcuagagccaccugggcgacgaacauacaaguugcuaucaaucaggugcgccggcugauugguaacgagaauuacuuggacuacaugacaucuaugaagagguuuaaaaacgaaucagaucccgagggcgcccugugguga

SEQ ID NO: 13880 - RNA, 9879 nt, Artificial Sequence
  derived and/or modified CDS sequence (opt3) from DENV-1__GU131689__SS-prME
agcgugaccauguuccugaugcucaugcccacagcccuugcuuuucaccugacuacgagaggcggggagccucauaugaucgucuccaagcaggaaaggggaaaaucuuuguuauucaagaccucagcagguguuaacaugugcacacugauugccauggaccuaggcgaguuuugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccucgcaccccaugucggccugggucuugagacuagaaccgaaacauggauguccucugagggggccuggaaacagauccagaggguggaaacuugggcucugcggcacccuggauucaccguuauugcauuguuucucgcccaugcuaucggcacaucgauuacccagaagggcaucauauucauccugcugaugcucgugacgccaucaauggccaugcgcugcgucgggauuggaagcagagauuuuguggaggguuuaaguggcgcgacuuggguagacguugugcuggagcacggguccugugucacaaccauggcaaaggauaaacccacucuugacaucgaauugcugaagacagaggugaccaacccugccgugcuaaggaaacucugcauugaagcuaagaucucuaauacgaccacagauagccgguguccaacucaaggagaggccacccuggucgaagagcaggacgcaaacuucguuugccgccgaacauuuguggauagaggcugggguaauggguguggacuuuucggcaaaggcucccugauaacuugcgcuaaguuuaagugcguaaccaaauuggaggggaagauugugcaguacgaaaaccucaaauauucagucaucgugacaguucacaccggagaccagcaucaaguggguaaugagaguacugaacacggcacgacagccaccauuacuccccaggcgccuagcaccgagauccagcugacagacuacggggccuuaacccuggauuguucuccaaggacuggacucgacuucaacgaaaugguccuucugacaaugaaggagaaauccugguuggugcauaagcagugguuucuagaucugccgcuccccuggacgucaggcgcaagcaccagucaagagacuuggaaucggcaggaccugcuuguaacauucaaaaccgcucacgccaagaagcaggaaguugugguccuggguucucaagagggggcuaugcacacagccuugacuggcgcaaccgaaauccagacguccggaaccacaacuauuuucgccggccaucucaaaugccgucugaagauggauaaauuaacccugaaggggaugagcuaugugauguguacaggaucguuuaaacuagagaaggaagucgcugagacucagcacgguaccgugcucguucagauaaaguacgagggcacggacgcgccuugcaaaaucccauucucuacacaagaugaaaagggggugacccagaacggacgccugauuacugcaaaucccaucguaacagacaaagagaagccugucaacauagaagccgagccacccuuuggcgaguccuauauugugaucggugcuggggaaaaagcccuuaaguugucaugguucaagaaaggcaguagcaucggaaagauguuugaggcaaccgccagaggcgcuaggcggauggccauucugggggauacugcaugggacuucggauccaucgguggcguuuuuaccucuguggggaaacucguccaucagauuuucggaacagcguacggcgugcuguuuagcgguguaucauggacgaugaagauagggaucggcgugcuucugaccugguugggacucaauagucgauccacuagccugucuaugacauguauugcuguuggcuuagucacccuguaccuaggggugauggugcaggccgauucaggaugcgucaucaacuggaaaggccgcgaacucaagugugguagugggaucuucguuacaaaugaggugcacacuuggaccgaacaauauaaguuucaggcagacagcccgaaaagacuguccgccgcuauuggaaaggccugggaggagggcgugugcgguauaaggucugcaacgcggcuugaaaacaucauguggaaacagauuucgaacgaguugaaucauauccugcucgaaaacgacaugaagcugacaguagucgugggcgauguugcugggauuuuagcccagggaaaaaagaugauccgcccucaacccauggaguacaaauauagcuggaaguccuggggcaaggcgaaaauaaucggggccgacgugcagaauaccacuuucauuaucgauggaccaaacaccccugaaugucccgacgaucagagagcuuggaauauuugggaggucgaggacuacggcuuugguaucuucacaacuaacauauggcugaagcuuagggauucauauacccaggugugcgaccaccguuugaugagugcagccauuaaagauucuaaggcuguucacgccgacaugggguacuggaucgaaagcgagaaaaaugaaacauggaagcucgcacgggcguccuucauugaggugaagacguguguauggccaaaaucacauacccuguggagcaacggaguccuagaaucugagaugaucauacccaagaucuauggcgguccuauuucccaacacaauuaccgaccaggcuacuuuacucagacagccgggccguggcaucugggaaaacucgagcuggauuucgaccuuugcgaaggcaccacugugguggucgaugagcacugcgggaacagaggacccaguuugaggacaaccacgguuacuggcaagaucauucacgaaugguguugccgcagcuguacccugccuccauuacgguuuaaaggugaggacgggugcugguauggaauggagaucagacccgugaaggaaaaggaggaaaaucucguaaaaucuaugguguccgcuggcucaggugaggucgacaguuucagccugggccuucuguguauaucgauuaugaucgaagaggugaugaggucccgcuggucucgaaagauguugaugacagggacccucgccguuuuuuuccugcuaaucaugggacagcugacuuggaacgaucucauucggcugugcaucauggugggcgcaaaugcuagcgaccguauggggaugggaacaaccuaccuugccuugauggcaacauuuaaaaugagaccuauguucgccgucggccuguuauuuaggcgccucacuucacgggaggugcugcuucugaccauuggucuaagucucguugcuuccguggaacugccaaacucuuuggaggaacugggggauggauuagcgaugggcauaaugauccucaagcugcuuacggacuuccaaagccaucagcugugggccacauugcucucccugaccuuuauuagaacuaccuucucacuacacuaugcauggaaaacaauggcuaugguccugagcaucguaagucuuuuuccccucugucugucuacuaccucccagaagacgacaugguugccggugcuguuaggcagccucgggugcaagccucugaccauguuccuuauugccgagaauaaaaucuggggaaggaagucguggccacugaacgaagguauaauggccguuggcaucgugucaauuuugcucucuagucugcuaaaaaacgaugucccccuggcugggccucuuaucgcaggaggcaugcucauugccuguuacgugaucuccgguagcucugcggaccugagcuuggagaaggcugccgagguauccugggaagaggaagcagagcauucaggggccagucacaauauauuaguggaaguccaggaugacggaacuaugaaaauuaaggaugaggagcgagacgauacacugaccauccuccugaaagcuacucuucuggcaguuagcggcguguaucccuugucuaucccagccacacuauucgugugguacuuuuggcaaaagaagaaacagcgcuccggcguccugugggacaccccuucacccccagaaguggagcgggcgguucucgaugacgggauuuauagaauaaugcagaggggacugcuuggucguagucagguaggcgugggggucuuccaagaaaacguguuucauacgauguggcacguuacucgcggagcuguguuaauguaccagggcaagcggcuggagccgagcugggccuccgucaaaaaggaccucaucucuuacggugggggauggagauugcagggcucguggaauaccggcgaggaagugcagguaauugcagucgagccugggaaaaaccccaagaaugugcaaacagccccaggaaccuucaagacaagcgaaggugagguuggcgcuaucgcccuggauuuuaaacccgggacuucaggauccccuauugugaacagggaaggcaagaucgucggucucuaugggaauggagugguuaccacgaguggcacauacgugucugcaauagcucaggccaaagcgagccaggagggcccacugcccgagaucgaagacgaggucuuccgaaagcggaaccuuacuauuauggaucugcacccuggguccggaaaaacccgcagauauuugccggccaucgugagggaagcaaugaagcggcgacuaagaacacugauucucgcuccaacccgcguaguggccucagagauggcugaagcauuaaaggguaugcccaucagguaccaaacuaccgccguuaaaucugagcauacaggcaaggagauagucgaccugaugugccacgccacguuuacuaugcgucuucugagcccugugcgggugccaaauuauaacaugauuaucauggaugaagcucauuucaccgaccccaguuccaucgcggcaagaggguacauuagcacaagggucggaaugggcgaggccgcugccaucuuuaugaccgcaacuccuccggguucuguagaagccuucccccagucaaaugcugugauacaggaugaggaacgcgacauuccagagcgauccuggaacaguggguaugaguggaucacagauuuuccuggaaaaaccguuugguucgugcccagcauuaagucgggcaaugacaucgcgaacugucucagaaaaaauggcaagcgggucauacaguugucuaggaagacguucgauacugaauaccaaaaaacaaagaacaacgacugggacuacgugguuaccaccgauauuuccgagaugggggccaauuuucgcgcagaccgugugaucgauccaagacggugccugaaaccugucauccucaaggacggacccgaaagggugauucuggcugguccaaugccgguaacuguggccagcgcagcccagcgccgaggcagaaucgggcggaaccacaauaaagagggagaucaguauauuuacaugggccagccucuuaacaaugacgaggaucaugcucacuggacagaagccaagaugcuacuggacaacauaaauacccccgaggguaucauuccagcguuguucgaacccgagagggaaaagucagcagccaucgauggggaguaucgcuuaagaggcgaggcuaggaaaacauuuguugaacugaugcggcguggagaccucccugucuggcugaguuacaagguggccucugagggcuuccaauauuccgaucgccgauggugcuuugacggggaaagaaacaaucaggugcuugaggaaaacauggaugucgagaucuggacuaaagagggagaaaggaagaaacugcggccacgcuggcucgacgcuagaacguacagcgaccccuuggcacugagggaguucaaggaauuugccgcuggucggcgaucaguuaguggcgaucuaauucuggagauagggaaacucccucagcaccuuacccagagagcccaaaaugcacuggacaacuuagugauguugcauaauagcgaacagggaggccgcgcguauaggcacgccauggaggagcugccggauacaaucgaaacucucaugcugcuugcucugauugccguacucaccgguggggugacauuguucuuucuguccggccggggauuaggcaagaccucuaucgggcuacugugugucauggcaagcuccgugcuccuuuggauggcuucaguugagccacauuggauugccgcaucuaucauacuggaauucuuuuugauggugcugcucauccccgagccugaccgucagagaacuccccaggauaaccaacuggccuacgucguaauuggacuucucuucaugauccugacgguggcugcgaaugagauggguuugcuggaaaccacaaagaaagacuuaggcauugggcacguugccguggagaaccaccaucacgcagcuaugcuagaugucgaccugcauccagccagugccuggacucucuacgcaguggcuaccacaaucauaaccccuaugaugaggcacacuauugaaaacacaacggccaauaucucgcuuaccgcgauugcuaaccaggccgcaauccugaugggauuggauaagggcuggcccauaagcaaaauggacaucggugucccacugcucgcccuggggugcuauucccaggugaauccucuuacuuuaacagcugcaguucugaugcucguggcccauuacgcgauuaucggcccgggauugcaagcuaaggccacccgcgaggcacagaaacggaccgccgcuggcauuaugaagaaccccacaguagaugggaucguggccauagaccuggauccagucguuuaugacgcaaaguuugaaaaacagcuaggacagauuaugcugcucauccuuuguacuucucaaauccuguugaugcgaacgaccugggcucugugcgagucaauuacacucgccacuggcccucugaccacauuaugggaggguagccccgggaaguucuggaauaccacuaucgcgguguccauggccaacauauucagaggaaguuaccuugcaggcgcuggucuggccuuuucucucaugaaaagccuaggcgggggaaggcgcggcacgggggcacagggagaaacacugggcgagaaguggaaacggcaguugaaucagcugucaaaguccgaauucaacaccuauaagagaagugguauuauggaggucgaccguagcgaagcuaaagaggggcucaagaggggagagacuaccaaacacgccgugucucggggcacagccaagcuucgcugguuuguagaacgaaaucuggugaaaccagaggguaagguuaucgauuugggcugugggagaggaggcugguccuacuauugcgcggggcugaagaaagugacugaagucaagggauacaccaaaggcgguccugggcacgaggaacccauuccgauggcuacauacggauggaaccucgugaaguuacauucaggcaaagacgucuucuuuaucccaccugagaagugugauacgcugcuuugcgacauaggcgagagcucgcccaauccaaccaucgaagaggggaggacucugcgggugcuaaaaaugguugaacccuggcuccgcggaaaccaauucuguauuaagauccugaauccuuauaugccgucuguaguggagacauuggagcagaugcagagaaagcacgguggcaugcuggucaggaacccccucagucgaaauuccacccaugaaauguacugggugagcugcgggacuggaaacauuguuucagcagugaauaugacaucccggaugcuucugaaccguuuuaccauggcccacagaaaaccaacguaugagcgcgaugucgacuuaggcgcugguaccaggcacguggccguagaaccugaggaagcaaaccuggauaucauugggcagcggaucgagaauauaaagcaugagcacaaaucuacauggcauuacgacgaagauaaccccuauaagacuugggccuaccacggaagcuaugaggugaaaccuaguggcuccgcuagcucuaugguuaauggcgucgugaaguugcucaccaagccaugggacgugauucccauggucacacaaaucgcgaugacugauaccacaccuuucgggcagcagagaguuuuuaaagaaaagguggacacccgcacuccaaaagccaagaggggaacggcacaaaucauggagguaacagcuaaauggcugugggguuuccuaucacgaaacaagaagccccggauuuguaccagagaagaguuuacuaggaaagugcgcaguaaugccgcaauaggcgccgucuucguggacgagaaccaguggaauuccgcuaaggaagccguugaggaugaacguuuuugggaccuugugcaucgggagagagaacugcacaaacaggggaagugcgcgaccugcgucuacaacaugaugggaaaaagggagaagaagcucggcgaguucgguaaagcaaaggggagccgcgccaucugguacauguggcugggagcucgauucuuggaauuugaggcccugggcuucaugaaugaagaucacugguuuucucgggagaacucgcucucaggcguggagggggaaggacuucauaaacuggguuauauuuuaagagacaucagcaagauuccgggcgggaauauguacgcagaugacacagcuggaugggauacgaggaucaccgaggacgaucugcagaacgaagccaaaauaacugacaucauggagccugaacacgcuuugcucgccaaguccauuuucaaacugacauaucaaaauaagguaguucgcgugcagagaccagcaaagaacggcaccgucauggaugugaucagucggagggaccagcgugguucugggcaggugggaacuuacggccuaaauacauuuaccaacauggaggcgcaacuuauucgacagauggagagcgaaggcaucuucucccccucagagcuggaaacaccuaaccucgccgggcgcguccuggauugguuggagaaacauggaguugaaagauuaaagcggauggcuauaaguggugacgacugugugguaaaaccaauugaugacagguuugccacugcacugaccgcucucaaugauaugggcaaggugcgcaaagacaucccccagugggagccgucuaagggguggaacgauuggcagcaagucccuuucugcagccaccacuuucaucagcuuaucaugaaggacggaagagagauugugguucccugucggaaucaggaugaacuggugggcagggcccgagucucccagggugcaggguggucacuacgugagacggccugccugggaaaaagcuaugcgcaaauguggcagcucauguacuuccacagacgcgacuugcggcuggcugccaacgcaauauguucugccgugccaguagauuggguuccuaccuccaggacaacuuggaguauccaugcucaccaucaguggaugaccacagaagacaugcuuagcguguggaauagagucuggauugaggaaaaccccuggauggaggauaagacucacgugucguccuggggcgacguuccauaucugggcaaacgcgaggaccaauggugcgggucucucaucggauuaaccgcccgggcaacgugggcuacaaauauucagguggccaucaaccaggucaggcgacuguuggguaaugaaaacuaccuggauuacaugaccucaaugaagagauuuaaaaaugagagcgaccccgaaggcgcgcucugguga

SEQ ID NO: 13881 - RNA, 9879 nt, Artificial Sequence
  derived and/or modified CDS sequence (opt3) from DENV-1__GU131690__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacgcugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgugacccggcucgaaaacaucauguggaaacagauuucuaacgagcugaaucauaucuuacuggaaaacgacaugaaguucacuguagucgugggcgauguugccgggauucuugcacagggcaagaagaugauccgcccucaacccauggagcacaaauacucguggaaaagcuggggcaaggcuaagauaaucggggccgacgugcagaauaccacauuuauuaucgauggaccaaacacuccugaaugucccgacgaucagagagcguggaauauuugggaggucgaggacuauggcuucgguaucuuuaccacaaacauaugguugaagcucagggauuccuacacacaggugugcgaccaccgucugaugucagccgcuauuaaagauaguaaggcaguucaugccgacaugggguauuggaucgaaucugagaaaaaugaaaccuggaagcuagcucgggccagcuucauugaggugaagacuuguaucuggccaaaaucccacacacuguggucaaacggaguacucgaaagcgagaugauaauccccaagauuuacggcgguccuaucucucaacauaauuaucgaccaggcuacuucacccagacugcagggccguggcaccugggaaaacuugaguuggauuuugaccugugcgaaggcacaaccgucgugguggaugagcacugcgggaacagaggacccuccuuaaggacgacuaccgucacaggcaagauuauccaugaaugguguugccgcaguuguacccucccuccacugcgguucagaggugaggacgggugcugguacggaauggagauaaggcccguuaaagaaaaggaggaaaaucuugugaaguccaugguaucugcgggcuccggugagguggacucauuuagucugggcuugcucuguauuagcaucaugaucgaagaggucaugcgcucgcgauggucccggaaaaugcugaugacugggacacuagccguguucuuucugcucauuguuggacagcugaccuggaacgaucuuauccguuugugcauuauggugggcgcuaaugccucugacagaauggggaugggaacaacuuaucuggcauuaauggcuaccuucaagaugaggccuauguuugccgucggccuccuguuccgccggcuuacgagcagagaggugcugcuacucacaauaggucugucauugguugcaaguguggaacugccaaacuccuuagaggaacucggggauggacuggccaugggcaucaugauucuuaaacuguugaccgacuuucaaucucaccagcucugggcuacucugcuaagccugaccuucaucaagacaacuuuuucccuucauuacgcguggaaaaccauggccaugguccucucaguagugagccuguuccccuugugucugaguacgacaucucagaagaccacuugguuaccgguucuccugggcucccuugggugcaagccucugacaauguuuuugauugcagagaauaaaaucuggggaaggcgaagcuggccacucaacgaagguauaauggcugugggcaucgucucgauucugcuaucaucucugcuuaagaacgaugugccccucgccgggccucugaucgccggaggcauguugauugcuuguuauguaaucagugguuccagcgcagacuuaucucuggagaaagccgcggaggugagcugggaagaggaagcugagcacuccggggccucacauaauauacucgucgaaguucaggaugacggaaccaugaagauuaaagaugaggagcgcgacgauacucugacaauccuucugaaggcaaccuugcuagccgugaguggcguguacccccugagcaucccagcuacacucuucgucugguauuucuggcagaagaagaagcagcggucuggcgugcugugggacacuccuucacccccagaaguugagagagcaguacuugaugacgggauuuacaggauaaugcagcguggauuacugggucgcagccaggugggcgucgggguguuucaagaaaacguuuuccacaccauguggcacgugacacggggagccguccucauguaucagggcaaaagauuggagccgaguugggcgagcgugaagaaagaccugaucuccuacggugggggauggaggcuccagggcucuuggaauaccggcgaggaaguacaggucauugcuguggagccugggaagaaccccaaaaauguucaaacagccccaggaacuuuuaagacccccgaaggugaggugggcgcaaucgcccuggauuucaagccugggacgucgggaagcccaauugucaaccgagaaggcaaaaucgugggucuuuacgggaauggaguugugacaacuucaggcaccuaugucuccgcuauagcccaggcaaaggcuagucaggagggcccccugccugagaucgaagacgagguguuucggaaacgcaacuugacaauuauggaucuacauccggggucuggaaagaccagaagguaccugccagccaucguacgggaagcgauuaaacgaaagcucagaacuuuaauccuggcccccacccgcgugguugcaagcgagauggcugaagcccuuaaggguaugccuauaagguaucaaacaacggcugucaaauccgagcacacuggcaaggagauuguggaccugaugugccaugcaaccuucacaaugcgucucuugucaccagugcggguccccaauuacaacaugaucaucauggaugaagcccacuuuaccgacccuucuagcauugccgcuagaggguauaucaguacuaggguaggaaugggcgaggcggcagccauauucaugacagcuaccccgcccgguuccguggaagccuuuccacagagcaaugcaguuauucaggaugaggaacgcgacaucccugagcgaucuuggaacucaggguacgaguggauuacggauuuccccggaaaaacugugugguuugucccauccaucaagaguggcaaugacauagccaacugucugaggaaaaauggcaagcgggugauucagcucagcaggaagacauucgauaccgaauaucagaaaaccaagaacaacgacugggacuacguugugacuacagauaucucggagaugggggcuaauuuccgcgcggaccgugucaucgauccuagacggugccugaaacccgugauucuuaaggacggaccagaaaggguaauccuagccgguccgaugccugugaccguugcaucugcugcccagcgccgaggcagaauugggcggaaccauaauaaagagggagaucaguacauauauaugggccagccccugaacaaugacgaggaucacgcacacuggacagaagccaagauguuguuagacaacaucaauacuccagaggguauuauccccgcucuguuugaaccugagagggaaaaguccgccgcgaucgauggggaguaccgccucagaggcgaggcaaggaaaacguucgucgaacugaugcggcguggagaccuuccaguguggcugagcuauaagguggccucagagggcuuucaauacagugaucgccgauggugcuucgacggggaaagaaacaaucagguccucgaggaaaacauggauguugagauuuggaccaaagagggagaaaggaagaaauugcggccccgcuggcuggacgcuagaacauauucugacccucuagcccugagggaguuuaaggaguucgcugcaggucggcgauccgugagcggcgaucucauacuugagaucgggaaacugccgcagcauuuaacucagagagcccaaaaugcuuuggacaaccugguaaugcuccacaauucagaacagggaggccgcgccuacaggcaugcaauggaggagcugccagauaccauugaaacacuuaugcugcucgcguugaucgccgugcugaccgguggggucacuuuauuuuuccuaaguggccggggacugggcaagacgagcauugggcuccuuugugugauggcuuccucuguucuguuguggauggccagcguggagccccacuggaucgcagcuuccauaauccuggaauuuuuccucaugguccugcuuauuccugagcccgaccgucagagaaccccacaggauaaccaacucgccuauguagugaucggacuguuguuuaugauucugacaguugcagccaaugagauggguuuacuagaaacuaccaagaaagaccugggcaucgggcacguggcugucgagaaccaucaccaugcggccaugcucgauguggaccuucacccugcaucagcuuggacacuguacgccgucgccaccacuauaauuacacccaugaugaggcauacgaucgaaaacaccacugcaaauauuucuuugacagcuaucgccaaccaggcggcuauacugaugggacucgauaagggcuggccaaucaguaaaauggacauuggugugccucugcuugccuuagggugcuacucgcagguuaauccgcugacccucaccgcagccguguugaugcugguagcucacuaugcaaucauuggccccggacuacaagccaaggcgacacgcgaggcucagaaacggacugccgcaggcaucaugaagaacccaacgguggaugggauagucgccauugaccuggauccuguuguguacgacgcuaaguucgaaaaacagcucggacagaucaugcuucugaucuuguguaccagccaaauucugcucaugcgaacaacuugggcccugugcgaguccaucaccuuagcaacaggcccccuuaccacucugugggaggguucuccagggaaguuuuggaauacgacaauagcugucucaauggccaacauuuucagaggaagcuaucucgcgggcgccggucuagcauucucccugaugaaaaguuugggcgggggaaggcgcggcaccggggcucagggagaaacucugggcgagaaguggaaacggcagcucaaucagcuuucuaagagcgaauuuaacaccuacaagagaucagguaucauggagguggaccguuccgaagccaaagaggggcugaagaggggagagacaacuaaacacgcaguaagucggggcaccgcuaaguugcgcugguucguggaacgaaaucugguuaaaccugaggguaaggugauugaucucggcugugggagaggaggcuggagcuauuacugcgccggguuaaagaaagucacagaagugaagggauauacgaaaggcggucccgggcaugaggaaccgaucccaauggccaccuacggauggaaccuggucaaacuucacucuggcaaagacguguuuuucauaccucccgagaagugugauacucugcuaugcgacaucggcgaguccucaccaaaucccacaauugaagaggggaggacccuccggguucugaaaaugguagaaccuugguugcgcggaaaccaauuuuguaucaagauucugaauccguacaugcccagcguggucgagacucucgagcagaugcagagaaagcaugguggcaugcuugugaggaacccacugucgcgaaauucuacacacgaaauguauuggguuaguugcgggaccggaaacaucguguccgcggucaauaugacgagccggauguuacugaaccguuucaccauggcucacagaaaaccuacauacgagcgcgauguggacuugggcgcagguacuaggcauguagccguggaacccgagguugcuaaccucgauauuaucgggcagcggauagaaaauauuaagcacgagcauaaaucaaccuggcacuaugacgaggauaacccuuacaagacaugggccuaucauggauccuacgaagucaaaccaucuggcagcgcaaguuccauggugaauggcguggucaagcugcuaacuaagcccugggacguuaucccuauggugacccaaaucgccaugacagauaccacuccauuugggcagcagagaguauucaaagagaagguggacacgcgcacacccaaagcuaagaggggaaccgcgcaaauuauggaagucacugccaaauggcuuugggguuuucugagccgaaacaagaagccgcggauauguaccagagaggaguucacaaggaaagugcgcucuaaugcagcuaucggcgccguuuuuguggacgagaaccaguggaacucagcaaaggaggccgucgaagaugagcguuucugggaccucgugcaccgggaaagagagcugcacaaacaggggaagugcgcuacgugcguauauaacaugaugggaaaaagggaaaagaaguugggcgaguuugguaaagccaaggggagucgcgcgauuugguacauguggcugggagcacgauuccucgaguucgaagcccuuggcuuuaugaaugaggaucauugguucucccgggaaaacagccugucuggcguugagggggagggauuacacaaacuggguuacaucuugagagacauuucgaagaucccuggcgggaauauguaugcugaugacaccgccggaugggauacuaggauaacagaagacgaucuccagaacgaggcacgcaucaccgacauuauggaaccagagcaugcucugcuagccaaaucaaucuuuaaacuuacuuaccaaaauaaaguggucagagugcagcggcccgcuaagaacggcacagugauggaugucauuagcaggcgugaccagcgagguuccgggcagguuggaaccuauggccugaauacauucacuaacauggaagcccaacucauccgccagauggagagugagggcauauuuucuccuagcgaacuggagaccccaaacuuggcagaaagaguguuagauuggcuggagaaguacgggguagaacggcucaaaaggauggcgauuuccggagacgacuguguggucaagcccaucgaugaccgcuucgccacggcucuuaccgcccugaaugauauggguaaagugagaaaggacaucccgcagugggagccuucaaaaggcuggaacgauuggcagcaaguucccuuuugcagucaccacuuccaucagcuaauuaugaaggacgggcgggagauaguggucccauguaggaaucaggaugaacuggugggacgagcacguguaucucagggcgcugguuggagccucagagagacagccugcuuggggaaguccuaugcacaaauguggcagcugauguacuuucaccgccgggaccuuaggcuggccgcgaacgcuaucuguucagccguuccuguggauuggauucccacuagcagaaccacauggucuauccaugcacaccaucaguggaugacuaccgaagacaugcucuccgucuggaaucgcguguggauugaggaaaacccauggauggaggauaaaacgcacaucaguagcuggggagacguucccuauuuaggcaagcgggaggaccaauggugcggcucgcugauaggguugacagccagggcuaccugggccacuaauauccagguggcaauuaaccagguccgaagacugaucggaaaugaaaacuaccucgauuacaugacauccaugaaacgguucaagaaugagucugacccugaaggugcucuuugguga

SEQ ID NO: 13882 - RNA, 9879 nt, Artificial Sequence
  derived and/or modified CDS sequence (opt3) from DENV-1__GU131695__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggagaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacggcaugaaguucacuguagucgugggggacguugcaggcauucuggcucagggcaaaaagaugauccgcccucaacccauggaguacaaauauucguggaaaagcugggggaaggccaagauaaucggagcggaugugcagaauaccacauuuauuaucgacggcccaaacacuccugaaugucccgaugaccagagagccuggaauauuugggaggucgaggauuacgguuucgggaucuuuaccacaaacauauggcuuaaguugagggacuccuauacacaggugugcgaucaccgucucaugucagcugcaauuaaagacaguaaggccguucacgcugauaugggauacuggaucgaaucugagaaaaaugaaaccuggaagcuggcccgggccagcuucauugaggugaagacuuguaucuggccaaaaucccauacacuauggucaaacggcguacuggaaagcgagaugauaauccccaagauuuaugguggcccuaucucucaacacaauuaccgaccaggguacuucacccagacugcgggaccguggcaucucggcaaacuggagcuugacuuugauuugugcgaagggacaaccgucgugguggacgagcacugcggaaacagaggccccucccugaggacgacuaccgucacagguaagauuauccacgaaugguguugccgcaccuguacuuuaccuccacuccgguucagaggggaggauggaugcugguauggcauggagauaaggcccguuaaagaaaaggaggaaaaucuggugaagaguaugguaagcgccgguucuggcgagguggacuccuuuucacuugggcuguuguguauuaguaucaugaucgaagaggucaugcgcagccgauggucgcggaaaaugcucaugacaggaacccuggcuguguucuuucuacugauuaugggccagcucacauggaacgaccugauccgucuuugcauuaugguuggggccaaugcauccgauagaaugggaaugggcacuaccuacuuggcucugauggccacguucaagaugaggccuauguuugcaguggguuuacucuuccgccggcugacaucuagagagguccuucugcuaaccauagggcucagccugguggccucaguugaauugccaaacagucuggaggaauuaggagacggccucgcuaugggcaucaugauucugaaacuucugacugauuuucaaucccaucaguugugggcgacccuccugucucuaacauucaucaagacuaccuuuagccugcacuaugccuggaaaacgauggcaauggugcuuuccauugucucacucuucccccuguguuugagcacaaccagucagaagacuacauggcugccgguauuacucgggucucugggaugcaagccucuuaccauguuucugaucgcugagaauaaaauaugggguaggcgauccuggccauugaacgaaggcaucauggccguggggauuguuagcauccuccugucgucacuacugaagaacgacgugccccuugccggaccucucauugcuggcgguaugcugaucgcauguuacgucauaucugggaguuccgccgauuugagcuuagagaaagcggcugaggugucuugggaagaggaagccgagcauagcggagcaucccacaauauucugguagaagugcaggacgauggcacuaugaagaucaaagacgaggagcgcgaugacacacucaccauccugcuuaaggccacgcuguuggcugucucaggcguuuauccccuaaguauuccagcaacucuguucgugugguacuucuggcagaaaaagaagcagcggagcggggugcucugggauaccccuucucccccagaagucgagagagccgugcuggacgauggaauauauaggaucaugcagcguggucuuuuaggccgcucccagguugggguaggaguguuucaagaaaacgucuuccauacaauguggcacgugacccggggcgcgguucugauguaccaggguaaaagacucgagccgucaugggcuagugugaagaaagacuugauuagcuacgggggaggcuggaggcugcagggcuccuggaauacaggggaggaaguccaggugaucgccguagagccuggaaagaaccccaaaaauguccaaacugcaccagguaccuuuaagacgcccgaaggcgaggugggggccauugcucucgacuucaagccuggaacaucuggcucgccaaucguuaaccgagaagguaaaauaguggggcuguauggaaauggcgucgugacuaccagcggcacauacguuucagccaucgcacaggcuaaggccucccaggaggggccccuuccugagauugaagaugagguguuucggaaacgcaaccugaccaucauggacuugcacccgggaagugguaagacuagaagguaucuaccagcgauuguccgggaagccaucaaacgaaagcugagaacccucauauuagcacccacacgcgugguagcuucugagauggccgaagcucugaagggcaugccuauuagguaccaaacgacugcagugaaaagcgagcauaccgggaaggagaucguugaucuuaugugccacgccacauucaccaugcgucugcucuccccaguccgggugcccaauuauaacaugaucauuauggacgaagcccauuuuacugauccuucaucuaucgcugcgagaggauacauaagcacaagggugggcaugggugaggcagccgcuauuuucaugaccgccacgccgcccgggagugucgaagcauuuccacaguccaaugccguaauccaggacgaggaacgcgauauuccugagcgaagcuggaacucuggauaugaguggaucacugacuuccccggcaaaacagugugguuuguuccaucaauaaaguccggcaaugauauugcuaacuguuugaggaaaaaugggaagcgggugauccagcugaguaggaagaccuucgacaccgaauaccagaaaacuaagaacaacgauugggacuacgucgugacaaccgacaucagcgagaugggagcgaauuuccgcgccgaucguguuauugacccuagacggugccucaaacccgugauccugaaggaugguccagaaagggucauucuugcaggcccgaugccugugacaguagcuucggccgcacagcgccgagggagaauaggacggaaccacaauaaagagggcgaccaguauaucuacaugggucagccccuaaacaaugaugaggaccaugcccacuggacugaagcuaagaugcuguuggauaacauuaauacgccagaggggaucauccccgccuuauuugaaccugagagggaaaagucugcggcaauugacggcgaguaucgccugagaggagaggccaggaaaaccuucguggaacucaugcggcguggcgaucugccaguuuggcuuuccuacaaggucgcuagcgagggguuucaauauucagaccgccgauggugcuucgauggagaaagaaacaaucaggugcuggaggaaaacauggacguggagauauggacaaaagagggugaaaggaagaaacuccggccccgcugguuggaugccagaacuuacagugacccucuggcucuaagggaguuuaaggaguucgcagccggccggcgaucugucuccggggaccugauccucgagauuggaaaacuuccgcagcaccugacccagagagcucaaaaugccuuagauaacuugguuaugcugcauaauagcgaacagggcggucgcgcauauaggcacgcgauggaggagcucccagacacaaucgaaacccugaugcuucuggcccucauugcuguguugacugggggcguaacgcuguuuuucuuaucaggacggggccuagggaagaccaguaucggacugcucugugugauggccagcuccguccuucuguggauggcaucuguggagccccauuggauagcugccagcaucauuuuggaauuuuuccugaugguucuccugaucccugagcccgaucgucagagaacaccacaggacaaccaacuugcauacguggucauuggucuccuguuuaugaucuugacuguagccgcuaaugagaugggccuguuagaaaccacaaagaaagaucuagggauaggacacguggcgguugagaaccaccaucacgccgcaaugcuggacguggaucuccauccugcuuccgccuggacccuuuacgccgucgcaacuacaauuaucacgcccaugaugaggcacaccauugaaaacacuacagcuaauaucucacugaccgccauagcgaaccaggcugccaucuugaugggccuggacaaggguuggccaauuucuaaaauggauaucggggugccucuccuggcacuuggcugcuauagucaggucaauccguuaacccugacagccgcugugcucauguugguugcacauuacgccauuaucggacccggccugcaagcgaaggcuacucgcgaggcccagaaacggacggcagccgggauaaugaagaacccaaccguggacggaauuguagcuaucgaucuagacccuguggucuaugaugccaaguucgaaaaacagcugggccagaucaugcuccuuauucuguguacaucgcaaaucuugcugaugcgaacuaccugggcacucugcgagagcauaacacuggcuaccggucccuuaacuacgcuuugggagggguccccaggaaaguuuuggaauacaaccauugccguuucuauggcgaacaucuucagaggcucauaccuggccggugcaggccucgcuuucagccuaaugaaaucccuagggggaggcaggcgcgggacuggagcccagggcgaaaccuugggugagaaguggaaacggcagcugaaucagcucaguaagucugaauuuaacacauauaagagaagcgggauuauggagguggaccguucagaagcaaaagagggacuuaagaggggcgagacuaccaaacacgcugucucccgggguacagccaagcugcgcugguucguggaacgaaauuugguaaaaccugagggcaaggugaucgaccugggguguggaagaggcggguggaguuacuauugcgccggacucaagaaaguuacggaagugaagggcuacaccaaaggugggcccggacacgaggaaccgauaccaauggcgacuuacggcuggaacuuagucaagcugcauagcggcaaagauguguuuuucaucccucccgagaagugugacacacuucugugcgauauuggggagucuuccccaaaucccaccaucgaagagggaaggacucuacggguccucaaaaugguggaaccuuggcugcgcgguaaccaauuuuguauuaagaucuugaauccguauaugcccucaguuguagagacacuggagcagaugcagagaaagcacggcgggaugcucgugaggaacccacuuagccgaaauucgacccaugaaauguacugggucucuugcggaacgggcaacauugugagugcuguuaauaugaccucccggaugcuguuaaaccguuucacaauggcacacagaaaaccuacuuaugagcgcgacguggaucugggugccgggaccaggcacgucgcuguggaacccgagguagccaacuuggacaucauaggacagcggauugaaaauaucaagcaugagcacaaaagcacauggcauuacgaugaggacaacccuuauaagacuugggcauaccacggcucauaugaagugaaaccauccggcucugccagcaguaugguuaauggggucgugaagcuccugaccaagcccugggaugugaucccuauggucacacaaauugcuaugaccgacacuacgccauuuggacagcagagaguuuucaaagagaagguggauacacgcacccccaaagcgaagagggguacugcccaaauaauggaaguaaccgcaaaauggcuauggggcuuucuuucccgaaacaagaagccgcggaucuguacaagagaggaguucacgaggaaagugcgcagcaaugcugccauuggggcagucuuuguggacgagaaccaguggaacucugccaaggaggcuguugaagacgagcguuucugggaucuggugcaucgggaaagagagcuccacaaacagggaaagugcgcaaccugcgucuacaacaugaugggcaaaagggaaaagaagcugggugaguuugggaaagcgaagggaucacgcgcaaucugguacaugugguugggcgcccgauuccuggaguucgaagcucucggcuuuaugaaugaggaccacugguucagucgggaaaacucccuuagcgggguggagggagagggucugcauaaauuaggcuauauucugagagauaucucuaagauaccugggggaaauauguacgccgacgauacugcaggcugggacacaaggaucaccgaagaugacuugcagaacgaggcucgcauuacugauaucauggaaccagagcacgcccuccuggcuagaucgauuuuuaaacuaacauaucaaaauaagguaguucgggugcagaggcccgccaaaaacgguaccgucauggacgugaucucacgucgagaucagcgcgggagcggacaggugggcacauacggccuuaauacuuucaccaacauggaagcacaacugauaagacagauggaguccgaggggauuuuuaguccuucugaacucgagacgccaaaccuggcggaacgggucuuggacugguuagagaaguauggaguugaaaggcugaagcgcauggccaucagcggugaugacugugugguaaaacccaucgacgauagauucgcuaccgcccucacagcacuuaaugacaugggcaaggugcggaaagauauuccgcagugggagccuuccaagggguggaacgacuggcagcaaguccccuuuugcucacaucacuuccaccagcugauaaugaaagauggaagggagaucgugguuccaugucgaaaucaggacgagcuggugggccgugcuagagucagucagggugccggguggucucugcgcgagacugcaugccucggaaagagcuacgcccaaauguggcaguugauguauuuucaucggagggaucugagacuugcggcuaacgccauuuguuccgcagugccuguagacuggauccccaccucacgcacaacuuggagcauucacgcccaucaccaguggaugaccacggaagauaugcugucuguuuggaaucggguguggaucgaggaaaacccauggauggaggacaagacacauauauccaguuggggcgauguccccuaccucggcaaaagggaggaccaauggugcgggagcuuaaucggacugaccgcucgagccacuugggcaacaaauauucagguggcuaucaaccagguuagacgguugauugguaaugaaaacuaccuggacuauaugaccucgaugaagagguucaaaaaugaguccgauccugaaggcgcccucugguga

SEQ ID NO: 13883 - RNA, 9879 nt, Artificial Sequence
  derived and/or modified CDS sequence (opt3) from DENV-1__GU131697__SS-prME
agcgugaccaugcugcucaugcuuaugcccacugcacuggcuuuccacuugacuacgcggggaggggagccucauaugaucgucuccaagcaggaaaggggaaagucuuuacuguuuaagaccucagccgguguuaacaugugcacauugauugcaauggaccucggcgagcugugugaagauacuaugaccuacaagugcccacggauuacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagggauuuuguggagggucuuaguggcgcgacuuggguagacguuguguuggagcacggguccugugucacaaccauggcaaaggauaagcccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccaguaccaaguggguaaugagaguacugaacauggcacgacagccaccauuacuccccaggcgccuaccacagagauccagcugaccgacuauggggcccucacucuugauuguagcccaaggacaggacuggacuucaacgaaauggucuugcuaacgaugaaggagaaaucuuggcuggugcacaagcagugguuucucgaucugccgcuucccuggaccuccggcgcaucaacuagccaagagacauggaauaaacaggaccuguugguaaccuucaagacagcucaugccaagaaacaggaaguugugguccucgguagucaagagggggcuaugcacacugcccugaccggcgcaacggaaauccagaccucuggaacaacuaccauuuuugccggccacuuaaagugccggcugaaaauggauaagcuaacacucaaagggauguccuacgugauguguacuggcagcuucaagcuggagaaggaagucgcugagacccagcaugguacggugcuuguucagauaaaauaugagggcacagacgcgccuugcaagaucccauucucgacccaagaugaaaaaggggugacucagaacggacguuugauuacagcaaaucccaucguaaccgacaaggagaaaccugucaacauagaagccgagccacccuuuggcgagucuuacauugugaucggugcuggggaaaaggcccugaagcucuccugguucaaaaagggcucaaguaucggaaaaauguuugaggcaacugcccgcggcgcuagaaggauggccauucugggggauaccgcaugggacuucggaagcaucgguggcguuuuuacauccguggggaaacuuauucaccagauauucggaacggcguacggcguccuguuuucuggugugagcuggaccaugaaaaucgggauuggcguauugcucacuuggcugggauuaaauucacggaguacaucccugagcaugaccuguaucgcugugggccuaguuacacucuaucugggggucauggugcaggccgauucuggaugcgugaucaacuggaagggccgagaacuuaagugugguucagggauuuucgucacuaaugagguucauaccuggacggaacaauacaaauuucaggcagacaguccgaagcgcuugagcgccgcuauaggaaaagccugggaggagggcgugugcgguaucagauccgcaacaaggcuggaaaacauuauguggaagcagaucucuaacgagcucaaucacauucuguuagaaaacgacaugaaacugaccgugguagucggcgauguggcugggauccuuggacagggcaagaaaaugauacggccucaacccauggaguauaaguacucguggaaaagcugggggaaggccaagaucauuggagcggacgcccagaauacuaccuucaucauugauggcccaaacacaccugaaugucccgacgaucagcgcgcuuggaauaucugggagguugaggacuaugguuuugggauauucacuaccaacauuugguugaaacucagagauuccuacacacaggugugcgaccauaggcugaugucagcagccaucaaggauaguaaagcuguccacgccgacaugggauauuggauugaaucugagaagaaugaaacguggaagcuagcacgugcgagcuuuaucgaggugaaaaccuguauauggccaaagucccacacucuguggucaaacggcguucucgaaagcgagaugaucauucccaaaaucuacgguggcccuauuucucaacauaauuaccggccaggguauuucacacagaccgccggaccguggcaccugggcaaacuugaguuggauuucgaccugugcgaagggacuacagugguagucgaugagcauugcggaaaccgaggccccuccuuaagaaccacgacugugaccgguaaaaucauacacgaaugguguugcaggaguuguacacucccuccacugcgcuuuagaggggaagacggaugcugguacggcauggagauuagacccgugaaggaaaaggaggaaaaucuugucaaaagcaugguuucugcugguuccggcgagguggacucauucagucugggguugcucuguaucagcaucaugauugaagagguaaugaggucgcgcuggucccgaaagaugcugaugaccggaacucuagccguguuuuuccugcucaucaugggccagcugacauggaacgaucuuauucgguugugcauaauggucggggcaaaugcuuuugaccguaugggaaugggcaccacauaucuggccuuaauggcaacuuucaaaaugagaccuauguuugccgugggucuccuguucaggcgccuuaccucucgggagguucugcuacucacgaucgggcugagcuugguggcuucagucgaacugccaaacaguuuagaggaacucggagauggccuggcgaugggcauuaugauccuuaagcuguugacagacuuucaaucccaccagcucugggccacccugcuaucucugacuuucauuaaaaccacauuuagccuucauuacgcauggaagacuauggcuauggugcucuccaucguuucacuguuccccuugugucugagcaccacgagucagaagacaaccugguuaccggugcuccuggggucucuuggaugcaaaccucugacuauguuuuugauagccgagaauaagaucugggguagaaaauccuggccacucaacgaaggcauuauggccgucgggaucguaagcauucugcuaucgucacugcuuaagaacgaugugccccucgcuggaccucugaucgcaggcgguauguugauagccuguuauguuauuucugggaguuccgcggacuuaagccuggagaaagcugccgaggugucuugggaagaggaagcagagcacagcggagccucccauaauauccucgucgaagugcaggaugacggcacaaugaagaucaaagaugaggagagggacgauacccugacuauucuucugaaggcuacauugcuagcaguaucaggcguguacccccugaguauaccagccacccucuucgucugguauuucuggcaaaagaaaaagcagcgaagcgggguucugugggacacgccuucucccccagaaguggagcgcgcggugcuugaugacggaaucuaccggauuaugcagagagguuuacugggcaggucccaggucggggugggaguuuuucaagaaaacguauuccacacuauguggcaugugacccguggcgcuguccucauguaccaggguaaacgcuuggagccgucaugggccagugugaagaaagaccugaucagcuaugggggaggcuggcggcucagaggcuccuggaauacaggggaggaaguucaggugauugcagucgagccuggaaagaaccccaagaaugugcagaccgccccagguacauuuaaaacucccgaaggcgagguaggggcuaucgcccuggauuucaagccuggaaccucuggcucgccaauagucaacagggaagguaaaaucguggggcuuuacggaaauggcguugugacgacaagcggcacuuaugucucagcaauugcucaagccaaggcgucccaggaggggccccugccugagaucgaagacgagguguuucgaaaacggaacuugaccauuauggaucuacacccgggaagugguaagacacgcagauaccugccagccaucguuagggaagcaauaaagcggaaacuccgaaccuuaauucuggcucccacuagaguggucgccucugagauggcugaagcacuuaagggcaugccuauccgcuaucagaccacagccgugaaaagcgagcacacggggaaggagaucguagaccugaugugccaugccacuuucaccaugaggcucuuguccccagugcguguucccaauuacaacaugauuaucauggaugaagcucacuuuacagacccuucaucuauagcggcacggggauauauuagcaccagagucggcaugggugaggccgcugccaucuucaugacugcaacaccgcccgggaguguggaagccuuuccacaauccaaugcugugauucaggaugaggaaagggacaucccugagcgcagcuggaacucuggacaugaguggauaaccgauuuccccggcaaaacggucugguuuguaccaucaauuaaguccggcaaugacaucgcgaacugucugcgaaagaaugggaaaagagugauccagcucagucggaagacuuucgauacagaauaccagaaaaccaagaacaacgacugggacuacguugugaccacugauauuagcgagaugggagccaauuucagggcagaccgcgucaucgauccucguagaugccugaaacccgugauucuuaaggacgguccagaacggguuauacuagcuggcccgaugccugugacagucgccucggcagcccaaaggcgcgggcgaaucggaagaaaccacaauaaggagggcgaucaguauauuuacaugggucagccccugaacaaugacgaggaucaugcucacuggaccgaagccaaaauguuguuagacaacaucaauacaccagaggggaucauucccgcgcuguuugaaccugagcgggaaaagucugcagccguggauggcgaguauaggcuccgcggagaggcuagaaaaacuuucguagaacugaugaggcggggcgaccuuccaguguggcuguccuacaagguugccagcgagggguuucaguauucagaucgucgcuggugcuucgacggagaacgaaacaaucaaguccucgaggaaaacauggauguggagauauggacgaaagagggugaaagaaagaaauugaggccccgguggcuggacgcucgcaccuacagugacccucuagcacugagagaguuuaaggaguucgccgcuggcaggcggucuguguccggggaucucauccuugagauuggaaagcugccgcagcacuuaacacagcgagcccagaaugcauuggacaaccuggucaugcuccauaauagcgaacaaggcgguagagcguaucgccacgccauggaggagcugccagauacuaucgaaacccuuaugcugcucgcuuugauugccguucugacagggggcgugaccuuauuuuuccuaucaggaaggggccuggggaaaacaaguaucggacuccuuuguguaauggcaagcuccgugcuguuguggauggcuucugucgagccccauuggauagccgcaagcaucauucuggaauuuuuccucauggugcugcuuaucccugagcccgaccggcagcguacgccacaggauaaccagcucgccuacguugugauuggucuguuguuuaugauccugaccgucgcugcgaaugagaugggcuuacuagaaacaacuaagaaagaccuggggauaggacacguagccguggagaaccaccaucacgcagcuaugcucgauguugaccuucauccugccuccgccuggacccuguacgcaguggcuacaaccauuaucacucccaugaugagacacacaauugaaaacacgaccgccaauaucucauugacugcgauagcuaaccaagccgcaauccugaugggccucgauaaggguuggccaauuucuaaaauggacaucggggucccucugcuugccuuaggcugcuauagucaggugaauccgcugacacucaccgcugcagucuugaugcugguggcccauuacgcgauuaucggacccggccuacaggcuaaggccaccagggaggcacaaaagcgcacagccgcugggauaaugaaaaacccaacuguugauggaauuguggccaucgaccuggauccuguaguguaugacgcaaaguucgaaaaacagcucggccagaucaugcuucugauuuuguguacgucgcagauccugcucaugcggaccacaugggcucugugcgagagcauaacuuuagccaccgguccccuuacaacccugugggagggguccccaggaaaguuuuggaauacuacgauugcggucucuauggccaacaucuuccgaggcucauaccucgcaggagcuggccuagccuucagccugaugaaaucccuaggggguggcagaagggggacaggagcacaaggcgaaacccugggugagaaguggaagcgccagcucaaucagcuuaguaaaucugaauuuaacacuuauaagcggagcgggauuauggagguugacagaucagaagcuaaagagggacugaagcguggcgagaccacaaaacacgccguguccagggguacugccaaguugcggugguucgucgaacgcaaucuggugaagccugagggcaaaguaaucgaucucggguguggacgaggcggguggaguuacuauugcgcgggauuaaagaaagugaccgaaguuaagggcuacacaaaaggugggcccggacacgaggaaccgauaccaauggcuacguacggcuggaaccuggugaaacuucauagcggcaaagacgucuuuuucaucccucccgagaagugugauacccugcuaugcgacauuggggagucuuccccaaaucccacuaucgaagagggaagaacacucagggugcugaagauggucgaaccuugguugcgggguaaccaguuuuguauuaaaauccugaauccguauaugcccucagugguugagacccucgagcaaaugcagcgcaagcacggcgggaugcuuguaagaaacccacugagcagaaauucgacucaugaaauguacugggugucuugcggaacaggcaacauugucagugcagugaauaugaccucccgaauguuacugaaccgguucacgauggcccaccguaaaccuaccuaugagagagauguugacuuggguacagggacucgccacguggcugucgaacccgagguggccaaccucgauaucauaggacagaggauugaaaauaucaagcaugagcacaaaagcaccuggcauuacgacgaggauaacccuuauaagacaugggcauaccacggcucauaugaaguaaagccauccggcucugccagcaguauggugaaugggguugucaaacugcuaacuaagcccugggacgugaucccuauggugacccagauugcuaugacagauaccacuccauuuggacaacagcgggucuucaaagagaagguugacacgagaacacccaaagcgaagcgcgguaccgcccagauaauggaagugacugcaagguggcuuuggggcuuucugucccgaaacaagaaaccgcggaucuguaccagagaggaguucacaaggaagguacgcagcaaugcugccauuggggcaguguuugucgacgagaaccaauggaacucugccaaagaggcuguggaagaugagcguuucugggaccucguucaucgggaaagagagcugcacaagcagggaaaaugcgccacgugcguguacaacaugaugggcaagagggaaaagaaauugggugaguuugggaaggcgaaaggaucacgcgcaaucugguacauguggcugggcgcccgauuccucgaguucgaagcucuuggcuuuaugaaugaggaucacugguucagucgggaaaacucccugagcggggucgagggagaggguuuacauaagcugggcuauauuuugagagacaucucuaaaauaccugggggaaauauguacgccgaugacaccgcaggcugggauacuaggaucacagaagacgaucuccagaacgaggcuaagauuaccgacaucauggaaccagagcacgcccugcuagcuaaagccauuuuuaaacuuacuuaucagaauaaggugguacgcguucaaagacccgccaagaaugguacagugauggaugucaucucgcggagggaccagcgugggucaggacaggugggcaccuacggccugaauacauucacuaacauggaagcgcagcucauacgacaaauggagagcgaggggauauuuuccccuagugaacuggagaccccaaacuuggccgaacgcgcuuuagauuggcuggagaaguauggaguggaaagacucaaacggauggccaucucuggugacgacugugucguuaagcccaucgaugacagguucgcaacggcucuuaccgcccugaaugauaugggcaaagugcgcaaggacauuccgcagugggagccuagcaagggguggaacgauuggcagcagguacccuuuugcucccaucacuuccaccaacuaauaaugaaagacggaagagagaucguggucccaugucggaaucaggaugaacuggugggcagggcacgaguuucacagggugccggguggagucuccgugagacagcgugcuugggaaagucuuacgcucagauguggcaacugauguauuuucauagacgcgaccuucggcuggccgcaaacgccauuuguagcgcugugccugucgauugggugcccacuuccaggaccacauggucaauccacgcccaucaccaguggaugacuaccgaagacaugcucagcguauggaauagaguuuggauugaggaaaacccauggauggaggauaaaacgcauaucucuuccugggaggacgugcccuacuuaggcaagcgcgaagaccaguggugcggcagucugauaggguugacagcacgggcuaccugggccacuaauauccaagucgcgauuaaccaggugaggcgacugaucggaaaugagaacuaccucgauuauaugacaagcaugaaaagauucaagaaugaaucggacccugagggugcucuuugguga

SEQ ID NO: 13884 - RNA, 9879 nt, Artificial Sequence
  derived and/or modified CDS sequence (opt3) from DENV-1__GU131700__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucaccccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacuagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacaagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucacacacacaggugugcgaccaccguuugaugagugcagccauaaaggauucuaaagcuguucaugccgacaugggguauuggauugaaagcgagaagaaugaaacguggaagcucgcacgggcguccuucaucgaggugaaaaccuguauuuggccaaagucacacacucuguggagcaacggaguacuagaaucugagaugaucauacccaaaaucuacggcgguccuauuucccagcauaauuaucgaccaggcuacuuuacacaaaccgccgggccguggcaccugggaaagcucgagcuggauuucgaccuuugcgaaggcacuacagucgugguggaugagcacugcgggaacagaggacccaguuugaggaccacgacugucaccggcaaaaucauucaugaaugguguugccgcagcuguacacugccuccauuacgguuuaagggugaggacgggugcugguacggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaucuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaccaacugugggccaccuugcucucccugacuuuuauuaagaccacauucucacuacauuacgcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcuaaaaaacgaugugccccuggcugggccucuuaucgcaggaggcaugcucauugccuguuaugucaucuccgguagcucugcggaccugagcuuggagaaggcugccgagguguccugggaagaggaagcagagcacucaggggccagucauaauauauuaguagaagugcaggaugacggaacaaugaaaauuaaggaugaggagagggacgauacccugacuauccuccugaaggcuacacuucugaccgucagcggcguuuaccccuugucuaucccagcaacgcuauucgugugguauuuuuggcagaaaaagaaacaacgauccggcgugcugugggacacuccuucacccccaaaggucgaacgcgccgugcucgaugacgggauuuaccggauaaugcagagaggacugcuugguaggagucagguuggcguagggguguuccaggagaacgucuuucacaccauguggcacgugacacguggagcgguuuuaauguaucaaggcaaacgccuggaaccgagcugggcuuccgugaagaaggaccucaucucuuacggugggggauggcgguugcagggcucguggaauaccggcgaggagguccaggugauugccguagaaccugggaaaaaccccaagaauguccagacagcaccaggaacuuucaaaaccagcgagggugaagugggcgccaucgcucuggauuuuaagcccgggacgucaggauccccuauuguuaacagagagggcaaaaucgugggucucuacgggaauggagucgugacaacuaguggcaccuauguuucugccauagcacaagcuaaggccagccaggaaggcccacugcccgagaucgaggacgaaguguucaggaagcgaaaccuuacaauuauggaucugcauccuggguccggaaaaacccggcgcuacuugccggcgaucgucagagaggccauuaagaggaaacuacggacucugauccucgcaccaacccgagugguagcuucagaaauggccgaggcuuuaaaggguaugcccauaagauaucagacaacggcagugaaaucugaacacacuggcaaggagauuguugaccugaugugccaugccaccuuuacaaugcgccuucugagcccugucagggugccaaauuacaacaugaucaucauggaugaggcccacuucaccgaccccaguuccauugcugcgcguggguauaucagcacucgggugggaaugggcgaagcagccgcuauauuuaugacagccaccccuccggguucugucgaggcauucccccaaucaaaugccguaauucaggaugaagagagagacaucccagaaagguccuggaacaguggguacgaguggauuacggauuuuccuggaaagacugugugguucguucccagcaucaaaucgggcaaugacauagcuaacugucuccgcaagaauggcaaacgagugauucaguugucuagaaagacauucgauaccgaguaucagaaaaccaagaacaacgacugggacuacgucgugacuacagauaucuccgaaaugggggcgaauuuucgggccgacaggguuaucgauccacgccguugccugaagccugugauucucaaagacggacccgagagagucauccuggcagguccaaugccggugaccguagcuagcgccgcacaacggaggggccgcauugggcgaaaccauaauaaggaaggagaucaguacauauauaugggccagccucuuaacaaugacgaggaucacgcccacuggacagaggcuaaaaugcuacuggacaacaucaauacucccgaagguauuaucccagccuuguucgagcccgaaagagagaagucagcggcaaucgauggggaauaccgguuaaggggcgaggcccgcaaaacguuuguggagcugaugagaaggggagaccucccuguuuggcugaguuauaaggucgcuucugaaggcuuccaguacuccgaucggcguuggugcuuugacggggagcgcaacaaucaagugcuugaagagaacauggauguggaaauuuggaccaaagagggagagcgaaagaagcugagaccaagguggcucgacgcccggacauauagcgaccccuuggcucugcgcgaauucaaagaguuugcagccgguagaaggucagucaguggcgaucuaauacuggaaaucgggaagcucccucagcaucuuacucagcgggcucagaaugcccuggacaacuuaguuauguugcacaauagcgagcaaggaggccgagcauacagacaugcgauggaagagcugccggauaccauugagacaaugaugcuccuggcccuuaucgcugugcugaccggugggguaacucucuucuuuuuguccggccgcggacugggcaaaacgucuauuggguuacuaugugugauggccagcuccguccugcucuggauggcaucaguggaaccacacuggaucgcugccucuauaauccuugaguucuuucugaugguuuugcugauucccgaaccugacaggcagcggaccccccaggauaaccagcucgcauauguggucaucggacugcuuuucaugauucucacaguagccgcuaaugagaugggucuguuggagacuaccaagaaagaccugggcaucgggcacguggcgguugaaaaccaucaccaugccgcaauguuagauguggaccuacacccagcuagugccuggacacuguacgccgucgcaaccacuauaauuacaccuaugaugcgucauacgaucgagaacaccacugcuaauauuucgcucacagccaucgcgaaccaagcugccauacuuaugggacuggauaagggcuggcccaucagcaagauggacauuggugugccauugcuggcacucgggugcuacucccaggucaauccucugacccuuaccgccgcuguguuaaugcugguugcacacuaugccaucauuggcccgggacuccaggcgaaagcuacaagagaagcccaaaagaggacugcagccggcaucaugaaaaaccccacgguggaugggauaguagcuauugacuuggauccaguggucuacgacgccaaguuugagaaacagcugggacagaucaugcuacugauccucuguaccucucagauucuucugaugcgcacaacuugggcauugugcgaaucaaucacccuggcuacaggcccucucaccacucugugggaggguagccccgggaaguucuggaauacgacaauagccguuuccauggcgaacauuuuccggggaaguuauuuagccggcgcaggucuugcuuuuucucugaugaagagccucggcgggggacgaagaggcaccggggcccaaggagagacucuaggcgaaaaauggaagaggcagcugaaucaguugucaaaauccgaguucaacaccuacaagcgcagugguaucauggaaguggaccggagcgaggcaaaagaagggcugaagagaggagagacaacuaagcacgcugucucucguggcaccgccaaacucaggugguuuguggagcggaaucuuguaaagccagaagguaaagugauugaucugggcugugggcgcggaggcugguccuauuacugcgccggguugaagaaaguuacagaggugaagggauauacgaaaggcgguccugggcaugaagagcccaucccgauggcgaccuacggauggaaccuggucaagcuccacucaggcaaggacguguucuuuauaccaccugaaaaaugugauacuuuacugugcgacaucggcgagagcucgcccaauccaacaauugaggaagggcgaacccuuagaguccugaagaugguggagcccuggcuaaggggaaaccaguucuguaucaaaauucucaauccuuacaugccgucuguuguagaaacucuggagcaaaugcagcggaagcaugguggcauguuggugcgcaacccccugaguagaaauuccacacacgagauguauugggucagcugcgggaccggaaacaucgugucagcuguuaauaugacguccaggaugcuccuuaaccgauuuaccauggcacaccggaaaccaacauacgaacgugauguggaccugggcgccgguacuagacaugucgcuguggagccugaaguagccaacuuagauauuaucgggcagcgcauagagaauauuaagcacgaacauaagucuaccuggcacuaugacgaggauaaccccuacaaaacaugggcauaucauggaagcuacgaggugaagccuaguggcuccgccagcucuaugguuaauggcgucgugaaacuguugacuaagccaugggacgugauccccauggucacccagaucgcuaugacagauaccacuccuuucgggcaacagaggguuuuuaaagaaaagguggacacgcggacaccaaaggcgaaaagaggaaccgcccagauuauggagguaacugcaaaguggcucugggguuuccugucacgcaacaaaaagcccaggauauguacccgagaagaguuuacacggaaagugagaaguaaugcugccaucggcgcagucuucguggacgaaaaccaauggaauuccgccaaggaggcuguugaggaugaaagguuuugggaccuagugcaccgcgagcgugaacuucacaagcaggggaaaugcgccacgugcgucuauaacaugaugggaaagcgggagaaaaagcugggcgaauucgguaaagcgaaggggagcagagcaauuugguacauguggcucggagccagguuccuggaguuugaggcuuugggcuucaugaaugaagaucauugguuuucucgcgagaacucgcugucaggcguggaaggggagggacuccacaaacuugguuacauccugcgagacauuagcaagaucccgggcgggaauauguaugccgaugacaccgcaggaugggauacucggauaacagaggacgauuuacagaacgaagcuaagaucaccgacauuauggagccugaacaugcccuguuggcuaaauccaucuucaagcucacuuaccagaauaaaguaguuagagugcaaaggccagccaagaacggcacagucauggaugugauuagucgcagagaccagcgggguucugggcaggugggaaccuauggccugaauacauuuacuaacauggaggcacagcuaaucaggcaaauggaaagcgagggcauauucucccccucagagcuugaaaccccuaaccuggcgcgucgaguccucgauuggcuggagaaacacgggguugaacgcuugaagagaauggccauuaguggagacgacugugugguaaagccaaucgaugaccgguuugcuacggccuuaaccgcacugaaugauauggguaaagugaggaaggacaucccccagugggagccgucuaaaggcuggaacgauuggcagcaggucccuuucugcagccaccauuuucaccaacucauuaugaaggacgggcgcgaaauagugguucccuguagaaaucaggaugagcuugugggacgggcuagggucucccagggcgccgguuggucacugcgagagacagcaugccuagggaaaagcuacgcccagauguggcaacugauguauuuccaucguagagaccuccgcuuggcggcuaacgccaucuguucugcagugccaguagauuggguuccuacuucccggaccacauggaguauucacgcccaucaccaguggaugacuaccgaagacaugcugagcguguggaauagggucuggaucgaggaaaaccccuggauggaggauaagacgcacauuucguccuggggagacgugccauaccuuggcaagagagaagaccaguggugcggcucucugaucgggcucacagcucgcgccaccugggcaacuaauauacaaguugcuaucaaccaggugcggagguuaauuggaaaugagaacuaucuggauuacaugacaucaaugaaacgauuuaagaaugagagcgaccccgaaggugccuugugguga

SEQ ID NO: 13885 - RNA, 9879 nt, Artificial Sequence
  derived and/or modified CDS sequence (opt3) from DENV-1__GU131701__SS-prME
agcgugaccaugcugcucaugcuuaugcccacagcccuggcuuuccacuugacuacgagaggaggggaaccucauaugaucgucuccaagcaagaaagaggaaaaucuuuacuguuuaagaccucagccgguguuaauaugugcacacuaauugccauggaccucggagaacugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccacaugucggccuggguuuggagaccagaacagaaacuuggauguccucugagggggcauggaaacagauccagaggguggaaaccugggcccuccggcacccuggauucacaguuaccgcucuguuucuggcacaugugauuggcacgucgaucacucagaagggcauuaucuucauacucuuaaugcuggucacaccaucaauggccaugcgcugcguggggaucggaagcagagauuuuguagagggucuuaguggcgcuaccuggguugacguggucuuggagcacggguccugugugacuacaauggccaaggauaaacccacccuggacauugaacuacucaagacggaggugaccaacccugcgguccugaggaaacuuugcaucgaagcaaagauuucuaauacaacuaccgauagccgguguccaacacaaggagaggccacucugguugaagaacaggacgcuaacuucgugugccgccgaaccuuuguagauagaggcugggguaauggguguggauuguucggcaaaggcucccucaucacaugcgccaaguuuaagugcgugaccaaacuggaggggaagauaguccaguacgaaaacuuaaaauauucagugauuguuacugugcacacgggagaccagcaucaagucgguaaugagaguacagaacacggcaccacugcaaccaucacaccccaggcuccuaccacugagauucagcugacagacuacggggcccucacgcuugauuguagcccaaggaccggacuggacuucaacgaaaugguguugcuaacuaugaaggagaaaucuuggcugguacauaagcagugguuucucgaucugccgcuucccuggacauccggcgcgucaaccagccaagagacauggaaucggcaggaccuguugguuacuuucaaaaccgcccacgcaaagaagcaggaaguggucgugcucgguagucaagagggggcuaugcacacggcccugaccggcgcuacagaaauccagacuucuggaaccacaacuaucuuugccggccauuuaaaaugccgucugaagauggauaaacuaacccucaaggggauguccuaugucauguguacgggcagcuucaaacuggagaaggaaguggcagagacacagcacgguaccguucuugugcagauuaaguacgagggcacugacgccccuugcaaaauaccauucucgacacaagaugaaaaggggguaacccagaacggacgcuugaucacugcuaaucccaccgucacagacaaagagaagccugugaacauugaagcggagccacccuuuggcgagucuuauaucauaauuggugcaggggaaaaagcccugaagcucuccugguucaagaaaggcucaaguaucggaaagauguuugaggcuacggccagaggcgcaaggcggauggccauccugggggauaccgcuugggacuucggaagcauugguggcguuuuuacuuccguggggaaacuuguccaucagaucuucggaacagccuacggcgugcuguuuucugguguaagcuggaccaugaagauugggauaggcguguugcucacauggcugggauuaaauucacgaaguacuucccugagcaugaccuguaucgcaguuggccuagucacgcucuaccugggggugauggugcaggcggauucuggaugcgucauuaacuggaaaggccgcgaacuuaagugugguucagggaucuucguuacaaaugaggugcacaccuggacugaacaauauaaguuucaggcugacaguccgaaaagauugagcgccgcaaucggaaaggccugggaggagggcgugugcgguauuagguccgcuacccggcuggaaaacauaauguggaaacagaucucuaacgagcucaaucauauucuguuagaaaacgacaugaaguucacaguagucgugggcgauguugccgggauccuggcacagggcaaaaagaugauucgcccucaacccauggaguacaaauauucguggaaaagcuggggcaaggcuaaaaucauaggggccgacgugcagaauacuaccuuuaucauugauggaccaaacacaccugaaugucccgacgaucagagagcguggaauaucugggaggucgaggacuacggcuucgguauuuuuacgaccaacaucuggcuuaaguugagggauuccuauacucaggugugcgaccaccgucucaugucagccgcuauaaaagauaguaaggcaguucacgccgacaugggguacuggauugaaucugagaaaaaugaaacauggaagcuggcucgggccagcuucaucgaggugaagaccuguauuuggccaaaaucccauacucuauggucaaacggaguacuggaaagcgagaugaucauacccaagaucuauggcgguccuauuucucaacacaaucaucgaccaggcuacuucacacagaccgcagggccguggcaccucggaaaacuggagcuugauuuugacuugugcgaaggcacgacugucgugguggaugagcacugcgggaacagaggacccucccugaggaccacaaccgucacuggcaagaucauucaugaaugguguugccgcaguuguacauuaccuccacuccgguucagaggugaggacgggugcugguacggaauggagaucaggcccguuaaagaaaaggaggaaaaucugguaaagagcaugguaucugcgggcuccggugagguggacucauuuagucuuggccuguuguguauaagcauuaugaucgaagaggucaugcgcucgcgauggucccggaaaaugcucaugaccgggacacuggccguguucuuucuacugaucaugggacagcucacuuggaacgaucugauucgucuuugcaucaugguuggcgcuaaugccucugacagaauggggaugggaaccacguauuuggcacugauggcuacauucaagaugaggccuauguuugccgugggcuuacucuuccgccggcugaccagcagagagguccuucugcuaacuauuggucucucacugguggcaaguguugaauugccaaacucccuggaggaauuaggggauggacucgccaugggcauaaugauccugaaacuucugaccgacuuucaaccccaccaguugugggcuacacuccugucucuaacuuucauuaagaccacguuuagccugcauuacgcguggaaaacaauggccauggugcuuuccaucgucucacucuucccgcuguguuugagcaccacaagucagaagacaaccuggcugccuguauuacucggcucucuggggugcaagccacuuacuauguuucugauugcagagaauaaaaucuggggaaggcgauccuggcccuugaacgaagguauaauggcugugggcaucguuagcauucuccugucgucacuacugaagaacgaugugccucuugccgggccccucaucgccggaggcaugcugauugcuuguuaugucaucucugguaguuccgcagacuugagcuuagagaaagccgcggaggugucuugggaagaggaagcugagcacagcggggccucccauaauauacugguagaagugcaggaugacggaacaaugaagauuaaagaugaggagcgcgacgauacccucacgauccugcuuaaggcaacucuguuggccgucucaggcguuuacccacuaaguaucccugcuacccuguucgugugguauuucuggcagaaaaagaagcagcggagcggcgugcucugggacacacccucuccaccggaagucgagagagcagugcuggaugacgggauuuacaggauaaugcagcguggacuuuuaggucgcucccagguuggcguagggguguuucaagaaaacgucuuccacaccauguggcacgugacacggggagccguucugauguaucagggcaaaagacucgagccuucaugggcgagugugaagaaagacuugaucagcuacggugggggauggaggcugcagggcuccuggaauacuggcgaggaaguccaggugauugcuguagagcccgggaagaaccccaaaaauguccaaaccgcccccggaacguuuaagacaccugaaggugaggugggcgcaaucgcccucgauuucaagccagggacuucuggaucgcccauuguuaaccgagaaggcaaaaucgugggucuguacgggaauggagucgugaccacaagcggcaccuauguuucagcuauagcccaggcaaaggcuucccaggagggcccucuuccggagaucgaagacgagguguuucggaaacgcaaccugacuauuauggauuugcauccagggaguggaaagaccagaagguaccuacccgccaucguccgggaagcgauuaaacgaaagcugagaacacucaucuuagccccuacgcgcgugguagcaucugagauggcugaagcccugaaggguaugccaauaagguaucaaacuaccgcugugaaaagcgagcacacaggcaaggagauuguugaccuuaugugccaugcaaccuucacuaugcgucugcucucccccguccgggugccuaauuacaacaugaucaucauggaugaagcccacuuuacagacccgucaucuauugccgcuagaggguauaucagcaccagggugggaaugggcgaggcggcagccauauucaugacggcuacucccccagguagugucgaagccuuuccucaguccaaugcaguaauucaggaugaggaacgcgacauccccgagcgaagcuggaacucuggguacgaguggauuacagauuucccaggaaaaaccgugugguuuguuccuucaaucaaguccggcaaugacauagccaacuguuugaggaaaaauggcaagcgggugauucagcugaguaggaagaccuucgauacugaauaucaaaagacuaagaacaacgacugggacuacgucgugaccacagauaucagcgagaugggggcuaauuuccgcgcggaccguguuaucgaucccagacggugccucaaaccagugauucugaaggacggaccggaaagggucauccuugccgguccuaugcccgugacuguagcaucggcugcccagcgccgaggcagaauugggcggaaccauaauaaagagggagaucaguacauauauaugggccagccacuaaacaaugacgaggaucacgcacacuggacggaagccaagaugcuguuggacaacaucaauacccccgaggguauuaucccugcuuuauuugaaccagagagggaaaagucugccgcgaucgauggggaguaccgccugagaggcgaggcaaggaaaacauucguggaacucaugcggcguggagaccugcccguuuggcuuuccuauaaggucgccagcgagggcuuucaauacucagaucgccgauggugcuucgacggggaaagaaacaaucaggugcuggaggaaaacauggauguggagauuuggacuaaagagggagaaaggaagaaacuccggccucgcugguuggacgcuagaaccuauagugacccgcuggcccuaagggaguuuaaggaguucgcugcaggucggcgaucugucuccggcgaucugauacucgagaucgggaaacuuccacagcaucugacacagagagcccaaaaugcuuuagacaacuugguuaugcugcacaauagcgaacagggaggccgcgccuacaggcaugcaauggaggagcuccccgauaccauugaaacucugaugcuucuggcgcucaucgccguguugacgggugggguaacccuguuuuucuuaucaggccggggacuaggcaagacaaguauugggcugcucugugugauggcuagcuccguccuucuguggauggccucuguggagccucacuggaucgcagcuagcauaaucuuggaauuuuuccugaugguucuccugauucccgagccagaccgucagagaacuccucaggauaaccaacuugccuauguggucaucggacuccuguuuaugauuuugaccguagcagccaaugagaugggucuguuagaaacaaccaagaaagaccuaggcaucgggcacguggcuguugagaaccaucaccaugcggccaugcuggauguggaccuccaccccgcauccgcuuggacucuuuacgccgucgccacaacgauaauuaccccaaugaugaggcauacuaucgaaaacacaaccgcaaauauuucacugaccgcuaucgccaaccaggcggcuauauugaugggacuggauaagggcuggccuaucucuaaaauggacauuggugugccgcuccuggcccuugggugcuacagucaggucaaucccuuaacacugacugcagccgugcucauguugguugcucacuaugcaaucauuggcccaggacugcaagccaaggcgacgcgcgaggcucagaaacggaccgccgcaggcaucaugaagaacccuacaguggaugggauaguagccauugaccuagaucccguggucuacgacgcuaaguucgaaaaacagcugggacagaucaugcuccuuauccuguguacuucgcaaauuuugcugaugcgaaccacaugggcccucugcgagagcaucacccuggcaacuggcccauuaacgacacuuugggaggguuccccugggaaguuuuggaauaccacuauagcuguuucuauggccaacauuuucagaggaucauaucuggcgggcgccggucucgcauucagccuaaugaaaucccugggcgggggaaggcgcggcaccggggcucagggagaaacauugggcgagaaguggaaacggcagcugaaucagcucaguaagucugaauuuaacacuuacaagagaagcgguaucauggagguggaccguucagaagccaaagaggggcuuaagaggggagagaccacaaaacacgcagucucccggggcacggcuaagcugcgcugguucguggaacgaaauuugguaaaacccgaggguaaggugauugaucugggcugugggagaggaggcuggaguuauuacugcgccgggcucaagaaaguuaccgaagugaagggauauacuaaaggcgguccggggcaugaggaaccaaucccuauggccacauacggauggaacuuagucaagcugcacagcggcaaagacgcguuuuucauacccccagagaagugugauacccuucugugcgacaucggcgagucuucccccaauccuacuauugaagaggggaggacacuacgggugcucaaaauggucgaaccguggcugcgcggaaaccaauuuuguaucaagauuuugaaucccuacaugccaucagugguugagacccuggagcagaugcagagaaagcaugguggcaugcucguaaggaacccucuuagccgaaauucgacgcacgaaauguauugggugucuugcgggaccggaaacaucgucagugcuauuaauaugacaucccggaugcuguuaaaccguuucacuauggcacacagaaaacccaccuacgagcgcgauguggaccugggcgccgguacaaggcauguugcuguggaaccugaggucgccaacuuggauaucauagggcagcggauugaaaauaucaagcacgagcauaaaagcacuuggcacuaugacgaggauaacccauacaagaccugggcauaucauggaucauacgaagugaaacccuccggcucugccagcaguaugguaaauggcgugguuaagcuccugacaaagccuugggacgucaucccaauggugacccaaauugcuaugacugauacgacacccuuugggcagcagagaguguucaaagagaaggucgacacccgcacuccgaaagcgaagaggggaaccgcccaaauaauggaaguuacagcaaaauggcuaugggguuuucuuucccgaaacaagaagccucggaucuguacgagagaggaguucaccaggaaagugcgcagcaaugcugccauuggcgcaguauuuguggacgagaaccaguggaacucugccaaggaggcugucgaagaugagcguuucugggaccuggugcaccgggaaagagagcuccacaaacaggggaagugcgccacuugcguuuauaacaugaugggaaaaagggaaaagaagcugggcgaguuugguaaagcgaaggggucacgcgcaaucugguacaugugguugggagcccgauuccuggaguucgaagcucucggcuuuaugaaugaggaucauugguucagucgggaaaacucccuuagcggcguggagggggagggacugcacagauuagguuacauucugagggacaucucuaaaauaccaggcgggaauauguaugccgaugacacagcaggaugggauacccgcaucacugaagacgauuugcagaacgaggcuagaauuacagacaucauggaacccgagcaugcccuccuggcuaagucgauuuuuaaacuaaccuaccaaaauaaggucgugcggguacagaggccuggcaaaaacgguacaguuauggaugugaucucacgucgagaccagcgcgggagcggacaggucggcacuuauggccuuaauaccuucacgaacauggaagcccaacugauaagacagauggaguccgaggggauuuuuaguccaucugaacucgagacccccaaccuggcagaacggguguuggauugguuagagaaguacggaguggaaaggcugaagcgcauggcgaucagcggugacgacugugucguuaaaccgaucgaugacagauucgccacagcucucacugcccuuaaugauaugggcaaggugcggaaagacauuccucagugggagcccuccaagggguggaacgauuggcagcaaguaccauuuugcucacaccacuuccaucagcugauaaugaaagacggaagggagaucguggucccuugucgaaaucaggaugagcuagugggccgugcaagaguuagucagggugcuggguggucucugcgcgagaccgccugccucggaaagagcuaugcacaaauguggcaguugauguacuuucaccggagggaccugagacuugccgcgaacgcuauuuguuccgccgugcccgucgauuggaucccaacaucacgcacuaccuggagcauucaugcacaccaucaguggaugacgacagaagacaugcugucuguguggaaucggguauggaucgaggaaaaccccuggauggaggauaagacccacauauccaguuggggcgacguuccuuaucucggcaaaagggaggaccaauggugcgggagcuuaaucggacugacugcccgagcuacaugggccaccaauauucagguggcaaucaaccaggucagacgguugauugguaaugaaaacuaccuggauuacaugacuucgaugaagagguucaaaaaugaguccgacccagaaggcgcucucugguga

SEQ ID NO: 13886 - RNA, 9879 nt, Artificial Sequence
  derived and/or modified CDS sequence (opt3) from DENV-1__GU131703__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcugugaguggcgucuauccccugagcauaccagcaacgcucuuuguuugguacuucuggcagaagaagaagcagcggucuggcgugcugugggacacuccuucacccccagaaguggagagagccguccuugaugacgggaucuauaggauuaugcagcguggauuacugggucgcagccaggugggcguugggguauuccaagaaaacguguuucauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacaacuccaggaaccuucaagacgcccgaaggugaggucggcgcaaucgcccuggauuuuaagccugggacaucgggaagcccaauagugaaccgagaaggcaaaaucguuggucuuuaugggaauggaguggucacuaccucaggcacauacguguccgcuauugcccaggcaaaggcuagucaggagggcccccugccugagaucgaagacgagguuuuccggaaacgcaacuugaccauuauggaucuacacccggggucuggaaagacuagaagguaucugccagccaucgugcgggaagcgauaaaacgaaagcucagaaccuuaauucuggcccccacacgcgucguggcaagcgagauggcugaagcccuuaaggguaugccuaucagguaccaaacgacugcuguaaaauccgagcauaccggcaaggagaucguggaccugaugugccacgcaacauuuaccaugcgucucuugucaccaguucggguccccaauuauaacaugauuaucauggaugaagcccauuucacugacccuucuagcauagccgcuagaggguacauuaguacaagggugggaaugggcgaggcggcagccaucuuuaugaccgcuacgccgcccgguuccguggaagccuucccacagagcaaugcagucauucaggaugaggaacgcgacaucccugagcgaucuuggaacucaggguaugaguggauaacugauuuucccggaaaaacaguaugguucgugccauccauuaagaguggcaaugacaucgccaacugucugaggaaaaauggcaagcggguuauccagcucagcaggaagaccuuugauaccgaauaccagaaaacuaagaacaacgacugggacuacguggucacaaccgauauuucggagaugggggcuaauuuccgcgcggaccgugugaucgauccuagacggugccugaaacccguuauucuuaaggacggaccagaaagggugauacuagccgguccgaugccugucacaguggcaucugcugcccagcgccgaggcagaaucgggcggaaccacaauaaagagggagaucaguauauuuacaugggccagccccugaacaaugacgaggaucaugcacacuggacugaagccaagauguuguuagacaacaucaauacgccagaggguaucauucccgcucuguucgaaccugagagggaaaaguccgccgcgauagauggggaguaucgccucagaggcgaggcaaggaaaaccuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacaaaagagggagaaaggaagaaauugcggccccgcuggcuggacgcuagaacuuacucugacccucuagcccugagggaguucaaggaauuugcugcaggucggcgauccgugagcggcgaucucauucuugagaucgggaaacugccgcagcacuuaacccagagagcccaaaaugcuuuggacaaccuggucaugcuccauaauucagaacagggaggccgcgccuauaggcacgcaauggaggagcugccagauacaauugaaacccuuaugcugcucgcguugaucgccguucugacugguggggugacguuauucuuucuaaguggccggggacugggcaagaccagcauagggcuccuuuguguaauggcuuccucugugcuguuguggauggccagcgucgagccccauuggaucgcagcuuccauuauccuggaguucuuucucauggugcugcuuauuccugagcccgaccgucagagaacaccacaggauaaccaacucgccuacguugugaucggacuguuguucaugauacugacugucgcagccaaugagauggguuuacuagaaaccacaaagaaagaccugggcauugggcacguagcugugggaaaccaccaucacgcggccaugcucgauguugaccuucauccugcaucagcuuggacccuguacgccguggccacuacaaucauuacgcccaugaugaggcacaccaucgagaacacuacagcaaauauaucuuugaccgcuaucgccaaccaggcggcuauucugaugggccucgauaaggguuggccaaucaguaaaauggacauuggggucccucugcuugccuuaggcugcuauagccaggugaauccgcugacccucacagcagccgucuugaugcugguggcucauuacgcaaucauaggacccggccuacaagccaaggcgacucgcgaagcucagaaacggacggccgcagggauuaugaagaacccaaccguugauggaaucguggccaucgaccuggauccuguaguguaugacgcuaaguuugagaaacagcucggccagauuaugcuucugaucuuguguacaagccaaauacugcucaugcgaacuaccugggcccugugcgaauccauuacauuagcaaccgguccccuuacuacgcugugggaggggucuccaggaaaguucuggaauacaaccaucgcugucucaauggccaacauuuuuagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguucaacacauauaagagaucagggaucauggaaguugaccguuccgaggccaaagaaggacugaagaggggcgagacuaccaaacacgcagugagucgggguacagcuaaguugcgcugguuugucgagcgaaaucuggugaaaccugaaggcaagguaauagaucucggguguggaagaggcggguggagcuacuauugcgccggauuaaagaaagugacggagguuaagggcuacaccaaaggugggcccggacacgaagaaccgaucccaauggccacuuacggcuggaaccuggugaaacuucauucuggcaaagacgucuucuuuauuccucccgaaaagugugauacacugcuaugcgacaucggggaguccucaccaaaucccaccauugaggaaggaaggacucuccgggugcugaaaauggucgagccuugguugcgcgguaaccaauucuguaucaagauucugaauccguauaugcccagcgugguugaaacacucgagcagaugcagagaaagcacggcgggaugcuuguaaggaacccacugucgcgaaauucuacccaugagauguacugggugaguugcggaacgggcaacaucgucuccgcggugaauaugaccagccggauguuacugaaccguuuuacaauggcucacagaaaaccuacuuaugaacgcgauguugacuugggugcagggaccaggcacguggccgucgagcccgaaguggcuaaccucgauauaauuggacagcggaucgagaauaucaagcaugaacacaaaucaacauggcauuacgacgaggauaacccuuauaagacuugggccuaccacggcuccuaugagguaaaaccaucuggcagcgcaaguuccauggugaaugggguugucaagcugcuaaccaagcccugggacgugauuccuauggugacacaaauagccaugaccgauacuacgccauucggacagcagagagucuuuaaagaaaagguugacacacgcacccccaaagcuaagagggguacugcgcaaaucauggaggugaccgccaaauggcuuuggggcuuccugagccgaaacaagaagccgcggauuuguacaagagaagaguuuacgaggaaaguacgcucuaaugcagcuaucggggccguguucgucgacgaaaaccaguggaacucagcaaaggaggccguggaggaugaacguuuuugggaccucguucaucgggagagagaacugcacaaacagggaaagugcgcuaccugcguguacaacaugaugggcaaaagggagaagaaguugggugaguucgggaaagccaagggaagucgcgcgauuugguacauguggcugggcgcacgauuucucgaguucgaggcccuuggcuucaugaaugaagaucacugguuuucccgggagaacagccugucuggggucgaaggagaggguuuacauaaacugggcuauaucuugagagacauaucgaagaucccugggggaaauauguacgcugaugacacugccggcugggauacaaggauuaccgaggacgaucuccagaacgaagcacgcaucacugacauuauggagccagaacacgcucugcuagccaaaucaaucuucaaacuuacauaucaaaauaaagugguaagaguucagcggcccgcuaagaacgguaccgugauggaugucauaagcaggcgugaccagcgaggguccggacaggugggcacauacggccugaauacuuuuaccaacauggaggcccaacucauucgccagauggaaagugaggggaucuucucuccuagcgagcuggaaacgccaaacuuggcagagagaguguuagauuggcuggaaaaguauggagucgagcggcucaaaaggauggcgaucuccggugacgacuguguugugaagcccauugaugaccgcuuugccaccgcucuuacagcccugaaugauaugggcaaaguaagaaaggacauaccgcagugggaaccuucaaaaggguggaacgauuggcagcaagugcccuucugcagucaucacuuucaccagcuaaucaugaaggacggacgggagauugucgugccauguaggaaucaggaugagcugguuggccgagcacgugugucucagggugcuggguggagccucagagaaacugccugcuugggaaaguccuacgcacaaauguggcagcugauguauuuccaucgccgggaccuuaggcuggccgcgaacgcuaucuguucagccgucccuguggauuggauucccaccagcagaacaacuuggucuauccacgcacaucaccaguggaugaccacggaggacaugcucuccguauggaaucgcguuuggauagaagagaacccauggauggaagauaaaacacauaucaguagcuggggcgacgugcccuacuuaggcaagcgggaggaccaauggugcgggucgcugauuggauugaccgccagggcuacuugggccacaaauauccaggucgcaauuaaccaggugcgaagacugaucgguaaugagaacuaccucgauuauaugaccuccaugaaacgguuuaagaaugaaucugacccugagggcgcucuuugguga

SEQ ID NO: 13887 - RNA, 9879 nt, Artificial Sequence
  derived and/or modified CDS sequence (opt3) from DENV-1__GU131706__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucagaaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaaugacauacuuggcucugauggccacuuucaaaaugcgcccuauguuugcagugggcuuacucuuccggagacugaccagcagggagguccuucugcuaacgauaggucucucacugguggccaguguugaauugccaaacucccuggaggaauuaggggauggacucgcuaugggcaucaugauucugaaacuucugacagacuuucaaucucaucaguugugggcgacccuccugagccuaacuuucaucaaaaccacauuuucccugcacuaugccuggaagacuauggcaauggugcuuucaauugucagccucuucccccuguguuugaguaccacgucucagaaaacaaccuggcugccgguauuacucggcucccuggggugcaagccucuuacuauguuucugaucgcugagaauaagauauggggacgacgcagcuggccauugaacgaagguaucauggccgugggcauuguuucgauccuccugucaucucuacugaaaaacgaugugccccuugccgggccucucauugcuggaggcaugcugaucgcauguuacgucauaagugguuccagcgccgacuugucuuuagagaaggcggcugaggugagcugggaagaggaagccgagcauuccggggcaucacacaauauucugguagaagugcaggaugacggaacaaugaaaaucaaggaugaggagcgggacgauacccucacuauccugcuuaaagccacacuguuggcugucaguggcguuuauccccuaagcauuccagcaacccuguucgugugguacuucuggcaaaagaaaaagcagagaucuggcgugcucugggacacgccuucacccccagaagucgagagggccgugcuggaugacgggauauaucguaucaugcagcgcggacuuuuaggucggagccagguuggcguagggguguuucaagaaaacgucuuccauacuauguggcacgugaccagaggagcgguucugauguaccagggcaagaggcucgagccgaguugggcuagcgugaaaaaggacuugauuuccuacggugggggauggcgacugcagggcucuuggaauacaggcgaggaaguccaggugaucgccguagagccugggaaaaaccccaagaauguccaaaccgcaccaggaacauuuaaaacucccgaaggugaggugggcgccauugcucucgauuucaagccugggaccucgggaagcccaaucguuaaccgggaaggcaagauagugggucuguaugggaauggagucgugacgacaucaggcacuuacguuuccgccaucgcacaggcuaaagccagucaggagggcccccuuccugagauugaagacgagguguuucgcaagagaaaccugaccaucauggauuugcacccggggucuggaaaaacaaggcgguaucuaccagcgauuguccgagaagccaucaagagaaaacugcgcacccucauauuagcacccacuagggugguagcuagcgagauggccgaagcucugaaggguaugccuauucguuaccaaaccacagcagugaaguccgagcauacgggcaaagagaucguugaccuuaugugccacgccacuuucaccaugcggcugcucucaccagucagagugcccaauuauaacaugaucauuauggaugaagcccauuuuacagacccuucuagcaucgcugcgaggggguacauaaguacccgcgugggaaugggcgaggcagccgcuauuuucaugacugccacaccgcccgguuccgucgaagcauuuccacagagcaaugccguaauccaggaugaggaacgagacauuccugagagaucuuggaacucaggguaugaguggaucaccgauuuccccggaaagacggugugguuuguuccauccauaaaaaguggcaaugacauugcuaacuguuugcggaagaauggcaaaagggugauccagcugagccgcaagacuuucgauacagaauaccaaaagaccaaaaacaacgacugggacuacgucgugaccacugauaucucggagaugggggcgaauuuccgugccgacagaguuauugauccucggaggugccucaagcccgugauccugaaagacggaccagaacgcgucauucuugcagguccgaugccugugacaguagcuucugccgcacagcgaagaggccggauagggaggaaccacaauaaggagggagaucaguauaucuacaugggccagccccuaaacaaugacgaggaucaugcccacuggaccgaagcuaaaaugcuguuggacaacauuaauacaccagaggguaucauccccgccuuauuugaaccugagcgcgaaaaguccgcggcaauugauggggaguauagacugaggggcgaggcccggaagacuuucguggaacucaugcgucgcggagaccugccaguuuggcuuagcuacaaagucgcuucagagggcuuucaauauagugaucgaagauggugcuucgacggggaaaggaacaaucaggugcuggaggaaaacauggauguggagauauggacgaaggagggagaacggaaaaagcuccgccccagaugguuggacgccaggaccuacucugacccucuggcucuacgggaguuuaaagaguucgcagccggucgaagauccgucagcggcgaucugauccucgagauugggaaacuuccgcagcaccugacacagcgcgcucaaaaugccuuagacaacuugguuaugcugcauaauucagaacagggaggcagggcauaucggcacgcgauggaggagcucccagauacuaucgaaacccugaugcuucuggcccucauugcuguguugacaggugggguaacccuguuuuucuuaaguggccguggacuaggcaaaacuagcaucgggcugcucugugugauggccuccucuguccuucuguggauggcaagcguggagccccauuggauagcugccuccaucauuuuggaauuuuuccugaugguucuccugaucccugagcccgacagacagaggacgccacaggauaaccaacuugcauacguggucauuggacuccuguuuaugaucuugaccguagccgcuaaugagaugggucuguuagaaacaacuaagaaggaccuaggcauagggcacguggcgguugagaaccaccaucacgccgcaaugcuggauguggaccuccauccugcuucagccuggacccuuuacgccgucgcaacaaccauuaucacucccaugaugcgccacacaauugaaaacacgaccgcuaauaucucucugacugccauagcgaaccaggcugccaucuugaugggacuggauaaaggcuggccaauuaguaagauggacaucggugugccucuccuggcacuugggugcuauucgcaggucaauccguuaacacugaccgccgcugugcucauguugguugcacauuacgccauuaucggccccggacugcaagcgaaagcuacccgggaggcccagaagcgaacagcagccggcauaaugaaaaacccaacuguggaugggauuguagcuaucgaccuagauccuguggucuaugacgccaaguucgaaaagcagcugggacagaucaugcuccuuauucuguguacgagccaaaucuugcugaugagaaccacaugggcacucugcgaguccauaacucuggcuaccggccccuuaacaacccuuugggaggguucuccagggaaauuuuggaauacuacgauugccguuucaauggcgaacaucuucaggggaagcuaccuggccggcgcaggucucgcuuucucccuaaugaagagucugggcgggggacgccggggcacaggggcccagggagaaaccuugggcgagaaauggaagagacagcugaaucagcucucuaaaagcgaauuuaacacuuauaagcguucagguauuauggagguggacagguccgaagcaaaggaggggcuuaaacggggagagaccacaaagcacgcugucagucgcggcacugccaaacugcgaugguucguggaaagaaauuugguaaagccugaggguaaagugaucgaucugggcugugggaggggaggcuggagcuacuauugcgccgggcucaagaagguuaccgaagugaaaggauacacaaagggcggucccgggcacgaggaaccgauaccaauggcgacguacggauggaacuuagucaaacugcauucuggcaaggacguguuuuucaucccucccgagaaaugugauacccuucugugcgacauuggcgaguccucaccaaaucccacuaucgaagaggggcggacacuacgcguccucaagaugguggaaccuuggcugagaggaaaccaauuuuguauuaaaaucuugaauccguauaugcccagcguuguagagacccuggagcagaugcagaggaagcacgguggcaugcucgugcgaaacccacuuucgagaaauucuacucaugaaauguacugggucaguugcgggacaggaaacauuguguccgcuguuaauaugaccagccguaugcuguuaaacagauucacgauggcacaccgcaagccuaccuaugagagggauguggaccugggcgccgguacacggcacgucgcuguggaacccgagguagccaacuuggauaucauagggcagagaauugaaaauaucaaacaugagcacaagucaacuuggcauuacgacgaggauaacccuuauaaaaccugggcauaccacggauccuaugaagugaagccaucuggcagcgccaguuccaugguuaauggcgucgugaaacuccugacaaagcccugggacgugaucccuauggucacucaaauugcuaugaccgauacaaccccauuugggcagcagcgcguuuucaaggagaaaguggacacuaggacgcccaaggcgaaacgaggaacagcccaaauaauggaaguaaccgcaaaguggcuaugggguuuucuuagccggaacaaaaagccgagaaucuguacuagggaggaguucacccgcaaggugcguucuaaugcugccauuggcgcagucuuuguggacgagaaccaguggaacucagccaaagaggcuguugaagaugagcgguucugggaccuggugcauagagaaagggagcuccacaagcaggggaaaugcgccacaugcgucuacaacaugaugggaaagcgcgagaagaagcugggcgaguuugguaaggcgaaagggagucgagcaaucugguacaugugguugggagcccgguuccuggaguucgaagcucucggcuuuaugaaugaggaucacugguucuccagagaaaacagccuuucuggcguggagggggagggacugcauaaguuagguuauauucugagggacaucucgaaaauaccuggcgggaauauguacgccgaugacacggcaggaugggauacccgcaucacugaagacgauuugcagaacgaggcuagaauuacagacaucauggaaccagagcacgcccuccuggcuaagucaauuuuuaaacuaaccuaucaaaauaagguaguucgggugcagaggcccgccaaaaacggcacugucauggaugugaucagccgucgagaccagcgcgguuccggacaggugggaacauacggccuuaauaccuucacaaacauggaagcacaacugauaagacagauggagagugagggcauauuuucuccuagcgaacucgagacuccaaaccuggcggaacgggucuuggauugguuagagaaguaugggguugaaaggcugaagcgcauggccaucuccggagacgacugugugguaaaacccaucgaugacagauucgcuaccgcccucacggcacuuaaugauauggguaaggugcggaaagacauuccgcagugggagccuucaaagggcuggaacgauuggcagcaaguccccuuuugcagucaucacuuccaccagcugauaaugaaagacgggagggagaucgugguuccaugucgaaaucaggaugagcuagugggacgugcuagagucucucagggcgccgguuggagccugcgcgagaccgcaugccucgggaaguccuacgcccaaauguggcaguugauguauuuucaucggagggaccugagacuugcggcuaacgccauuuguucagcagugccuguagauuggauccccacaagccgcacuaccuggucuauucacgcccaucaccaguggaugacaacugaagacaugcuguccguuuggaaucggguguggaucgaggaaaacccauggauggaggauaagacccauauaaguagcuggggagacguccccuaccucggcaaaagggaggaccaauggugcggcucguuaaucgggcugacggcucgagccacaugggcaaccaauauucagguggcuaucaaccagguuagacgguugauuggaaaugaaaacuaccuggauuauaugacuuccaugaagagguucaaaaaugagucugacccugaaggugcccucugguga

SEQ ID NO: 13888 - RNA, 9879 nt, Artificial Sequence
  derived and/or modified CDS sequence (opt3) from DENV-1__GU131708__SS-prME
agcgugaccaugcugcucaugcuuaugcccacagcccuggcuuuccacuugacuacgcggggcggggagccucauauggucguuuccaagcaggaaagaggaaaaucuuuacuguuuaagaccucagcgggugugaacaugugcacacuaaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacuacucaagacagaggugaccaacccugccauccugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuagcucguucaaacuggagaaggaagucgcugagacccagcacggaacggugcuuguucagauaaaguacgaggguacagacgcgccuugcaaaaucccauucucuacccaagaugaaaagggcgugacucagaacgggcgcuugauuacagcaaaucccaucguaaccgacaaagagaagccugucaacauagaagccgagccacccuuuggagaguccuauauugugaucggcgcuggugaaaaagcccugaagcucucaugguucaagaaagggaguagcaucggcaagauguuugaggcaacugccagaggagcuaggcggauggccauucugggcgauaccgcaugggacuucggguccaucggagguguuuuuacaucugugggcaaacuuguccaucagauuuucgggacggcguacggagugcuguuuagcggcguaucauggaccaugaagauagguuugggggugcuccugacuugguuaggccugaauagucgauccacaagccuaucuaugaccuguaucgcuguuggacucgucacacuguaccuuggcgugauggugcaggccgauucagggugcgucauuaacuggaaaggacgcgaauugaaguguggcagugguaucuucguuacuaaugaggugcacaccuggacggaacaauauaaguuucaggcagacagcccgaaaagacuguccgccgcuaucgggaaggccugggaggagggagugugcggcauuaggucugcaacacggcucgaaaacguaauguggaaacagauaucgaacgagcugaaucauaucuuacuggaaaacgacaugaaguucaccgucgugguuggugauguggcuggcauucuugcccaggggaaaaagaugauccgcccucaacccauggaguacaaauauagcuggaaguccuggggaaaggcgaaaauuaugggcgccgacguccagaauacuaccuuuaucauagaugggccaaacacaccugaaugucccgacgaucagagagcuuggaauaucugggagguggaggacuacggauucggcauuuuuacuaccaacaucugguugaagcucagggauucauauacacagguuugcgaccaccgucugaugagugcagccauuaaagauucuaaggcugugcacgccgacauggguuacuggaucgaaagcgagaaaaaugaaacguggaagcuagcacgggcguccuucauagagguaaagaccuguauuuggccaaaaucacauacucuguggagcaacgggguccucgaaucugagaugaucauucccaagaucuauggaggcccuauaucccaacacaauuaccgaccagguuacuucacacagaccgccggcccguggcaucuggggaaacuugaguuggauuuugaccugugcgaaggaacuacagugguggucgaugagcacugcggcaacagagggcccaguuuaaggaccacgacuguuaccggaaagaucauucacgaaugguguugccgcagcuguacacucccuccacugcgguucagaggcgaggacgguugcugguaugggauggagaucaggcccgugaaagaaaaggaggaaaaucuuguaaagucuaugguguccgcuggaucaggcgaggucgacaguuuuagccuggguuugcucuguauuucgaucaugauagaagaggugaugcgcucccgauggucucggaaaaugcugaugaccggcacucuagccguuuuccugcuccugauuauggggcagcuuacauggaacgauuugauccgucugugcaucauggugggagcaaaugcuagcgacagaaugggcauggggaccacauacuuagcccucauggcaacuuuuaagaugaggccuauguucgccgucggacugcuuuuucgccggcugaccucaagagaggugcuacuccugacgauuggcuugagucugguugcuuccguggaauuaccaaacucucucgaggaacugggugaugggcuugcgaugggaaucaugauucugaaauugcucacagacuuccaaagccaucagcugugggccacccuacugucccuuacuuuuauaaagaccacauucucacuccacuaugcauggaaaacuauggcuaugguccugagcaucguaaguuuguuuccccuguguuuaucuaccacgucccagaagacaaccuggcucccggugcugcuuggcagccugggcugcaagccuuugacuauguuccucauugccgagaauaaaaucugggggaggcgaucguggccacugaacgaaggaauuauggccguugguaucgugucaauacuacugucuagucuucucaagaacgaugucccccuggcuggcccuuugaucgcagggggaauguuaauugccuguuacgugaucuccggcagcucugcggaccugagccucgagaaagcugccgagguauccugggaagaggaagcagagcauucaggugccagucacaauauucugguggaaguccaggaugacgggacaaugaagaucaaagaugaggagcgcgacgauacccuuacuauacuguugaaggcuacacuacuggcaguuagcggaguguauccccucucuauuccagccacccuguuugugugguacuucuggcagaaaaagaagcagcgguccggcguccuuugggacacgccuucacccccagaaguggagagagcgguuuuagaugacggcaucuauaggaucaugcagcgugggcugcucggacgcagucagguaggugugggcgucuuccaagaaaacguguuucauacuauguggcacguuaccagaggggcuguguugauguaccagggaaaaagacuggagccgagcugggccuccgucaagaaagaccucauuucuuacggcgguggguggaggcugcagggaucguggaauacaggcgaggaagugcagguaauagcagucgagccuggcaagaaccccaaaaaugugcaaaccgccccagggacauucaagacucccgaaggagagguuggugcuaucgcccuugauuuuaagccuggcaccagcgggucaccaauugugaaccgagaaggaaaaaucgucggccuguaugguaauggggugguuacgacauccggaacuuacgugagugcaauugcucaggccaaggcgucucaggagggccccuugccugagaucgaagacgaggucuuccggaaacgcaaccuaaccauaauggaucugcacccgggcagcgggaagacaagaagguaucucccagccaucgugcgggaagcaauuaaacgaaaguuaagaacccugauccuugcucccacucgcguaguggccuccgagauggcugaagcacugaagggaaugccuauuagguaccaaaccacagccguuaaaucagagcauacggguaaggagaucgucgaccucaugugccacgccacuuuuaccaugcguuugcugucuccagugcgggugcccaauuauaacaugauaauuauggaugaagcucauuucacagacccuagcaguaucgcggcaagaggcuacaucuccaccagggucgggaugggagaggccgcugccauuuuuaugacugcaacaccgcccggcagcguagaagccuucccacagucuaaugcugugauccaggaugaggaacgcgacauaccugagcgaucauggaacuccgguuaugaguggauuaccgauuuucccgggaaaacgguuugguucgugccaaguaucaagagcggaaaugacauugcgaacugucucaggaaaaauggcaagcgggucauccagcugucgaggaagacuuuugauacagaauaccagaaaaccaagaacaacgacugggacuacgugguuaccacugauauaucugagaugggcgccaauuuccgcgcagaccgugugauugauccuagacggugccuuaaacccgucauccuaaaggacgggccagaaagggugauccuggcuggaccgaugccuguaacaguggccuccgcagcccagcgccgagguagaauuggccggaaccacaauaaagagggggaucaguauaucuacaugggacagcccuugaacaaugacgaggaucaugcucacuggaccgaagccaagauguuacuggacaacauuaauacaccagagggcauaauccccgcacucuucgaaccugagagggaaaagagcgcagccauugauggugaguaucgccugagaggggaggcuaggaaaacuuuuguugaacuuaugcggcguggcgaccugccagucuggcucucauacaagguggccagugagggauuccaauauucugaucgccgauggugcuuugacggcgaaagaaacaaucagguguuggaggaaaacauggaugucgagaucuggacgaaagagggggaaaggaagaaacugcggccccgcuggcuagacgcuagaaccuacuccgacccucuggcacucagggaguucaaggaauuugccgcuggacggcgaagcguuucaggugaucuuauccuggagauuggcaaauuaccgcagcacuugacacagagagcccaaaaugcacuggacaaccucgugaugcugcauaauagugaacaaggcgggcgcgcguauaggcacgccauggaggagcuuccagauacuauagaaacccugaugcucuuggcucugaucgccguauuaacagggggugugacccuauucuuucugagcgggcggggccucggaaagacuuccauuggccuucugugugucauggcaucuagcguguugcuguggauggcuuccguugagccccauuggaucgccgcaucaauuauccucgaguucuuucugauggugcuucucauaccugagcccgaccgucagagaacgccacaggauaaccaacuggccuacgucguaaucggguugcuguucaugauuuuaaccguggcugcgaaugagaugggacuacuggaaacaacuaagaaagaccucgguaucggccacgccgcaguugggaaccaccaucacgcugccaugcuugauguggaccugcauccugccucugcauggaccuuguacgcugucgccacaaccauuaucacucccaugaugaggcacacaauagagaacacgaccgcgaauauuagucugacugcuaucgccaaccaggcagccauucucaugggacuggauaagggcuggccaaucucgaaaauggacauaggugugccucuuuuagcucuggggugcuauagccaggucaauccgcucacauugaccgcagccgugcugaugcuaguugcgcauuacgcuaucauuggccccggacugcaagccaaggcaacccgcgaagcccagaaacggacagcugccggcaucaugaagaacccaacuguggaugggauuguagcaaucgaccucgauccuguggucuaugacgcuaaguuugagaaacagcuuggacagauaaugcuguugauucuguguacgucccaaauccuccugaugcgaaccacaugggccuuaugcgaaucuaucacucuugcgaccggcccccugacaacccucugggaggguucaccagggaaguucuggaauacuacgauugccguuagcauggcaaacaucuuuagaggauccuaccuagcuggcgccggucuggcauucaguuugaugaaaucucugggcgggggaaggcgcggcacaggggcucagggagagacccucggcgaaaaguggaaacggcagcuuaaucagcugagcaagucagaguucaacacuuauaagagauccgguauaauggaaguggaccguagugaggccaaagaaggguugaagaggggagagaccacaaaacacgccgucagccggggcacugcgaagcugcgcugguuuguggagcgaaaucucguaaaaccugaagguaaggugauugauuuaggcugugggagaggaggcuggucuuacuauugcgcugggcugaagaaaguuaccgaggugaagggauacacaaaaggcggucccgggcacgaagaaccgaucccaauggcaacguacggauggaaccuugucaagcugcauuccggcaaagacguguucuuuauuccucccgaaaagugugauacccuacucugcgacaucggcgagucaagcccaaaucccacuauagaggaagggaggacacugcgggucuugaaaaugguggagccuuggcugcgcggaaaccaauucuguaucaagauucucaauccguauaugcccucgguuguagaaacccuugagcagaugcagagaaagcacgguggcaugcuggugaggaacccauuaucucgaaauaguacucaugagauguacugggucuccugcgggacaggaaacaucgugagcgccguuaauaugaccucacggaugcuguugaaccguuuuacgauggcucacagaaaaccuaccuaugaacgcgauguggaccucggcgccgguacaaggcacgucgcaguggagcccgaaguagccaaccuggauauuaucgggcagcggauugagaauaucaagcaugaacacaaauccacuuggcauuacgacgaggauaacccuuauaagaccugggcuuaccacggaucuuaugaggugaaaccaagcggcagugcguccagcaugguuaauggcgucgugaagcuacuuacaaagcccugggacgugauaccuauggucacucaaauugccaugaccgauacaaccccauucgggcagcagagaguuuuuaaagaaaagguggacacucgcacgcccaaagcaaagaggggaacagcucaaaucauggagguaaccgccaaauggcugugggguuuccucucucgaaacaagaagccgcggaucuguacuagagaagaguuuaccaggaaagugcgcucaaaugcagccauuggcgcugucuucguggacgaaaaccaguggaauagugccaaggaggcgguugaggaugaacguuuuugggaccuggugcaucgggagagagaauugcacaaacaggggaagugcgcaacaugcgucuacaacaugaugggaaaaagggagaagaagcugggcgaguucgguaaagccaaggggucccgcgcuauaugguacauguggcucggagcccgauuucuugaguucgaggcacugggcuucaugaaugaagaucacugguuuagccgggagaacucuuuaucgggcguggaaggggagggacugcauaaauuggguuauauccucagagacauuucaaagaucccuggcgggaauauguacgcugaugacacggccggaugggauaccaggauuacugaggacgaucugcagaacgaagcucgcaucacagacauaauggagccagaacacgcccuacuugcaaaaagcaucuucaagcugaccuaucaaaauaaaguaguuagagugcagcggcccgcgaagaacggcacugucauggaugugauuuccaggcgugaccagcgagguaguggacaggugggaacauacggccucaauaccuuuacaaacauggaggcccaacugauccgccagauggaaucugagggcauuuucagcccuuccgaguuggaaacuccaaacuuagcugagagaguccuggauuggcucgaaaaguaugggguugagcggcuuaaaaggauggccaucucaggagacgacugugugguaaagcccauagaugaccgcuuugcaaccgcucugacggcccuaaaugauauggguaaagugagaaaggacauuccgcagugggaaccuaguaaaggcuggaacgauuggcagcaaguccccuucugcucucaucacuuucaccagcugaucaugaaggacgggcgggagaucgugguuccauguaggaaucaggaugagcucgugggacgagcacgugucagccagggcgccgguugguccuugagagaaaccgcgugccuggggaagucauacgcucaaauguggcagcuuauguauuuccaucgccgggaccugaggcucgccgcaaacgccauuuguagcgcugugccuguagauuggauacccacaucuagaacuaccugguccauccacgcccaucaccaguggaugacaacugaggacauguuaaguguuuggaaucgcguguggauugaagagaacccauggauggaagauaaaacccauaucagcucguggggagacguccccuaccugggcaagcgggaggaccaauggugcggcuccuugauugggcugacggcaagggcuacaugggccaccaauauccagguggcgauaaaccagguucgaagacucaucggaaaugagaacuaccuugauuauaugacuucuaugaaacgguuuaagaaugaaucagacccugagggugcucugugguga

SEQ ID NO: 13889 - RNA, 9879 nt, Artificial Sequence
  derived and/or modified CDS sequence (opt3) from DENV-1__GU131710__SS-prME
uccgugaccaugcugcucaugcuuaugcccaccgcccuggcuuuccacuugacuacgagaggaggggaaccucauaugaucgcauccaagcaggaaaggggaaaaucuuuacuguuuaagaccucagccggugucaauaugugcacgcuaauugcgauggaccucggagaacugugugaagauacuaugaccuacaaaugcccacggauaacagaaaccgaaccggacgauguugacuguuggugcaaugcuacugauacaugggugaccuaugggacguguagucaaacuggagagcaccgccgagacaagcguagcguagcccuugcaccccaugugggccuggguuuggagaccagaacagaaacuuggauguccucugagggggccuggaaacagauccagagggucgaaaccugggcucuccggcacccuggauucacagugauugcacuguuucuggcccaugcuaucggcaccucgauuacgcagaagggcaucauauucauccucuuaaugcugguuacuccaucaauggccaugcgcugcguggggauuggaagcagagauuuugucgagggucuuaguggcgcgacauggguggacguaguuuuggagcacggguccugugugaccacuauggcaaaggauaaacccacacuggacaucgaacuacucaagaccgaggucacgaacccugccgugcugaggaaacuuugcauugaagcuaagaucucuaauaccacaacugauagccgguguccaacccaaggagaggccacacugguggaagaacaggacgcaaacuucgucugccgccgaacuuuuguugauagaggcugggguaauggguguggauuguucggcaaaggcucccucauaaccugcgcuaaguuuaagugcgugacaaaacuggaggggaagauuguacaguacgaaaacuuaaaauauucagugaucgucaccgugcacacuggagaccagcaucaaguugguaaugagaguacggaacacggcacaaccgccacuauuacaccccaggcgccuacaaccgagauccagcugacugacuacggggcccucacacuugauuguagcccaaggacgggacuggacuucaacgaaaugguguugcuaaccaugaaggagaaaucuuggcugguccauaagcagugguuucucgaucugccgcuucccuggacuuccggcgcaucaacaagccaagagaccuggaaucggcaggaccuguuggugacauucaaaacugcucacgccaagaagcaggaaguaguugugcucgguagucaagagggggcuaugcacaccgcccugacgggcgcaaccgaaauccagacaucuggaacuaccacaauuuuugccggccauuuaaaaugccgucugaagauggauaaacuaacucucaaggggauguccuaugucauguguaccgguagcuucaaacuggagaaggaaguggcugagacgcagcacggaacaguccuugugcagauaaaguacgagggcaccgacgcgccuugcaaaaucccauucucgacucaagaugaaaaggggguuacacagaacggacgcuugauuaccgcaaaucccaucgugacugacaaagagaagccuguaaacauagaagccgagccacccuuuggcgagucuuauauugucaucggugcuggggaaaaagcccugaagcucuccugguucaagaaaggcucaaguaucggaaagauguuugaggcaaccgccagaggcgcuaggcggauggccauucugggggauacagcaugggacuucggaagcaucgguggcguguuuacguccguugggaaacuugugcaucagauuuucggaaccgcguacggcguccuguuuucuggugugagcuggacuaugaagauagggaucggcguauugcucacauggcugggauuaaauucacgaaguaccucccugagcaugacauguauugcugugggccuaaucacucucuaccuggggguuaugguccaggccgauucuggaugcgugaucaacuggaaaggccgcgaacuuaagugugguucagggauuuucgugaccaaugagguccacacguggacagaacaauauaaguuucaggcagacaguccgaaaagauugagcgccgcuauaggaaaggccugggaggagggcguuugcgguaucagguccgcaacccggcuggaaaacauuauguggaaacagaucucuaacgagcucaaucauauucuguuagaaaacgacaugaaguucacuguggugguaggcgaugucgcugggauccuggcccagggcaagaagaugauacgcccucaacccauggaguacaaauauucguggaaaagcuggggcaaggcgaagaucauuggggccgacgugcagaauaccacauuuaucauugauggaccaaacacuccugaaugucccgacgaucagagagcuuggaauaucugggagguugaggacuacggcuucgguauauuuaccacaaacauuuggcuuaaguugagggauuccuauacacaggugugcgaccaccgucucaugucagcagccaucaaagauaguaaggcuguccacgccgacaugggguacuggauugaaucugagaaaaaugaaaccuggaagcuggcacgggcgagcuucaucgaggugaagacuuguauauggccaaaaucccauacacuauggucaaacggaguucuggaaagcgagaugaucauucccaagaucuauggcgguccuauuucucaacacaauuaccgaccaggcuacuucacccaggccgcugggccguggcaucucggaaaacuggagcuugauuuugacuugugcgaaggcacuacagugguagucgaugagcacugcgggaacagaggacccucccugaggaccacgacugugaccggcaagaucauacacgaaugguguugccgcaguuguacauuaccuccacuccgguucagaggugaggacgggugcugguauggaauggagauuaggcccgugaaagaaaaggaggaaaaucuggucaagagcaugguuucugccggcuccggugagguggacucauuuagucuuggccuguuguguaucagcaucaugauugaagagguaaugcgcucgcgauggucccggcguaugcucaugaccgggacucuggcaguguucuuucuacugaucaugggacagcucacauggaacgaucugauuagacuuugcauaauggucggcgcuaaugccucugacaggauggggaugggaaccacauacuuggcacugauggccacuuucaaaaugcgcccuauguuugcugugggcuuacucuuccggagacugaccagcagggagguucuucugcuaacgaucggucucucacugguggcgagugucgaauugccaaacucccuggaggaauuaggggauggacucgccaugggcauuaugauccugaaacuucugacagacuuucaaucucaucaguugugggcaacccuccugagccuaacuuucauuaaaaccacauuuucccugcacuaugcuuggaagacuauggccauggugcuuucaaucguuagccucuucccccuguguuugaguaccacgucucagaaaacaaccuggcugccgguguuacucggcucccuggggugcaagccucuuacuauguuucugauagccgagaauaagaucuggggacgacgcagcuggccauugaacgaagguauuauggcugucggcaucguaucgauucuccugucaucucuacugaaaaacgaugugccccuugcagggccucucaucgccggaggcaugcugauagcguguuacguuauuagugguuccagcgcugacuugucuuuagagaaggccgcagaggugagcugggaagaggaagccgagcauuccggggcuucacacaauauccuggucgaagugcaggaugacggaacaaugaaaaucaaggaugaggagcgggacgauacccucacuauucugcuuaaagcaacacuguuggccguaaguggcguguauccccuaagcauaccagcgacccuguucgucugguacuucuggcaaagaaagaaacagaggucuggcguucucugggacacgccuucacccccagaaguggagcgugcugugcuggaugacgggaucuaucgcauuaugcagcggggacuuuuagguagaagccaggucggcguggggguuuuucaagaaaacguauuccauacuauguggcacgugaccaggggagccguccugauguaccagggcaagcgacucgagccgaguugggcaagcgugaagaaagacuugaucuccuacggugggggauggcggcugcagggcucuuggaauacaggcgaggaaguucaggugauugccgucgagccugggaagaaccccaaaaaugugcaaaccgcuccaggaacauuuaagacucccgaaggugagguaggcgccaucgcacucgauuucaaaccugggaccucgggaagcccaauagucaaccgcgaaggcaagaucgugggucuguaugggaauggaguugugacgacaucaggcacuuacgucuccgcuauugcccaggcgaaggccagucaggagggcccccuuccugagaucgaagacgagguguuuagaaaaaggaaccugaccauuauggauuugcacccggggucuggaaagacacggcgauaucuaccagcaaucguuagagaagcuauaaaacgcaagcugaggacccucauuuuagcccccacucguguggucgcuagcgagauggcagaagcccugaaagguaugccuauccgguaccaaaccacagccgugaaguccgagcauacgggcaaggagaucguagaccuuaugugccacgcuacuuucaccaugagacugcucucaccagugaggguucccaauuauaacaugauuaucauggaugaagcgcauuuuacagacccuucuagcauagcagcccgcggguacauuaguacccgagucggaaugggcgaggcugccgcaaucuucaugacugccacaccgcccgguuccguggaggcuuuuccacagagcaaugcggugauucaggaugaggaaagagacaucccugagcggucuuggaacucaggguaugaguggauaaccgauuuccccggaaaaacggucugguuuguaccauccauuaagaguggcaaugacaucgccaacuguuugaggaaaaauggcaagcgcgugauccagcugagccguaaaacuuucgauacagaauaccaaaagaccaagaacaacgacugggacuacguugugaccacugauauuucggagaugggggcaaauuucagagcugaccgggucaucgauccuaggcgcugccucaaacccgugauucugaaggacggaccagaacgaguuauacuugccgguccgaugccugugacagucgcaucugccgcucagagacggggcaggaucgggcgcaaccacaauaaagagggagaucaguauauuuacaugggccagccccuaaacaaugacgaggaucaugcccacuggaccgaagcgaagaugcuguuggacaacaucaauacaccagaggguaucauucccgcauuauuugaaccugagagagaaaaauccgccgcuauagauggggaguauaggcugcggggcgaggcccguaagacuuucguggaacucaugcgccgaggagaccugccaguauggcuuagcuacaagguggcuucagagggcuuucaauauagugauagaagguggugcuucgacggggaacggaacaaucagguucuggaggaaaacauggaugucgagaucuggacgaaagagggagaacgcaagaaacucagacccaggugguuggacgcacggaccuacucugacccucuggcccuacgagaguuuaaggaguucgcugccgguagacgcuccgugagcggcgaucugauucucgagaucgggaaacuuccgcagcaccugacacagagggcacaaaaugcguuagacaacuuggugaugcugcauaauucagaacagggaggccgggccuaucgucacgcuauggaggagcucccagauacuauugaaacccugaugcuucuggcccucaucgcagucuugacaggugggguuacccuguuuuucuuaaguggcagaggacuaggcaagacuagcauagggcugcucugugugauggcuuccucuguacuucuguggauggccagcguggagccccauuggaucgcagccuccauuaucuuggaauuuuuccugaugguccuccugauuccugagcccgacaggcagcgcacgccacaggauaaccaacuugcuuacgugguuaucggacuccuguuuaugauauugaccguggcggccaaugagaugggucuguuagaaacaacuaaaaaggaccuaggcauugggcacgucgcaguagagaaccaccaucacgcugccaugcuggauguggaccuccauccugccucagcauggacccuuuacgcuguugccacaaccaucauuacucccaugaugcggcacacaaucgaaaacacgaccgcgaauauaucucugacugcuaucgccaaccaggcagccauuuugaugggacuggauaagggcuggccaaucaguaaaauggacauuggugugccucuccuggcucuugggugcuauucgcaggucaauccguuaacacugaccgcagccgugcucauguuggucgcgcauuacgcuaucauaggccccggacugcaagccaaggcaacccgagaggcccagaaaagaacagcugccggcauuaugaagaacccaacuguggaugggaucguugcaaucgaccuagauccugugguauaugacgcuaaauucgaaaagcagcugggacagauuaugcuccuuauccuguguacgagccaaauauugcugaugaggaccacaugggcccucugcgaguccauuacucuggcgaccggccccuuaacaacccuuugggaggguucuccagggaaguuuuggaauacuacgaucgccgugucaauggcaaacauuuuccgcggaagcuaccuggcuggcgccggucucgcauucucccuaaugaaaagucugggcgggggacggagaggcacaggggcucagggagaaaccuugggcgagaaguggaaacgucagcugaaucagcucucuaagagcgaauuuaacacuuauaaaaggucagguaucauggaggucgaccgguccgaagccaaggaggggcuuaagcgcggagagaccacaaaacacgccguuagucgaggcacugcgaagcugagaugguucguggaaaggaauuuggucaaaccugaggguaaggugauagaucugggcugugggcggggaggcuggagcuacuauugcgcugggcucaaaaagguaaccgaagugaagggauacacaaaaggcggucccgggcacgaggaaccgaucccaauggcaacguacggauggaacuuaguuaagcugcauucuggcaaagacguguuuuucauuccucccgagaagugugauacccuucugugcgacaucggcgaguccucaccaaaucccacuauugaagaggggcgcacacuaagaguccucaaaaugguggaaccuuggcugaggggaaaccaauuuuguaucaagauuuugaauccguauaugcccagcgucguggagacccuggagcagaugcagcgaaaacacgguggcaugcucguucggaacccacuuucgcguaauucuacucaugaaauguacuggguaaguugcgggacaggaaacaucguguccgccgucaauaugaccagcagaaugcuguuaaaccgcuucacgauggcucacaggaagccuaccuaugagcgggauguggaccugggcgccgguacaagacacguugcaguggaacccgaggucgccaacuuggauauaauugggcagcgcaucgaaaauaucaagcaugagcacaaaucaacuuggcauuacgacgaggauaacccuuauaagaccugggcuuaccacggauccuaugaagugaaaccaucuggcagcgcgaguuccaugguaaauggcgugguuaagcuccugacaaaacccugggacgucauuccuauggugacucaaauagccaugaccgauacaaccccauuugggcagcagaggguguucaaggagaaggucgacacucgaacgcccaaagcaaagcggggaacagcucaaaucauggaaguuaccgccaaauggcuaugggguuuucuuagcagaaacaagaaaccgaggauuuguacucgcgaggaguucacccguaaggugcggucuaaugcagccaucggcgcuguauuuguggacgagaaccaguggaacucagccaaggaggcggucgaagaugagagauucugggaccuggugcauagggaacgcgagcuccacaaacaggggaagugcgcaacaugcguuuacaacaugaugggaaaacgagaaaagaaacugggcgaguuugguaaggccaaggggagucgggcuauuugguacaugugguugggagccagauuccuggaguucgaagcacucggcuuuaugaaugaggaucacugguucuccagggaaaacagccuuucuggcguggagggggagggacugcauaaauuagguuauauccugcgcgacauaucgaagaucccuggcgggaauauguacgcugaugacacggccggaugggauaccagaauuacugaagacgauuugcagaacgaggcucggaucacagacauuauggaaccagagcacgcccuccuggcaaaaucaaucuuuaagcuaaccuaucaaaauaaagucgugaggguacagcgucccgcgaagaacggcacuguuauggaugugauaagccgacgcgaccagagagguuccgggcaggucggaacauacggccuuaauaccuucacaaacauggaagcccaacugauucggcagauggagagugagggcaucuuuucuccuagcgaacucgagacuccaaaccuggcugaaaggguguuggauugguuagagaaauaugggguggaacgccugaagagaauggccaucuccggagacgacugugucguuaagcccauugaugaccgguucgcaaccgcucucacggcccuuaaugauauggguaaagugaggaaggacauaccgcagugggagccuucaaaaggcuggaacgauuggcagcaaguacccuuuugcagucaucacuuccaccagcugaucaugaaggacgggcgagagauuguggucccaugucguaaucaggaugagcuagugggcagagcacgcguuucucagggcgccgguuggagccugcgggagaccgcgugccucgggaaauccuacgcucaaauguggcaguugauguauuuucauaggagagaccugcgccuugccgcaaacgccaucuguucagcugugccugucgauuggauucccacaagccggacuaccuggucuauccacgcccaucaccaguggaugacaacugaagacaugcuguccguguggaauaggguauggauagaggaaaacccauggauggaggauaagacccauaucaguagcuggggagacguucccuaccucggcaagcgagaggaccaauggugcggcucguuaauugggcugacggcaagagcuacaugggccaccaauauccagguggcgauuaaccagguccggagguugaucggaaaugaaaacuaccuggauuauaugacuuccaugaaacgcuucaagaaugagucugacccugaaggugcucucugguga

SEQ ID NO: 13890 - RNA, 9879 nt, Artificial Sequence
  derived and/or modified CDS sequence (opt3) from DENV-1__GU131717__SS-prME
agcgugaccaugcugcuaaugcuuaugcccacagcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccgauccugccgugcucaggaaacugugcauugaagcuaagaucucuaacacgaccacagacagccgguguccaacucaaggagaggccacccuugucgaagaacaagaugcaaauuuuguuugccgccgaacauucguggacagaggcugggguaacggguguggacuguuuggcaaaggcuccuugaugacuugcgcuaaguucaagugcguaaccaaacucgaggggaagauagugcaguacgaaaaucugaaauauucagucauugugacaguucacaccggagaccagcaucaaguggguaacgagaguacugaacacggcacgacagccaccaucacuccccaggcgccuagcaccgagauucaguuaacagauuacggggcccugacccucgacuguucuccaaggacuggacuugauuuuaaugaaaugguccuguugacaaugaaggagaaauccuggcuagugcauaagcagugguuccuggaccucccgcugcccuggacgucaggcgcaagcaccagucaagagacuuggaaccggaaagaucuucugguaacauuuaagaccgcucacgccaagaaacaggaaguuguggucuuggguucucaggagggggcuaugcacacagcccucacuggcgcaaccgaaauccaaacguccggaaccacaacuaucuucgccggccaucugaagugccguuuaaaaauggacaagcugacccuaaaagggaugagcuaugugauguguacaggaucguucaagcucgagaaggaagucgcugagacucagcacgguaccgugcugguucagauuaaauacgagggcacggaugcgccuugcaagauaccauuuucuacacaggacgaaaaaggggugacccaaaauggacgccuuaucacugcaaaccccauuguaacagauaaggagaaaccugucaauaucgaagccgagccacccuucggcgaguccuauauagugauuggugcuggggaaaagaccuugaagcugucaugguuuaaaaagggcaguagcaucggaaaaauguucgaggccacugcaagaggcgccaggcggauggcuauccucggggacaccgccugggauuuuggauccauugguggcguuuucacaucuguggggaagcugguccaucagaucuuuggaacggcauacggcgugcuuuucagcgguguaucauggaccaugaaaauugggauaggcgugcuguugacuuggcucggacugaacagucgauccaccagcuuaucuaugacauguaucgcgguuggccuggucacacuauaccucggggugauggugcaggcugacucaggaugcgucauuaauuggaagggccgcgaacugaagugugguagugggaucuuuguuacuaacgaggugcacaccuggacggaacaguauaaauuccaagccgacagcccgaagagacuuuccgcagccaucggaaaggcuugggaggagggcgugugcgguauuaggucugccacacgguuggaaaauauaauguggaagcagaucucgaacgagcugaaccauauucuccuggaaaaugauaugaaauuuaccguagucgugggcgacguugcagggaucuuagcucagggaaagaaaaugauucgcccucagcccauggaguacaaguauagcuggaaguccuggggcaaagccaagaucauaggggcggaugugcaaaacacuaccuucaucauugacggaccaaauacaccugaaugucccgaugaccagagagccuggaacaucugggaggucgaggauuacggcuuugguauuuucacuaccaauaucuggcugaaacuuagggacucauauacacaggugugcgaucaccguuugaugagugcugcaauaaaggacucuaaagccguucacgcugauaugggguacuggauugaaagcgagaagaacgaaacguggaagcucgcccgggcauccuucaucgaggugaaaaccuguauuuggccaaagucacauacucuguggagcaauggaguacuagaaucugagaugaucauacccaaaaucuauggcgguccuauuucccagcacaacuaccgaccaggcuacuuuacacaaaccgcggggccguggcaucugggaaagcucgagcuggacuucgaucuuugcgaaggcacuacagucgugguggacgagcacugcgggaauagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaccucgugaagucuaugguauccgccggcucaggugagguggauaguuucagccugggccuucuguguauaucgauuaugaucgaagaggucaugaggucccgcuggucucgaaaaauguugaugaccgggacucucgcuguguuuuuccugcuaaucaugggacagcugacauggaaugaccucauucggcugugcaucaugguuggcgccaacgcaagcgaucguauggggaugggaaccacauaccuugcuuugauggccacuuuuaagaugagaccuauguucgcagugggccuguuauuuaggcgccucaccucacgggagguccugcuucugacgauuggucuaagucucguggccuccguugaacugccaaauucuuuggaggaacugggggacggauuagcuaugggcauaaugauccucaaacugcuuacagauuuccagagccaucaacugugggcgaccuugcucucccugacuuuuauuaagaccacauucucacuacacuaugccuggaagacuauggcaauggugcugagcaucgucagucuuuuuccccucugucugucuaccacgucccagaaaacaaccugguugccgguacuguuaggcagccucgggugcaagccucugacuauguuccuuauugcugagaacaaaaucuggggaagaaagucguggccacugaaugaagguauaauggccgugggcaucguuucaauuuugcucucugcccugcucaagaaugacgugccccuggcugggccucuuaucgcaggaggcaugcucauugccuguuacgucaucagugguuccagcgcggaucugucuuuggagaaggcugccgaggugagcugggaagaggaagcagagcauuccggggccucacacaacauauuaguagaagugcaggacgauggaacaaugaaaauuaaggacgaggagagggaugacacccugacuauccuccugaaggcuacacuucuggcagucaguggcguuuaucccuugagcaucccagccacccuauucgugugguacuuuuggcagaaaaagaaacaacgaucuggcgugcugugggauacgccuucacccccagaagucgagcgcgcggugcucgacgacgggauuuaucggauaaugcagagaggacugcuugguaggagccagguuggcguagggguguuccaggaaaaugucuuucauacuauguggcacgugacccguggagcuguuuuaaugcaccaaggcaagcgccuggagccgaguugggccagcgugaaaaaggaucucaucuccuacggugggggauggcgguugcagggcucuuggaacacaggcgaggaaguccaggugauugcaguagagccugggaagaaucccaaaaacguccagaccgccccaggaacauucaagacuucggaaggugaggugggcgcuaucgcccuggacuuuaaacccgggaccagcggaucaccuauuguuaauagagaaggcaagaucgugggucucuacgggaacggagucgugacgacauccggcacuuauguuagugcaauagcucaagccaaagcgucucaggagggcccacugcccgagaucgaagaugagguguucaggaagcgaaaucuuaccauuauggaccugcauccugggagcggaaagacacggcgcuacuugccggccaucgucagagaagcaauuaaaaggaagcuacggacccugauccucgcuccaacucgagugguagccuccgagauggcugaagcauuaaaagguaugcccauaagauaucagaccacagccgugaagucagagcacacgggcaaagagauuguugaucugaugugccaugccacuuuuaccaugcgccuucugucuccugucagggugccaaacuacaauaugaucaucauggacgaagcucacuucacagaucccagcaguauugcggcacguggguauaucuccacccgggugggaaugggcgaggccgcugccauauuuaugacugcaacaccuccggguagcgucgaagccuucccccaaucuaacgcuguaauucaggacgaggaaagagauaucccagagaggucauggaacuccggguacgaguggauuaccgacuuuccuggaaagacggugugguucguucccaguaucaagagcggcaacgauauagcgaauugucuccgcaaaaacggcaagcgagugauucaguugucgagaaaaacuuucgacacagaauaucagaagaccaaaaauaacgacugggauuacgucgugaccacugacaucucugagaugggggccaacuuucgggcagauaggguuaucgacccacgccguugccugaagccugugauucucaaggauggacccgaaagagucauccuggcugguccaaugccggugacaguagccuccgcagcccaacggaggggccgcauugggcgaaaucauaacaaagagggagaccaguacauauauaugggccagccucuuaauaacgaugaggaccacgcucacuggaccgaagccaagaugcuacuggauaauaucaacacacccgaggguauuaucccagcguuguucgaacccgagagagagaaauccgcagccaucgacggggaguaccgguuaaggggcgaggcucgcaagacuuuuguggaacugaugagaaggggagaucucccuguuuggcugucauauaaagucgccagugagggcuuccaguacucugaccggcguuggugcuuugauggggaacgcaauaaccaagugcuugaggaaaauauggacguggagauuuggacgaaggagggagaacgaaagaaacugagaccaagguggcucgacgcucggaccuauuccgaucccuuggcacugcgcgaguucaaagaauuugccgcugguagaaggagcgucucaggcgaccuaauacuggagaucgggaaacucccucagcaucuuacacagcgggcccagaacgcacuggauaauuuaguuauguugcacaacagugaacaaggaggccgagcguacagacaugccauggaggagcugccggacacuauugaaacccucaugcugcuugcucugaucgccgugcucacaggugggguaaccuuguucuuucugagcggccgcggauuaggcaagacuuccauugggcuacugugugugauggcaucuagcguccuccuuuggauggcuuccguggagccacacuggaucgccgcaucaauaauccuggaguucuuuuugaugguucugcucauucccgagccugauaggcagcggacgccccaggacaaucagcuggccuauguggucaucggacuucucuucaugauucugaccguagcugcgaacgagauggguuugcuggaaacaacuaaaaaggauuuaggcaucgggcacguggccguugagaaucaucaccaugcagcuaugcuagacguggaucugcacccagccucugccuggacccucuacgcagucgcuacaaccauaauuacuccuaugaugcgucauacaaucgaaaacacgaccgccaacauuagucuuacugcgaucgcuaaucaagccgcaauacugaugggauuggacaaaggcuggcccaucucgaagauggauauuggugugccacugcucgcccuggggugcuacagccaggucaacccucuuacauuaaccgcugcagugcugaugcucguugcccacuaugcgaucauuggcccgggauugcaggcuaaggccaccagagaggcacagaaaaggacagccgcuggcaucaugaagaaucccacuguggacgggauaguagccauugaucuggacccaguggucuacgacgcaaaauuugaaaagcagcuaggacagaucaugcugcucauccuuuguacgucccagauucuguugaugcgcaccacaugggcucugugcgagucuaucacucucgccaccggcccucugacaaccuuaugggaggguucacccgggaaauucuggaacacuacgauagcgguuagcauggccaauauuuuccggggauccuaucuugcaggcgcuggucuggccuuuagucucaugaagucucuaggcgggggacgaagaggcacaggggcacaaggagaaacccugggcgagaaguggaaaaggcaguugaaccagcugagcaagucagaguucaauacuuacaaacgcuccgguaucauggagguggaucggagugaagcuaaggaggggcucaaaagaggagagaccacaaagcacgccgucagccguggcacugccaaacuuaggugguuuguggaacggaaccugguaaaaccagaggguaaggugauugacuugggcugugggcgcggaggcuggucuuauuacugcgcggggcugaaaaagguuaccgaagugaaaggauauacaaagggcgguccugggcaugaggaacccaucccgauggcuacguacggauggaaucucgucaaauuacacuccggcaaggauguguucuuuauaccaccugagaagugugacacccugcuuugcgauaucggcgagucaagccccaacccaacuauugaagaggggcgaacacugagaguccuaaaaaugguggaacccuggcucaggggaaaucaguucuguaucaagauucugaacccuuacaugccgucgguuguagagaccuuggagcaaaugcagcggaaacaugguggcaugcuggugcgcaauccccucucuagaaacaguacucacgaaauguauugggucuccugcgggacaggaaauaucgugagcgcaguuaacaugaccucaaggaugcuucugaaucgauuuacgauggcccaccggaagccaaccuacgagcgugacguggauuuaggcgcugguacaagacaugucgccguggaaccugagguagcaaaccuggacauuaucgggcagcgcauagaaaacauuaaacacgagcauaaguccacuuggcacuaugaugaggacaaucccuacaagaccugggccuaucauggaucuuacgaagugaaaccuagcggcagugcuuccagcaugguuaacggcgucgugaaguugcucacaaaaccaugggaugugauccccauggucacucagaucgcgaugaccgacacaaccccuuucgggcaacagaggguuuuuaaggagaaaguggacacucggacgccaaaggccaagagaggaacagcacagauuauggaaguaaccgcuaaauggcugugggguuuccuaucucgcaauaagaaacccaggauauguacucgagaggaauuuacccggaaggugagaucaaacgccgcaaucggcgccgucuucguggaugagaaucaauggaacagugcuaaagaggccguugaagacgagagguuuugggaucuugugcaccgcgaacgugagcugcacaagcaggggaagugcgcgacaugcgucuauaauaugaugggaaaacgggaaaagaaacucggcgaguucgguaaggcaaaaggguccagagccauuugguacauguggcugggagcuagguucuuggaguuugaagcccugggcuucaugaacgaggaccauugguuuagccgcgaaaauucucucucgggcguggagggggagggacuucacaagcuggguuacaucuuacgagauauuucaaaaaucccgggcgggaacauguaugcagacgauacggcuggaugggacacccggauaacugaagaugaccugcagaaugaggccaagaucacagauauuauggaaccugagcaugcuuugcucgccaagagcaucuucaaacugaccuaccagaacaagguaguuagagugcaaaggccagccaaaaauggcacugucauggacgugauuucccgcagagaucagcgggguaguggacaggugggaacauauggccuaaacaccuuuacaaauauggaagcgcagcuuaucaggcaaauggagucugagggcauauucagccccuccgaacuggagacuccuaaccucgccgggcguguccuggacugguuggaaaagcacggaguugagcgauuaaaacgcauggcuauuucaggugacgauugugugguaaagccaaucgacgauagauuugccgcagcucugaccgcccucaacgacaugggcaaggugcggaaagauaucccccagugggaaccgaguaagggguggaaugacuggcagcaggucccuuucugcucucaccauuuucaccaacuuauuaugaaagauggaagggagauagugguucccugucgcaaccaggacgagcuggugggcagagcacgggucagccagggugccggguggucccuaagggaaacggcgugccugggaaagucauacgcucagauguggcaacucauguauuuccaucgacgugauuugagacuggccgcaaaugccaucuguagcgcugugccaguagacuggguuccuaccucucgcacaacuugguccauucacgcccaucaccaguggaugaccacagaggauaugcuuaguguguggaaccgggucuggaucgaagagaaucccuggauggaagacaaaacucacauuagcucguggggcgacgugccauaccugggcaagagggaggaucaguggugcgggucccucaucggauuaaccgcaagagcuacgugggccacaaacauacaaguugcgaucaaucaggugcgccggcugauugguaacgagaauuauuuggacuacaugaccucuaugaagagguuuaaaaacgaaucagaucccgagggcgcucugugguga

SEQ ID NO: 13891 - RNA, 9879 nt, Artificial Sequence
  derived and/or modified CDS sequence (opt3) from DENV-1__GU131718__SS-prME
agcgugaccaugcugcucaugcuuaugcccacagcccuggcuuuccacuugacuacgagaggaggggagccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaauugaacacggcacgacagccaccaucacuccccaggcgccuaccagugagauccagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugucauguguacagguagcuucaaacuggagaaggaaguggcugagacucagcacggaaccguccuugugcagaucaaguacgagggcacggacgcgccuugcaaaauuccauucucgacacaagaugaaaaggggguuacccagaacggacgcuugaucacugcaaaucccauagugauugacaaagagaagccuguaaacaucgaagccgagccacccuuuggcgagucuuauaucgucauuggugcuggggaaaaagcccugaagcucuccugguucaagaaaggcucaaguaucggaaagauguuugaggcaacagccagaggcgcuaggcggauggccauucugggggauaccgcaugggacuucggaagcauagguggcguguuuacuuccaucgggaaacuuguucaucagauuuucggaaccgcguacggcgugcuguuuucuggugucagcuggacaaugaagaucgggaucggcguguugcucacguggcugggauuaaauucacgaaguaccucccugagcaugacuuguauugcuguaggccuagugacacucuaccuggggguuaugguccaggccgauucuggaugcgugauaaacuggaaaggccgcgaacuuaagugugguucagggaucuucgugaccaaugagguccacacauggacugaacaauauaaguuucaggcagacaguccgaaaagauugagcgccgcuauuggaaaggccugggaggagggcguuugcgguaucagguccgcaacccggcuggaaaacauuauguggaaacagaucucuaacgagcucaaucauauacuguuagaaaacgacaugaaguucacgguggugguaggcgaugucguggggauccuggcucagggcaagaagaugauucgcccucaacccauggagcacaaauacucguggaaaagcuggggcaaggccaaaaucauuggggcggacguucagaauacaaccuuuaucauagauggaccaaacacuccugaaugucccgacgaucagagagccuggaauauuugggagguggaggacuauggcuucgguaucuuuaccacaaacauuuggcuuaagaugagggauuccuacacucaggucugcgaccaccguuugaugucagcugcaaucaaagauaguaaggccgugcaugcugacaugggguauuggauagaaucugagaaaaaugaaaccuggaagcucgcccgggcauccuucaucgagguuaagacauguauuuggccaaaaucccacacgcuguggucaaacggagugcuagaaagcgagaugaucauucccaagaucuacggcgguccuauaucucaacauaauuaucgaccaggcuacuucacccagacugcggggccguggcaccugggaaaacucgagcuggauuuugaccuuugcgaaggcacaaccguagucguggaugagcacugcgggaacagaggacccuccuugaggacuacaaccgugacgggcaagauuauccaugaaugguguugccgcaguuguacucugccuccauuacgguucaaaggugaggacgggugcugguacggaauggagaucagacccgucaaggaaaaggaggaaaaucucguuaaaagcauggugucugccggcuccggugagguagacucauuuagucugggccuucuguguauuagcaucaugauugaagaggugaugaggucgcgcuggucccgaaagauguugaugaccgggacacucgcugucuuccugcuacugauaaugggacagcucaccuggaacgaucugauccggcuuugcauuauggugggcgccaaugcaucugaccguauggggaugggaacuacauauuuggcucugauggccaccuuuaaaaugagaccuauguucgcaguuggcuuacucuuuaggcgccugacaagccgggaggugcuucugcuaacuaucggucucucacuggucgccaguguggaauugccaaacucccuggaggaauuaggggauggacucgcuaugggcauuaugauccugaaacuucugaccgacuuccaaucucaccaguugugggcgacgcuccugagccuaacauuuauaaaaaccacucugucccuucauuacgccuggaagaccauggcaaugguucucucaaucgugagccugauucccuugugucugaguacaacuucucagaagaccacgugguuaccgguccuccugggcucccuugggugcaaaccucugacaauguucuugaucgcugagaauaagauuuggggaagaaaaagcuggccacucaacgaagguaucauggccguaggcgugguuucgauacugcuaucaucucugcuuaagaacgaugugccccucgccgggccucugauugcuggaggcauguugaucgcauguuaugucaucagugguuccagcgccgacuuaucucuggagaaagcggcugaggugagcugggaagaggaagccgagcacuccggggcaucacauaauauucucguagaagugcaggaugacggaaccaugaagauaaaagaugaggagagggacgauacucugacaauccuucugaaggccaccuugcuagcugucaguggcguuuacccccugagcauuccagcaacucucuuugugugguauuucuggcaaaagaaaaagcagcgaucuggcgugcugugggacacaccuucacccccagaagucgagcgcgccgugcuugaugacgggaucuaccggauuaugcagagaggauuacuggguaggagccagguuggcguagggguguuucaagaaaacgucuuccacaccauguggcacgugacgcguggagcgguucucauguaucagggcaaacgcuuggagccgaguugggcuagcgugaagaaagaccugaucuccuacggugggggauggcggcuccagggcucuuggaauacuggcgaggaaguccaggugauagccguagagccugggaagaaccccaagaauguccaaaccgcaccaggaacauucaaaacccccgaaggugaggugggcgccaucgcucuggauuuuaagccugggacaucgggaagcccaauuguuaacagagaaggcaaaaucgugggucuuuacgggaauggagucgugacuaccucaggcacguauguuuccgccauugcacaggcuaaggccagucaggagggcccccugccugagaucgaagacgagguguucaggaaacgaaacuugacaauaauggaucuacauccggggucuggaaagacucggcgcuaccugccagcgauugucagagaagccaucaagaggaaacuccggaccuuaauccuggcacccacacgagugguagcuagcgagauggccgaagcucuuaaggguaugccuauuagauaucaaaccacugcagugaaauccgagcacaccggcaaggagaucguugaccugaugugccaugccacauuuacgaugcgccucuugucaccagucagggugcccaauuacaacaugauaauuauggaugaagcccacuucacugacccuucuagcaucgcugcgcguggguauauuaguacccgggugggaaugggcgaggcagccgcuaucuuuaugacagccaccccgcccgguuccgucgaagcauucccacagagcaaugccguaauacaggaugaggaaagagacauuccugagaggucuuggaacucaggguacgaguggaucacugauuuucccggaaaaacagugugguucguuccauccaucaagaguggcaaugacauugcuaacugucugcgcaagaauggcaaacgagugauccagcucagcagaaagaccuuugauacggaauaucagaagacuaagaacaacgacugggacuacgucgugacaaccgauauuucggagaugggggcgaauuuccgggccgacaggguuauagauccucgccguugccugaaacccgugauccuuaaggacggaccagaaagagucauucuagcagguccgaugccugugaccguagcuucugccgcacagcggaggggccgcaucgggcgaaaccauaauaaggagggagaucaguacaucuauaugggccagccccugaacaaugacgaggaucacgcccacuggacugaagcuaaaauguuguuagacaacauuaauacaccagaggguauaauccccgcccuguuugaaccugagagagaaaaguccgcggcaauugauggggaguaccggcucaggggcgaggcccgcaaaaccuucguggaacugaugagaaggggagaccuuccaguuuggcugagcuauaaggucgcuucagagggcuuccaauacagugaucggcguuggugcuuugacggggaacgcaacaaucaggugcucgaggaaaacauggauguggagaucuggacaaaagagggagaacgaaagaaauugagacccagguggcuggacgcccggacuuauucugacccucuagcucugcgcgaguucaaggaauuugcagccgguagaagguccgucagcggcgaucucauucuugagaucgggaagcugccgcagcauuuaacgcagcgggcucaaaaugccuuggacaaccugguuaugcuccacaauucagaacagggaggccgagcauacagacaugcgauggaggagcugccagauaccauagaaacacuuaugcugcucgccuugaucgcugugcugacuggugggguaaccuuauucuuucuaaguggccgcggacugggcaaaacaagcauugggcuccuuugugugauggccuccucuguccuguuguggauggcaagcguggagccccacuggaucgcugccuccauuauccuggaguucuuucucaugguucugcuuauaccugagcccgacaggcagcggaccccacaggauaaccaacucgcauauguggucauuggacuguuguucaugauccugacuguagccgcuaaugagauggguuuacuagaaacgaccaagaaagaccugggcauugggcacguggcgguugagaaccaucaccaugccacaaugcucgauguggaccuucacccugcaucagcuuggacucuguacgccgucgccaccacaaucauaacccccaugaugcgucauacuaucgaaaacacaacggcaaauauuucuuugaccgcuaucgccaaccaggcggcuauucugaugggacucgauaagggcuggccaaucaguaaaauggacauaggugugccucugcuugccuuagggugcuacucgcaggucaauccgcugacucucacagcagccguguugaugcugguugcucacuaugcaauuaucggccccggacuacaagccaaggcgaccagagaggcucagaagaggaccgccgcaggcaucaugaaaaacccaacaguggaugggauuguagccaucgaccuggauccuguggucuacgacgcuaaguuugaaaaacagcucggacagauaaugcuucugauuuuguguacuagccaaauccugcucaugcgcacgaccugggcccugugcgaguccauuacauuagcaacuggcccccuuaccacacugugggaggguucuccagggaaguucuggaauaccacuaucgcuguuucaauggccaacauauuucggggaagcuaucucgcgggcgccggucuagcauucucccugaugaaaaguuugggcgggggacgaagaggcacgggggcucagggagaaacacugggcgagaaguggaagaggcagcucaaucagcuuucuaaaagcgaauuuaacaucuacaagcgcucagguauuauggagguggaccgguccgaagccaaagaggggcugaagagaggagagaccacucgucacgcagucaguaggggcaccgcuaaauugcggugguucguggaacgcaaucugguaaagccugaggguaaggugaucgaucucggcugugggcgaggaggcuggagcuauuacugcgccgggcuaaagaagguuacagaagugaaaggauauacuaagggcggucccgggcaugaggaaccgauuccaauggccaccuacggauggaaccuggucaaacuucacucuggcaaggacguguucuuuacaccucccgagaaaugugauacgcugcuaugcgacaucggcgaguccucaccaaaucccaccauugaagaggggagaacucucaggguccugaagaugguggaaccuugguugcggggaaaccaauucuguaucaagauacugaauccguacaugcccagcguuguagagacacucgagcagaugcagcgcaaacaugguggcaugcuugugagaaacccacugucgagaaauucuacccacgaaauguauugggucaguugcgggacuggaaacauuguguccgcgguuaauaugacaagccgaauguuacugaaccgguuuaccauggcucaccguaagccuacguacgagaaagauguggacuugggcgcagguaccagacaugucgccguggaacccgagguagcuaaccucgauaucaucgggcagcgcauugaaaauauaaagcacgagcauaaaucaacauggcacuaugacgaggauaacccuuacaagacuugggccuaucauggauccuacgaagugaagccaucuggcagcgcaaguuccaugguuaauggcgucgugaaacugcuaaccaagcccugggacgugaucccuauggucacacaaauugccaugacugauaccacaccauucgggcagcagaggguuuuuaaagagaagguggacacccggacucccaaagcuaagagaggaacgguacaaaucauggaagugacagcgcgcuggcuuugggguuuccugagcaggaacaagaaaccgcgaauuuguacccgggaggaauuuacuagaaaggucaggucuaaugccgcaaucggcgcuguguucguugacgagaaccaguggaacucagccaaagaggcaguggaagaugagcgcuuuugggaccucgucaagaaagaacgugagcugcacaagcaggggaagugcgcaaccugcguguauaacaugaugggaaaacgggaaaagaaauugggcgaguucgguaaggcuaaagggaguagagccauaugguacauguggcugggagcgagguuucucgaguucgaagcacuuggcuuuaugaaugaggaucacugguucucccgcgaaaacagccugucuggcguagagggggagggauuacauaagcuggguuacaucuugcgagacauuucgaaaaucccuggcgggaauauguaugccgaugacacagcuggaugggauacgcggauuaccgaagacgaucuccagaacgaggccaagaucacugacauaauggaaccagagcacgcacugcuagcuacaucaauuuucaaacuuaccuaccaaaauaaaguugugagaguccagaggcccgccaagaacggcacugugauggaugugaucagccgcagagaccagcgggguuccgggcaggucggaacauauggccugaauaccuuuacaaacauggaagcucaacucaucaggcagauggagagugagggcauuuuccugccuucugaauuggagacuccaaacuuagccgaacguguucuggauuggcucgagaaauacgggguggaacgacuuaagcgcauggcaauaagcggagacgacuguguagugaaacccaucgaugacagauuugcgaccgcccugacggcucuaaaugauauggguaagguccggaaggacauuccgcagugggagccuuccaaaggcuggaacgauuggcagcaagugcccuucugcucacaucacuuucaccagcugaucaugaaggacgggagggagauuguugugccaugucgcaaucaggaugaacucgucggaagggcccgggugagucagggcgcagguuggucuuugagggagaccgcuugccuggggaaaagcuaugcccaaauguggcagcuuauguacuuccaucgacgugaccugagacucgcagccaacgcgaucuguuccgcuguaccuguugauugggugcccacaucacgcacuaccuggagcauacacgcccaucaccaguggaugacaacugaagacauguuaucugucuggaaucggguguggaucgaggaaaacccauggauggaggauaagacccauguuuccaguuggggagacgugcccuaucugggcaaaagggaggaccaauggugcggcagcuugauugggcugacggcaagagccacaugggcuucgaauauccaggucgccauuaaccaggugcgccggcucaucggaaaugaaaacuaccuugauuacaugaccuccaugaagagguuuaagaaugagggugacccugaaggcgcacugugguga

SEQ ID NO: 13892 - RNA, 9879 nt, Artificial Sequence
  derived and/or modified CDS sequence (opt3) from DENV-1__GU131720__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaagaagaugauucgcccucaacccauggagcacaaauacucguggaaaagcuggggcaaggccaaaaucauaggggcggacguccagaauacuaccuuuaucauugauggaccaaacacaccugaaugucccgacgaucagagagccuggaauaucugggagguggaggacuauggcuucgguauuuuugcuacuaacaucuggcuuaaguugagggauuccuacacccagguuugcgaccaccgucucaugucagcagccauaaaagauaguaaggcugugcaugccgacaugggguauuggauugaaucugagaaaaaugaaacauggaagcuggcacgggcgagcuucaucgagguaaagacguguauuuggccaaaaucccacacccuauggucaaacggaguccuggaaagcgagaugaucauacccaagaucuacggcgguccuauuucucaacauaauuaucgaccaggcuacuucacucagacagccgggccguggcaccucggaaaacuggagcuugauuuugacuugugcgaaggcaccacugugguggucgaugagcacugcgggaacagaggacccucccugaggacaaccacgguuacuggcaagaucauucaugaaugguguugccgcaguuguaccuuaccuccacuccgguucaaaggugaggacgggugcugguacggaauggagaucagacccgugaaggaaaaggaggaaaaucugguaaaaagcauggugucugcuggcuccggugaggucgacucauuuagucuuggccuguuguguauaagcauuaugaucgaagaggugaugaggucgcgcuggucccgaaagaugcucaugacagggacccuggccguuuuccuacugcucaucaugggacagcugacuuggaacgaucuuauucgguugugcaucauggugggcgcaaaugcuucugaccguauggggaugggaacaaccuaucuggccuuaauggcaacauuuaaaaugagaccuauguucgccgucggccuccuguuuaggcgccuuacuagccgggaggugcugcuacucaccauuggucugucauugguugcuaguguggaacugccaaacuccuuagaggaacucggggauggacuggcgaugggcauaaugauccuuaagcuguugacggacuuccaaucucaccagcucugggccacacugcuaagccugaccuuuauuaaaacuacccuuucccuccauuacgcauggaagacaauggcuaugguccugucaaucguauccuuguucccccuguguuuaaguacuaccucucagaagacgacauggcucccggugcugcuuggcuccuuugggugcaaaccucugaccauguucuugauuacugagaauaagaucuggggaagaaaaagcuggccacucaacgaagguauaauggccguuggcguggucucgauccugcuaucaucucugcuuaagaacgaugugccccucgccgggccucugauugcuggaggcauguugaucgcauguuauguaauuagugguuccagcgccgacuuaucucuggagaaagcggcugaggugagcugggaagaggaagccgagcacuccggggcaucacauaauauccucgucgaaguucaggaugacggaacaaugaagauaaaagaugaggagagggacgauacccugacuauucuucugaaggccacauugcuagcugugaguggcguguacccccugagcaucccagcaacccucuuugucugguauuucuggcaaaagaaaaagcagcgaucuggcgugcugugggacacgccuucacccccagaaguugagcgcgccguacuugaugacgggaucuaccggauuaugcagagaggauuacuggguaggagccaggugggcgucgggguguuccaagaaaacguuuuucacacuauguggcacgugacccguggagcgguccucauguaucagggcaaacgcuuggagccgaguugggcuagcgugaagaaagaccugauauccuacggugggggauggcggcuccagggcucuuggaauacaggcgaggaaguacaggucaucgccguggagccugggaagaaccccaagaauguucaaaccgcaccaggaacauucaaaacucccgaaggugaggugggcgccauugcucuggauuuuaagccugggaccucgggaagcccaaucgucaacagagaaggcaaaauugugggucuuuacgggaauggaguugugacgacaucaggcacuuaugucuccgccaucgcacaggcuaaggccagucaggagggcccccugccugagauagaagacgagguguucaggaaacgaaacuugaccaucauggaucuacauccggggucuggaaagacacggcgcuaccugccagcgauuguaagagaagccaucaagaggaaacuccggaccuuaauucuggcacccacucgagugguugcuagcgagauggccgaagcucuuaaggguaugccuaucagauaucaaaccacagcagucaaauccgagcacacgggcaaggagauaguggaccugaugugccaugccacuuuuaccaugcgccucuugucaccagugaggguccccaauuacaacaugauuaucauggaugaagcccacuucacagacccuucuagcaucgcugcgcguggguauauuaguacccggguaggaaugggcgaggcagccgcuaucuuuaugacugccacaccgcccgguuccguggaagcauucccacagagcaaugccguuauacaggaugaggaaagagacauuccugagaggucuuggaacucaggguacgaguggaucaccgauuuucccggaaaaacggugugguucgucccauccauuaagaguggcaaugacaucgcuaacugucugcgcaagaauggcaaacgagugauacagcucagcagaaagacuuuugauacagaauaucagaaaaccaagaacaacgacugggacuacguugugaccacugauauuucggagaugggggcgaauuuccgggccgacagggucaucgauccucgccguugccugaaacccgugauccuuaaggacggaccagaaagaguaauucuagcagguccgaugccugugacaguugcuucugccgcacagcggaggggccgcaucgggcgaaaccauaauaaggagggagaucaguacauuuauaugggccagccccugaacaaugacgaggaucacgcccacuggaccgaagcuaaaauguuguuagacaacauaaauacaccagaggguaucauucccgcccuguucgaaccugagagagaaaaguccgcggcaaucgauggggaguaccggcucaggggcgaggcccgcaaaacuuuugucgaacugaugagaaggggagaccuuccaguguggcugagcuauaagguggcuucagagggcuuccaauacagugaucggcguuggugcuuugacggggaacgcaacaaucagguccucgaggaaaacauggauguugagaucuggacgaaagagggagaacgaaagaaauugagacccagguggcuggacgcccggaccuauucugacccucuagcucugcgcgaguucaaggaauuugcagccgguagaagguccgugagcggcgaucucauucuugagauagggaagcugccgcagcauuuaacacagcgggcucaaaaugccuuggacaaccugguaaugcuccacaauucagaacagggaggccgagcauacagacaugcgauggaggagcugccagauacuaucgaaacccuuaugcugcucgccuugauugcugugcugacagguggggucaccuuauucuuucuaaguggccgcggacugggcaaaacuagcaucgggcuccuuugugugauggccuccucuguucuguuguggauggcaagcguggagccccacuggauugcugccuccaucauacuggaguucuuucucaugguccugcuuaucccugagcccgacaggcagcggacgccacaggauaaccaacucgcauauguagugauuggacuguuguucaugauccugaccguugccgcuaaugagauggguuuacuagaaacaacuaagaaagaccugggcauugggcacguggcggucgagaaccaucaccaugccaccaugcucgauguggaccuucacccugcaucagcuuggacacuguacgccgucgccaccacuaucauaacacccaugaugcgucauacgauugaaaacaccacugcaaauaucucuuugacagcuauugccaaccaggcggcuauccugaugggacucgauaagggcuggccaauaaguaaaauggacaucggugugccucugcuugccuuagggugcuacucgcagguuaauccgcugacccucaccgcagccguguugaugcugguagcucacuaugcaauuaucggccccggacuacaagccaaggcgacaagagaggcucagaagaggacugccgcaggcauuaugaaaaacccaacgguggaugggaucgucgccauagaccuggauccuguuguguacgacgcuaaguuugaaaaacagcucggacagauuaugcuucugaucuuguguaccagccaaauccugcucaugcgcacaacuugggcccugugcgaguccauuaccuuagcaacaggcccccuuaccacucugugggaggguucuccagggaaguucuggaauacgacaaucgcugucucaauggccaacauauuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaguucaacauuuacaagcgcucagguaucauggagguggaccgguccgaagccaaagaggggcugaagagaggagagaccacacgucacgcaguaaguaggggcacugcuaaauugcggugguuuguggaacgcaaucugguuaagccugaggguaaggugauugaucucggcugugggcgaggaggcuggagcuauuacugcgccgggcuaaagaaggucaccgaagugaaaggauauacaaagggcggucccgggcaugaggaaccgaucccaauggccacguacggauggaaccuggucaaacuucacucuggcaaggacguguucuuuaccccucccgagaaaugugauacucugcuaugcgacauaggcgaguccucaccaaaucccacaaucgaagaggggagaacccucaggguucugaagaugguagaaccuugguugcggggaaaccaauucuguauuaagauccugaauccguacaugcccagcguggucgagacucucgagcagaugcagcgcaaacaugguggcaugcuugugagaaacccacugucgagaaauucuacacacgaaauguauuggguuaguugcgggaccggaaacauuguguccgcggucaauaugacgagccgaauguuacugaaccgguuuaccauggcucaccguaagccuacauacgagagagauguggacuugggcgcagguacucgccauguagccguggaacccgagguugcuaaccucgauaucauugggcagaggaucgaaaauauaaaacacgagcauaagucaaccuggcacuaugacgaggauaacccuuacaaaacaugggccuaucauggauccuacgaagucaagccaucuggcagcgcaaguuccauggugaauggcguggucaagcugcuaacuaaacccugggacguuauuccuauggugacccaaaucgccaugacagauaccacuccauucgggcagcagcggguauuuaaggagaaaguggacacgagaacacccaaggcuaaacgcggaaccgcgcaaaucauggaagucacugccagguggcuuugggguuuccugagccgaaacaagaagccgcggauuuguaccagagaggaauuuacaaggaaagugcgcucuaaugcagcuauaggcgccguuuucguggacgagaaccaguggaacucagcaaaggaggccgucgaagaugagcguuuuugggaccucgugcagaaagaacgggagcugcacaagcaggggaaaugcgcuacgugcguauauaacaugaugggaaagagagaaaagaaauugggcgaguucgguaaggccaaagggaguagggcgaucugguacauguggcugggagcacgcuuucucgaguucgaagcccuuggcuucaugaaugaggaucacugguuuucccgagaaaacagccugucuggcguugagggggagggauuacauaagcuggguuacauuuugcgggacaucucgaaaauuccuggcgggaauauguaugcugaugacaccgccggaugggauacuagaaucacagaagacgaucuccaaaacgaggcaaagauaaccgacaucaugaaaccagaacacgcucugcuagccacuucaauuuucaaacuuacauaccagaauaagguggucagggugcagcgccccgcuaaaaacggcaccgugauggaugucaucagcagacgggaccagagggguuccgggcaaguuggaacauauggccugaauacuuuuaccaacauggaggcccagcucauucgucagauggaaagugagggcaucuuccugccuucugaguuggaaacgccaaacuuagcagagcgagugcuggauuggcucgaaaaguacgggguagagcgccuuaaaagaauggcgauaagcggagacgacuguguggucaagcccauugaugaccgguuugccaccgcucugacagcccuaaaugauauggguaaagugaggaaggacaucccgcagugggaaccuuccaagggcuggaacgauuggcaacagguucccuucugcucacaucacuuucaccagcugaucaugaaagacgggcgcgagauuguggucccauguagaaaucaggaugagcucgugggacgggcaaggguaagucaaggcgcugguuggucuuugcgagaaacugccugccugggaaagagcuaugcacagauguggcagcuuauguacuuccaucguagagaccugcgccucgccgcgaacgcuauauguuccgccguuccuaucgauugggugcccaccucacggacaacuuggagcauucacgcacaucaccaauggaugaccacggaggacauguuaucugucuggaauaggguguggaucgaagagaacccauggauggaagauaaaacacauguuuccaguuggggagacgugcccuaucugggcaagagagaggaccaguggugcggcagcuugauugggcugaccgcccgcgcuacuugggccucgaauauccaggucgcaauaaaccaggugcggaggcucaucggaaaugagaacuaccuugauuacaugacauccaugaaacgauuuaagaaugaaggugacccugagggcgcucugugguga

SEQ ID NO: 13893 - RNA, 9879 nt, Artificial Sequence
  derived and/or modified CDS sequence (opt3) from DENV-1__HM181960__SS-prME
agcgugaccaugcugcucaugcuuaugcccacggcccuggcuuuccacuugacuacgcggggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcugcuauucgcaggucaauccguuaacccugaccgccgcugugcucauguugguugcacauuacgccauuaucggacccggccugcaagcgaaggcuacacgcgaagcccagaaacggacugcagccgggauaaugaagaacccaacgguggauggaauuguagcuaucgaccuagauccuguggucuaugacgccaaguucgagaaacagcugggccagaucaugcuccuuauucuguguaccagccaaaucuugcugaugcgaacaacuugggcacucugcgaauccauaacccuggcuacaggucccuuaaccacucuuugggaggggucuccaggaaaguuuuggaauacgacaauugccguuucaauggcgaacaucuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcagagugaucgaucugggguguggaaggggcggguggagcuacuauugcgccggacucaagaagguuacagaggugaaaggcuacacgaagggugggcccggacacgaggagccgauaccaauggcgaccuacggcuggaacuuagucaaacugcauucuggcaaggacguguuuuucaucccucccgaaaaaugugauacucuucugugcgacauuggggaguccucaccaaaucccacaaucgaggaaggacggacccuacgcguccucaagaugguggagccuuggcugagagguaaccaauuuuguauuaaaaucuugaauccguauaugcccagcguuguagaaacucuggagcagaugcagaggaagcacggcgggaugcucgugcgaaacccacuuucgagaaauucuacacaugagauguacugggucaguugcggaaccggcaacauuguguccgcuguuaauaugacgagccguaugcuguuaaacagauucaccauggcacaccgcaagccuacauaugaaagggauguggaccugggugccgggacucggcacgucgcuguggagcccgaaguagccaacuuggauaucauaggacagagaauugagaauaucaaacaugaacacaagucaaccuggcauuacgacgaggauaacccuuauaaaacaugggcauaccacggcuccuaugaggugaagccaucuggcagcgccaguuccaugguuaauggggucgugaaacuccugacuaagcccugggacgugaucccuauggucacccaaauugcuaugacagauaccacuccauuuggacagcagcgcguuuucaaggaaaaaguggacacgaggacacccaaggcgaaacgagguaccgcccaaauaauggagguaacugcaaaguggcuauggggcuuucuuagccggaacaaaaagccgagaaucuguaccagggaagaguucacacgcaaggugcguucuaaugcugccauuggggcagucuuuguggacgaaaaccaguggaacucagccaaagaggcuguugaggaugaacgguucugggaccuggugcauagagagagggaacuccacaagcagggaaaaugcgccacgugcgucuacaacaugaugggcaagcgcgagaaaaagcugggugaauuugggaaggcgaaaggaagucgagcaaucugguacaugugguugggcgcccgguuccuggaguucgaggcucucggcuuuaugaaugaagaucacugguucuccagagagaacagccuuucugggguggaaggagagggucugcauaaguuaggcuauauucugagggacaucucgaaaauaccugggggaaauauguacgccgaugacaccgcaggcugggauacucgcaucacagaggacgauuugcagaacgaagcuagaauuaccgacaucauggagccagaacacgcccuccuggcuaagucaauuuuuaaacuaacuuaucaaaauaagguaguucgggugcagaggcccgccaaaaacgguacagucauggaugugaucagccgucgagaccagcgcggguccggacaggugggcaccuacggccuuaauacauucacuaacauggaggcacaacugauaagacagauggaaagugaggggauauuuucuccuagcgagcucgaaaccccaaaccuggcggagcgggucuuggauugguuagaaaaguauggaguugagaggcugaagcgcauggccaucuccggugacgacugugugguaaaacccaucgaugacagauucgcuacggcccucaccgcacuuaaugauaugggcaaggugcggaaagacauuccgcagugggaaccuucaaagggguggaacgauuggcagcaaguccccuuuugcagucaucacuuccaccagcugauaaugaaagacggaagggagaucgugguuccaugucgaaaucaggaugagcuagugggccgugcuagagucucucagggugccggguggagccugcgcgaaacagcaugccucggaaaguccuacgcccaaauguggcaguugauguauuuucaucggagggaccugagacuugcggcuaacgccauuuguucagcagugccuguagauuggauccccacuagccgcaccacauggucuauucacgcccaucaccaguggaugacuaccgaggacaugcuguccguuuggaaucggguguggaucgaagagaacccauggauggaagauaagacgcauauaaguagcuggggcgacguccccuaccucggcaaaagggaggaccaauggugcgggucguuaaucggacugacagcucgagccaccugggcaacuaauauucagguggcuaucaaccagguuagacgguugauugguaaugagaacuaccuggauuauaugacauccaugaagagguucaaaaaugaaucugacccugagggcgcccucugguga

SEQ ID NO: 13894 - RNA, 9879 nt, Artificial Sequence
  derived and/or modified CDS sequence (opt3) from DENV-1__HM181963__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaaucggagagcaccgccgagacaagcguagcguggcccuggcaccccaugucggccuuggucuggagacgagaacugaaaccuggauguccucugagggggccuggaaacagauucagaggguggaaacaugggcuuugcggcacccuggauuuacuguuaucgcacucuuccuggcccaugcuauuggcaccucgaucacacagaagggcauaaucuuuauucugcucauguuagugaccccaucaauggccaugcgcugcgucgggaucggaagcagagauuucguggagggucugaguggcgcgacguggguagacguugugcuugagcacggguccugugucacuacaauggcaaaggauaaacccaccuuggacauugaacugcuaaagacugaggugacaaacccugccgugcucaggaaacugugcaucgaagcuaagauaucuaauaccacgaccgauagccgguguccaacacaaggagaggccacucuugucgaagagcaggacgcaaacuuuguuugccgccgaaccuucguggauagaggcugggguaauggguguggacuguuuggcaaaggcuccuugauuacaugcgcuaaguucaagugcguaacuaaacucgaggggaagaucgugcaguacgaaaaccugaaauauucagucauugugaccguucacacaggagaccagcaucaaguggguaaugagaguaccgaacacggcacuacggccacaaucaccccccaggcgccuagcacugagauccaguuaaccgacuacggggcccugacacucgauuguucuccaaggaccggacuugacuuuaacgaaaugguccuguugacuaugaaggagaaauccuggcuagugcauaagcagugguuccuggaucucccgcugcccuggacaucaggcgcaagcacgagucaagagaccuggaaucggcaggaccuucugguaacuuuuaaaacagcucacgccaagaagcaggaaguuguggucuuggguucucaagagggggcuaugcacaccgcccucacaggcgcaacugaaauucagaccuccggaacgaccacaauauucgccggccaucugaaaugccguuuaaagauggauaaacugacucuaaaggggaugagcuaugugauguguaccggaucguucaaacucgagaaggaagucgcugagacacagcacgguacugugcugguucagaucaaguacgagggcaccgacgcgccuugcaaaauuccauuuucuacgcaagaugaaaagggggugacacagaacggacgccuuaucaccgcaaaucccauaguaacugacaaagagaagccugucaacauugaagccgagccacccuucggcgaguccuauaucgugaucgguguuggggaaaaagcuuugaagcugucaugguuuaagaaaggcaguagcauuggaaagauguucgaggccacagcaagaggcgccaggcggauggcuauccucggggauaccgccugggacuuuggauccauugguggcguguucacuucugucgggaaacuggugcaucagauauuuggaaccgcauacggcguacuuuucagcggugugucauggacaaugaagaucgggauuggcguucuguugacguggcucggacugaauagucgauccaccagcuuaucuaugacuuguaucgcggucggccuggugacacuauaccucggggugaugguccaggcugauucaggaugcguuaucaacuggaaaggccgcgaacugaagugugguagugggauuuuugugaccaaugaggugcacacauggacugaacaauauaaguuccaggccgacagcccgaaaagacuuuccgcagccauaggaaaggcuugggaggagggcguaugcgguaucaggucugccacccgguuggaaaacauuauguggaaacagaucucgaacgagcugaaucauauucuccuggaaaacgacaugaaguuaacggucgugguuggcgauguggcagggauccuggcucagggaaaaaagaugauacgcccucaacccauggaguacaaauauagcuggaaguccuggggcaaggccaaaaucauuggggcggacguccagaauacaaccuuuaucauugauggaccaaacacuccugaaugucccgacgaucagagagccuggaauaucugggagguggaggacuacggcuucgguauauuuaccacaaacauuuggcuuaaguugagggauucauauacucagguuugcgaccaccgucucaugagugcugcaaucaaagauucuaaggccgugcacgcugacaugggguacuggauugaaagcgagaaaaaugaaaccuggaagcuggcccgggcauccuucaucgagguaaagacauguauauggccaaaaucacauacgcuauggagcaacggaguccuggaaucugagaugaucauucccaagaucuauggcgguccuauuucccaacacaauuaccgaccaggcuacuucacccagacugcggggccguggcaucucggaaaacuggagcuugauuuugacuugugcgaaggcacaaccgugguggucgaugagcacugcgggaacagaggacccagucugaggacuacaaccguuacgggcaagaucauacacgaaugguguugccgcagcuguacuuuaccuccacuccgguucaaaggugaggacgggugcugguauggaauggagauuagacccgugaaggaaaaggaggaaaaucugguaaaaucuaugguguccgccggcucaggugaggucgacaguuuuagccuuggccuguuguguaucucgaucaugauugaagaggugaugaggucccgcuggucucgaaagaugcucaugaccgggacacuggcuguuuucuuucuacugaucaugggacagcucaccuggaacgaucugauucggcuuugcauaauggugggcgccaaugcaagcgaccguauggggaugggaacuacauacuuggcucugauggccaccuucaaaaugagaccuauguuugcagucggcuuacucuucaggcgccugacaucacgggaggugcuucugcuaacuaucggucucagucugguugccuccguggaauugccaaacucucuggaggaauuaggggauggacucgcuaugggcauuaugauccugaagcuucugaccgacuuucaaagccaucaguugugggcgacgcuccuguccaugacauucauuagaaccacuuuuucacuacacuaugccuggaaaaccauggcaaugguccugagcaucguaagucuuuucccccucugucugucuacaacuucccagaagaccacgugguugccggugcuguuaggcagccucgggugcaagccucugacaauguuucuuauagcugagaauaaaaucuggggaaggaagucguggccacugaacgaagguauuauggccguuggcaucgugucaauuuugcucucuagucugcuaaaaaacgaugucccccuggccgggccucuuaucgcuggaggcaugcucauagcauguuacgugauuuccgguagcucugccgaccugagcuuggagaaggcggcuguaguguccugggaggaagaggccgaacauucaggggcaagucacaauaucuuagucgagguucaggaugacggaaccaugaaaaucaaggaugaagagcgagacgauacucugacaauucuccugaaagccacccuucuggcugugagcggcguguaucccuugucuauaccagcaacucuauucgucugguacuucuggcaaaagaagaaacagcgcuccggcgugcugugggacacaccuucacccccagagguugaacgggccguacucgaugacgggaucuauagaauuaugcagaggggacugcuuggucguagucaggugggcgucgggguguuucaagagaacguuuuccauaccauguggcacgugacgcgcggagcggucuuaauguaccagggcaagcggcuggaaccgagcugggcuuccgugaaaaaggaccucaucucuuacggugggggauggagauugcagggcucguggaauacuggcgaggagguacaggucauugccguggaaccugggaaaaaccccaagaauguucaaaccgcaccaggaacauuuaagaccagcgagggugaagugggcgccaucgcucuggauuucaaacccgggacaucaggauccccuauagucaacagggagggcaaggugguuggucucuaugggaauggaguggucacuaccaguggcacguacgugucugccaucgcacaggcuaaagccagccaggaaggcccacugcccgagauugaggacgaaguauuucgaaagcggaaccuuacaaucauggaucugcacccuggguccggaaaaacucgcagauauuugccggcgauugugagggaggccaucaagcggaagcuacgaacccugauacucgcaccaacaagaguugucgcuucagaaauggccgaggcuuuaaaagguaugcccauucgcuaccaaaccacugcagugaagucugaacauaccggcaaagagaucguggaccugaugugccacgccacauucacgaugaggcuucugagcccuguccguguaccaaauuauaacaugaucauuauggaugaggcccauuuuacugaccccaguuccaucgcugcgcggggguacauaagcaccagagugggaaugggcgaagcagccgcuauuuucaugacagccaccccuccggguucuguugaggcauuuccccagucaaaugccgugauccaggaugaagagagggacauuccagaacgcuccuggaacaguggguaugaguggaucacugauuucccuggaaagacagucugguuugugcccagcauaaaaucgggcaaugacauugcuaacugucuccgaaagaauggcaagagaguuauccaguugucucggaaaaccuucgauacggaguaccaaaagacuaaaaacaacgacugggacuacguggucacaaccgauaucuccgaaaugggggcgaauuucagggccgaccgcgugauugauccacguagaugccugaagccuguaauccucaaagacggacccgagcgggugauucuggcagguccaaugccgguuaccgucgcuagcgccgcacagaggcgcggccgaauagggagaaaccacaauaaggaaggagaucaguauaucuacaugggccagccucuuaacaaugacgaggaucaugcccacuggacugaggcuaagaugcuacuggacaacauuaauacacccgaagguaucaucccagccuuguuugagcccgaacgggagaaaucagcggcaauugauggggaauauagguuacgcggcgaggccagaaagaccuucguggagcugaugaggcggggagaccucccuguguggcugaguuacaaagucgcuucugaaggcuuucaauauuccgaucgucgcuggugcuucgacggggagcgaaacaaucagguucuugaagagaacauggauguggaaauauggacaaaggagggagagagaaaaaagcugaggccacgguggcucgacgcccgcacuuacagcgaccccuuggcucugagagaauuuaaagaguucgcagccgguaggcggucaguaaguggcgaucuaauccuggaaauugggaagcucccucagcaccuuacgcagcgagcucaaaaugcccuggacaacuuagugauguugcauaauagcgagcagggaggcagagcauaucgccacgcgauggaagagcugccggauaccaucgagacacucaugcugcuugcccugauugcuguccucacugguggggugaccuuguuuuuccuguccggcaggggauuaggcaagacaucuaucgggcuacuguguguuauggccagcuccgugcuccuuuggauggcaucagucgaaccacauuggauagcugccucuaucauucuggaguuuuucuugaugguacugcucauccccgaaccugaccggcagcguaccccccaggauaaccaacuggcauacgugguuauuggacuucucuuuaugauccugacuguggccgcuaaugagauggguuugcuggagacgaccaaaaaggacuuaggcauagggcacgucgcgguggaaaaccaccaucacgccgcaaugcuagaugucgaccugcauccagcuagugccuggacacucuacgccguggcaacuaccauuaucacaccuaugaugagacacaccauugagaacacuacagcuaauaucucgcuuacggccauagcgaaccaggcugccauccugaugggauuggauaaaggcuggcccauuagcaagauggacaucgguguuccacugcucgcacuggggugcuauucccaggugaauccucuuaccuuaacugccgcuguacugaugcucguggcacauuacgccauuaucggcccgggauugcaagcgaaagcuacaagggaagcccagaagcgcaccgcagccggcauaaugaagaaccccaccgucgaugggauuguugcuaucgaccuggauccaguggucuaugacgccaaauucgagaagcagcuaggacagaucaugcugcucauucuuuguacaucucaaauccuguugaugcggacuacgugggcacugugcgaaucaauaacccucgcuacaggcccucugacuaccuuaugggaggguagccccgggaaauuuuggaauacaaccauugccguguccauggcgaacaucuuccgaggaaguuaccuugccggcgcaggucuggcuuucucucucaugaagagccuaggcgggggaagaaggggcacuggggcccagggagagacgcugggcgaaaaauggaagcgccaguugaaucagcugucaaaguccgaguuuaacacauauaaacggagugguauuauggaaguagacagaagcgaggcaaaggaagggcucaaacguggagagaccacuaagcacgcugugucuaggggcaccgccaaacuucggugguucguugagcgcaaucuggugaagccagaagguaaggucaucgauuugggcugugggcgaggaggcugguccuacuauugcgccgggcugaaaaaggugacagaggucaaaggauacacuaagggcgguccugggcacgaagagcccauaccgauggcgaccuacggauggaaccucgugaaauuacauucaggcaaggacguuuuuuucaucccaccugaaaaaugugauacacugcuuugcgacauuggcgagagcucgcccaauccaacgaucgaggaagggagaacccugaggguacuaaagaugguggagcccuggcuccggggaaaccaauuuuguauuaagauccugaauccuuauaugccgucugucguggaaacuuuggagcagaugcagcgcaaacacgguggcaugcugguuagaaacccccucaguaggaauuccacacaugagauguacugggugagcugcgggaccggaaacauugucucagcugugaauaugacuucccgaaugcuucugaaccgguucacaauggcacaccguaagccaaccuaugaaagagauguagacuuaggcgccgguacgcgccacguggcuguugagccugaagucgccaaccuggauaucauagggcagaggauugagaauaucaaacaugaacacaagucuaccuggcauuacgacgaggauaaccccuauaaaacaugggcauaccacggaagcuaugaggugaagccuaguggcuccgccagcucuauggugaauggcgucguuaaguugcucacuaaaccaugggacgugauccccaugguaacccaaauugcuaugacagauacuaccccuuuugggcagcagcggguguucaaggaaaaagucgacacaagaaccccaaaggcgaaacgcggaacugcccaaauaauggaggugacggcaaaguggcugugggguuuucuaucaaggaacaagaaaccccgaaucuguacacgggaagaguucaccagaaagguuaggaguaaugcugccauuggcgcaguguuugucgacgaaaaccaguggaauuccgccaaagaggcuguggaggaugaacgcuucugggaccuuguacaucgugagcgggaacugcacaagcaggggaaaugcgccacuugcguuuacaacaugaugggaaagagagagaagaaacucggcgaauuugguaaggcgaaagggagcagggcaaucugguacauguggcugggagcccgcuucuuggaguucgaggcucugggcuuuaugaaugaagaucacugguucucucgagagaacucgcucucaggcguggaaggggagggacuucauaagcuggguuauauuuuacgggacaucagcaaaauaccgggcgggaauauguacgccgaugacaccgcaggaugggauacaagaaucacggaggacgaucugcagaacgaagcuaagauuaccgacaucauggagccugaacacgccuugcucgcuaaauccauuuuuaagcugacuuaucaaaauaaggucgugagggugcagcgcccagccaaaaacggcacagucauggauguuaucaguagacgggaccagagggguucugggcaggugggaaccuacggccuaaauacuuucacaaacauggaggcacaacuuauacgucagauggaaagcgagggcauuuuuucccccucagagcuggaaaccccuaaccucgcggggcgagcccuggauugguuggagaagcauggaguagaacgcuuaaaaagaauggcuaucaguggugacgacuguguggucaagccaaucgaugaccgguucgccacagcacugacugcucucaaugauaugggcaaagugaggaaggacauuccccagugggagccgucuaagggguggaacgauuggcagcaaguuccuuuuugcagccaccacuuccaucagcuuauaaugaaagacggacgcgaaaucgugguccccuguagaaaucaggaugagcuggugggccgggccaggguaucccagggugcaggguggucacuacgagagaccgccugccugggaaagagcuaugcgcaaauguggcagcucauguacuuucaccguagagacuugcgccuggcugccaacgcaauuuguucugccguuccaguggauugggucccuacgucccggaccacauggaguauccaugcucaccaucaguggaugacuaccgaagacaugcuuagcguguggaauaggguuuggauugaggaaaaccccuggauggaggauaaaacacacaucucguccuggggcgacgugccauaucugggcaagagagaagaccaauggugcgggucucucauaggauuaacugcccgcgcaaccugggcuacgaauauccaggucgccauuaaccaggugcggaggcuguuggguaaugagaacuaccuggauuacaugacaucaaugaaacgauucaagaaugagagcgaccccgaaggcgcgcucugguga

SEQ ID NO: 13895 - RNA, 9879 nt, Artificial Sequence
  derived and/or modified CDS sequence (opt3) from DENV-1__HM181964__SS-prME
agcgugaccaugcugcucaugcuuaugcccaccgcccuggcuuuccacuugacuacgagaggcggggaaccucauaugaucgucuccaagcaggaaaggggaaagucuuuacuguuuaagaccucagccgguguuaauaugugcacgcuaauugccauggaccucggcgagcugugugaagauacuaugaccuacaagugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaagcccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucuccgcgggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuacuuggcucugauggccaccuucaaaaugcgcccuauguuugcagugggcuuacucuuccggagacugacgagcagggagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaaaacaacuuuuucccugcacugugccuggaagaccauggcaauggugcuuucaauugucagccucuucccccugugcuugaguacgacaucucagaaaaccacuuggcugccgguauuacucggcucccugggguguaagccucuuacaauguuucugaucgcugagaauaagauauggggacgacgcagcuggccauugaacgaagguaucauggccgugggcauuguuucgauccuccugucaucucuacugaaaaacgaugugccccuugccgggccucucauugcuggaggcaugcugaucgcaugcuaugucauaagugguuccagcgccgacuugucuuuagagaaggcggcugaggugagcugggaagaggaagccgagcauuccggggcaucacacaauauucugguagaagugcaggaugacggaaccaugaaaaucaaggaugaggagcgggacgauacucucacaauccugcuuaaagccacccuguuggcugucaguggcguuuacccccuaagcauuccagcaacgcuguucgugugguauuucuggcaaaagaaaaagcagagaucuggcgugcucugggacacuccuucacccccagaagucgagagggccgugcuggaugacgggauauaccguaucaugcagcgcggacuuuuaggucggagccagguuggcguagggguguuucaagaaaacgucuuccauaccauguggcacgugacaagaggagcgguucugauguaucagggcaagaggcucgagccgaguugggcuagcgugaaaaaggacuugauuuccuacggugggggauggcgacugcagggcucuuggaauaccggcgaggaaguccaggugaucgccguagagccugggaaaaaccccaagaauguccaaacagcaccaggaacuuuuaaaacccccgaaggugaggugggcgccauugcucucgauuucaagccugggacgucgggaagcccaaucguuaaccgggaaggcaagauagugggucuguacgggaauggagucgugacaacuucaggcaccuauguuuccgccaucgcacaggcuaaagccagucaggagggcccccuuccugagauugaagacgagguguuucgcaagagaaaccugacaaucauggauuugcacccggggucuggaaaaaccaggcgguaccuaccagcgauuguccgagaagccaucaagagaaaacugcgcacucucauauuagcacccaccagggugguagcuagcgagauggccgaagcucugaaggguaugccuauucguuaucaaacaacggcagugaaguccgagcauacuggcaaagagaucguugaccuuaugugucacgccaccuucacaaugcggcugcucucaccagucagagugcccaauuacaacaugaucauuauggaugaagcccauuuuaccgacccuucuagcaucgcugcgaggggguauauaaguacucgcgugggaaugggcgaggcagccgcuauuuucaugacagccaccccgcccgguuccgucgaagcauuuccauugagcaaugccguaauccaggaugaggaacgagacauuccugagagaucuuggaacucaggguacgaguggaucacggauuuccccggaaagacugugugguuuguuccauccauaaaaaguggcaaugacauugcuaacugccugcggaagaauggcaaaagggugauccagcucagccgcaagacauucgauaccgaauaucagaagaccaaaaacaacgacugggacuacgucgugacuacagauaucucggagaugggggcgaauuuccgugccgacagaguuauugauccucggaggugccugaagcccgugauccuuaaagacggaccagaacgcgucauucuagcagguccgaugccugugaccguagcuucugccgcacaacgaagaggccggauagggaggaaccacaauaaggagggagaucaguacaucuauaugggccagccccugaacaaugacgaggaucaugcccacuggacagaagcuaaaauguuguuagacaacauuaauacuccagaggguaucauccccgcccuguuugaaccugagcgcgaaaaguccgcggcaauugauggggaguacagacucaggggcgaggcccggaagacguucguggaacugaugcgucgcggagaccuuccaguuuggcugagcuauaaagucgcuucagagggcuuucaguacagugaucgaagaugguguuucgacggggaaaggaacaaucaagugcucgaggaaaacauggauguggagauauggaccaaggagggagaacggaaaaaguugcgccccagauggcuggacgccaggacauauucugacccucuagcucugcgggaguuuaaagaguucgcagccggucgaagauccgucagcggcgaucucauccuugagauugggaagcugccgcagcacuuaacucagcgcgcucagaaugccuuggacaaccugguuaugcuccauaauucagaacaaggaggcagggcauaccggcacgcgauggaggagcugccagauaccaucgaaacacuuaugcugcucgccuugauugcugugcugaccggugggguaacuuuauuuuuccuaaguggccguggacugggcaaaacgagcaucgggcuccuuugcgugauggccuccucuguccuguuguggauggcaagcguggagccccauuggauagcugccuccaucauucuggaauuuuuccucaugguucugcuuaucccugagcccgacaagcagagaaccccacaggauaaccagcucgcauauguggucauuggacuguuguuuaugauccugacaguagccgcuaaugagauggguuuacuagaaacuaccaagaaagaccugggcauagggcacguggcgguugagaaccaccaucacgccgcaaugcucgauguggaccuucauccugcuucagccuggacacuguacgccgucgcaaccacuauuaucacacccaugaugaggcacacgauugaaaacaccacugcuaauaucucuuugacagccauagcgaaccaagcugccauccugaugggacucgauaagggcuggccaauuaguaaaauggacaucggugugccucugcuugcauuaggguguuacucgcaggucaauccgcugacccucaccgccgcuguguugaugcugguugcacauuaugccauuaucggccccggacuacaggcgaaggcuacacgcgaggcccaaaaacggacugcagccggcauaaugaagaacccaacgguggaugggauuguagcuaucgaccuggauccuguggucuacgacgccaaguucgaaaaacagcucggacagaucaugcuucugauuuugugcaccagccagauccugcucaugcgaacaacuugggcacugugugaguccauaaccuuagcuacaggcccccuuaccacucugugggaggguucuccagggaaguuuuggaauacgacaauugccguuucaauggcgaacaucuucagaggaagcuaucucgccggcgcaggucuagcuuucucccugaugaaaaguuugggcgggggaaggcgcggcaccggggcccaaggagaaacucugggcgagaaguggaaacggcagcucaaucagcuuucuaagagcgaauuuaacaccuacaagagaucagguauuauggagguggaccguuccgaagcaaaagaggggcugaagaggggagagacaacuaaacacgcugucagucggggcaccgccaaguugcgcugguucguggaacgaaaucugguaaaaccugaggguaaggugaucgaucucggcugcgggagaggaggcuggagcuauuacugugccggguuaaagaaaguuacagaagugaagggauauacgaaaggcggucccgggcacgaggaaccgauaccaauggcgaccuacggauggaaccuggucaaacuucauucuggcaaagacguguuuuucaucccucccgagaagugcgauacucugcuaugugacauuggcgaguccucaccaaaucccacaaucgaagaggggaggacccuccggguccugaaaaugguggaaccuugguugcgcggaaaccaguuuugcauuaagauccugaauccguacaugcccagcguuguagagacucucgagcaaaugcagagaaagcacgguggcaugcuugugaggaacccacugucgcgaaauucuacacaugaaauguauugggucaguugugggaccggaaacauuguguccgcuguuaauaugacgagccggauguuacugaaccguuucaccauggcacacagaaaaccuacauacgagcgcgauguggacuugggcgccgguacuaggcacgucgcuguggaacccgagguagccaaccucgauaucauagggcagcggauugaaaauaucaagcaugagcacaaaucaaccuggcauuaugacgaggauaacccuuacaagacaugggcauaucacggauccuacgaagugaaaccaucuggcagcgccaguuccaugguuaauggcgucgugaagcugcuaacuaagcccugggacgugaucccuauggucacccagauugcuaugacagauaccacuccauuugggcaacagagaguuuucaaagagaagguggacacgcgcacacccaaagcgaagaggggaaccgcccagauaauggaaguaacugcaaaauggcuuugggguuuucugagccgaaacaagaagccgcggaucugcaccagagaggaguucacaaggaaagugcgcucuaaugcugccauuggcgcagucuuuguggacgagaaccaauggaacucagccaaggaggcuguugaagaugagcguuucugggaccucgugcaucgggaaagagagcugcacaaacaggggaagugcgccacgugugucuauaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcguggagggggagggauuacauaaacuggguuacauuuugagagacaucucgaagauaccuggcgggaauauguaugccgaugacaccgcaggaugggauacuaggaucacagaagacgaucuccagaacgaggcucgcauuaccgacaucauggaaccagagcacgcccugcuagcuaaaucaauuuuuaaacuuacuuaccagaauaaaguaguuagagugcaacggcccgccaagaacggcacagucauggaugugaucagcaggcgugaccagcgagguuccggacaggugggaaccuauggccugaauacauucacuaacauggaagcacagcucauacgccaaauggagagugagggcauauuuucuccuagcgaacuggagaccccaaacuuggcggaaagagucuuagauuggcuggagaaguacgggguugaacggcucaaaaggauggccaucuccggagacgacugcgugguaaagcccaucgaugaccgcuucgcuacggcccuuaccgcacugaaugauauggguaaagugagaaaggacauuccgcagugggagccuucaaaaggcuggaacgauuggcagcagguccccuuuuguagucaucacuuccaccaacuaauaaugaaggacgggcgggagaucgugguuccaugcaggaaucaggaugaacuggugggacgagcucgugucucucagggcgccgguuggagccucagagagacagcauguuuggggaaguccuaugcccagauguggcaacugauguacuuucaucgccgggaccuuaggcuggcggcuaacgccauuugcucagcagugccuguagauuggauccccacuagcagaaccacauggucuauucacgcccaucaccaguggaugacuaccgaagacaugcucuccguuuggaaucgcguguggaucgaggaaaacccauggauggaggauaaaacgcauauaaguagcuggggagacguccccuauuuaggcaagcgggaggaccagugguguggcucgcugaucggguugacagcuagggccaccugggcaacuaauauucaaguggcuaucaaccagguucgaagacugauuggaaaugaaaacuaccucgauuacaugacauccaugaaacgguucaagaaugagucugacccugaaggugcccuuugguga

SEQ ID NO: 13896 - RNA, 9879 nt, Artificial Sequence
  derived and/or modified CDS sequence (opt3) from DENV-1__HM181966__SS-prME
agcgugaccaugcugcucaugcuuaugcccaccgcccuggcuuuccacuugacuacgcgaggaggggagccucauaugaucgucaccaagcaggaaaggggaaaauccuuacuguuuaagacaucuguuggugugaacaugugcacucugauugccauggaccucggcgagcugugugaagauaccaugacauacaaaugcccacggauaaccgaggccgaaccggacgauguagacuguuggugcaaugcgacugauacaugggugaccuaugggacguguucacaaacuggagagcaccgccgagacaagcguagugucgcucuugcaccccaugugggccuggguuuggagaccagaacagaaacuuggaugagcuccgagggggcauggaaacagauccagaggguugaaaccugggcccuccggcacccuggauucacagugauugcucuguuucuggcacaugccaucggcaccucuauuacgcagaagggcaucauauucauccucuuaaugcuggucacuccaucgauggcuaugcgcugcguggggauuggaucaagagauuuuguagagggucuuagcggcgccacauggguugacguggucuuggagcacgggaguugugugaccacuauggcgaaggauaaacccacacuggacaucgaacuacucaagaccgaggugacgaacccugcaguccugaggaaacuuugcauugaagccaagaucuccaauaccacaacugauucucgguguccaacccaaggagaggcuacacugauggaagaacaagacgccaacuucguuugccgccgaacuuuuguggauagaggcugggguaauggguguggauuguucggcaaaggcagccucauaaccugcgcaaaguuuaagugcguaacaaaacuggaggggaagauugugcaguacgaaaacuuaaaauauuccgucaucgugaccguucacacuggagaccagcaucaaguggguaaugagucaacggaacacggcacaaccgcuacuauuacaccccaggccccuacaagugagauccagcugaccgacuacggggcgcucacucuugauuguagcccaaggacaggacuggacuucaacgaaauggucuugcuaacgaugaaggagaaaucuuggcuggugcauaagcagugguuucucgaucugccgcuucccuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacugguagcuucaaacuggagaaggaagucgccgagacccagcacggaacggugcuuguucagauaaaguacgagggcacagacgcuccuugcaaaaucccauucucgaccuuggaugaaaagggggugacucaaaacggacgccugauuacagcgaaucccaucguaaccgacaaagagaagccugucaacauagaagcagagccacccuuuggcgagucuuauauugugaucggugccggggaaaaagcucucaagcuguccugguucaagaaaggcucaaguaucggaaagauguuugaggccacugcaagaggcgccaggcggauggcuauucuuggggauaccgccugggacuucggaagcaucgguggcguuuuuacauccguggggaaacugguccaucagauuuucggaacggcauacggcguguuguuuucugguguaagcuggaccaugaagauagggaucggcgugcuccugacuugguuaggacuaaauucacgaaguacaucccuaagcaugaccuguauugcgguuggccucgucacacuguaccuuggggugauggugcaggcugauucuggaugcgucaucaacuggaaaggccgcgaauugaagugugguucagggaucuucguuacuaaugaggugcacaccuggacggaacaguauaaguuucaagccgacaguccgaaaagacugagcgcagccauuggaaaggcuugggaggagggcgugugcgguauaagguccgccacacggcucgaaaacaucauguggaaacagauuucuaacgagcugaaucauaucuuacuggaaaacgacaugaaguucaccguagucgugggcgauguuguggggauucuugcacagggcaagaaaaugauccgcccucagcccauggagcacaaauacucguggaaaagcuggggcaaggcuaaaauaaucggggccgacguccaaaauacuaccuuuauuaucgauggaccaaacacaccugaaugucccgacgaucagagagcguggaauauuugggagguggaggacuauggcuucgguaucuuuacuaccaacauaugguugaagcucagggauuccuacacacagguuugcgaccaccgucugaugucagccgcuauuaaagauaguaaggcagugcaugccgacaugggguauuggaucgaaucugagaaaaaugaaacguggaagcuagcucgggccagcuucauugagguaaagaccuguaucuggccaaaaucccacacucuguggucaaacggaguccucgaaagcgagaugauaauccccaagauuuacggcgguccuaucucucagcauaauuaucgaccaggcuacuucacacaaaccgcagggccguggcaccugggaaaacuugaguuggauuuugaccugugcgaaggcacuacagugguggucgaugagcacugcgggaacagaggacccuccuuaaggaccacgacuguuaccggcaagauuauccaugaaugguguugccgcaguuguacacucccuccacugcgguucaaaggugaggacgggugcugguacggaauggagauaagacccgugaaggaaaaggaggaaaaucuuguaaaaagcauggugucugcgggcuccggugaggucgacucauuuagucugggcuugcucuguauuagcaucaugaucgaagaggugaugaggucgcgcuggucccgaaagaugcugaugaccgggacucuagccguuuuccugcuccugauuaugggacagcuuacauggaacgauuugauccggcugugcauuauggugggcgcuaaugccucugaccguauggggaugggaaccacauauuuagcacucauagcuacuuuuaaaaugagaccuauguucgccgucggccugcuuuuuaggcgccugaccagccgggaggugcuacuccugacgaucgguuugucacugguugcaaguguggaauuaccaaacucccucgaggaacugggggauggacuugccaugggcauuaugauccugaaguugcucacagacuuccagucucaccaacugugggcuacccuacugagcuuuacuuucauuaaaaccacacuuucccuccauuacgcguggaagacuauggccaugguccugucaaucguauccuuguuuccccuguguuuaaguaccacgucucagaagacaaccuggcucccggugcugcuuggcucccuggggugcaaaccuuugacuauguuccucauagcagagaauaagaucuggggaagaaaaagcuggccacugaacgaagguauuauggcuguuggcguggucucgauccuacugucaucucuucucaagaacgaugugccccuggccgggccuuugauugccggaggcauguuaaucgcuuguuauguaauaagugguuccagcgcagaccugucucucgagaaagccgcggaggugagcugggaagaggaagcugagcacuccggggccucacauaauauucuggucgaaguucaggaugacggaacaaugaagaucaaagaugaggagagggacgauacccuuacuauccuguugaaggcaacacuacuggccgugaguggcguguacccccucagcauuccagcuacccuguuugucugguauuucuggcagaagaaaaagcaacgaucuggcgugcuuugggacacgccuucacccccaaaaguugaacgcgcaguauuagaugacgggauauaccggaucaugcagagaggacugcucgguaggagccaggugggcgucgggguguuccaggagaacguuuuucacacuauguggcacgugacccguggagccgucuugauguaucaaggcaagcgccuggaaccgaguugggcgagcgugaaaaaggaccucauuuccuacggugggggauggcggcugcagggcucuuggaauacaggcgaggagguacaggucaucgcuguggaaccugggaagaaccccaaaaauguucagaccgccccaggaacauucaagacuucggagggugaagugggcgcaauugcccuugauuuuaaacccgggaccagcggaucaccuaucgucaacagagagggcaagauagugggucuguacgggaauggaguugugacgacauccggcacuuaugucagugcuaucgcccaagcaaaggcuucucaggaaggcccauugcccgagauugaggacgaaguguucaggaagcgaaaccuaaccaucauggaucugcauccugggagcggaaagacacggcgcuaccucccggccauuguaagagaggcgaucaaaaggaaguuacggacccugauacuugccccaacucgagugguugcauccgaaauggcugaggcccugaaagguaugcccauuagauaucagaccacagcugucaagucagaacacacgggcaaagagaucguggaccucaugugccaugcaacuuuuaccaugcgcuugcugucuccugugagggucccaaauuacaacaugaucauuauggaugaggcccacuucacagaccccagcaguaucgccgcucguggguauauauccacccggguaggaaugggcgaagcggcagccauuuuuaugacugcuacaccuccggguagcguggaggccuucccccaaucuaaugcaguuauccaggaugaagagagagacauuccagaaaggucauggaacuccggguacgaguggaucaccgauuuuccuggaaagacggugugguucguccccaguauaaagagcggcaaugacauugccaacugucuccgcaaaaauggcaagcgagugauccagcugucgagaaaaacuuuugauacagaguaucagaagaccaaaaacaacgacugggacuacguugugaccacugauaucucugaaaugggggcuaauuuccgggcggacagggucauugauccacgccguugccuuaagccugugauccuaaaggacggacccgagagaguaauucuggccgguccaaugccggugacaguugcauccgcugcccaacggaggggccgcauagggcgaaaccauaauaaagaaggagaucaguacaucuauaugggccagccuuugaacaaugacgaggaucacgcacacuggaccgaggccaagauguuacuggacaacauuaauacacccgaagguaucaucccagcucucuucgagcccgaaagagagaaaagcgccgcgauugauggggaauaccggcugaggggcgaggcacgcaagacuuuugucgagcuuaugagaaggggagaccugccuguguggcucucauauaaaguggccagugaaggcuuccaguacucugaucggcguuggugcuuugacggggagcgcaacaaucaagucuuggaagagaacauggauguugaaauauggacgaaggagggagagaggaaaaagcugagaccaagauggcuagacgcucggaccuauuccgacccccuggcccuccgcgaguucaaggaguuugcugcagguagaaggagcgugucaggcgaucuuauccuggaaauugggaaauuaccucagcauuugacacagcgggcccagaaugcucuggacaaccucguaaugcugcacaauagugagcaaggaggccgagccuacagacaugcaauggaagaacuuccggauacuaucgagacccugaugcucuuggcgcugauugccguguuaacagguggggucacccuauucuuucugagcggccgcggacucggcaagacuuccaucgggcuucugugugugauggcuucuagcgccuugcuguggauggcauccguugaaccacacuggauagcugccucaaucauucucgaguucuuucugauggugcuucucauccccgaaccugacaggcagcggacgccccaggauaaccagcuggcauaugucguaauuggauugcuguucaugaucuuaaccguggccgcuaaugagaugggucuacuggagacaacuaaaaaggaccucggcauagggcacguugcgguggaaaaccaucaccaugccaccaugcuugaugucgaccugcacccagcaucugcuuggacauuguacgccguggccaccacuauuaucacaccuaugaugcgucauacgauugagaacaccacugcaaauaucagucugacagcuauagccaaccaagcggcuauccucaugggacuggauaaaggcuggcccauuucgaagauggacaucggugucccacuuuuagcccuggggugcuacagccaggugaauccucucaccuugaccgcagccguucugaugcuaguggcucacuaugcaauuaucggcccgggacugcaggccaaggcgacaagagaagcucagaaaaggacugccgcaggcauaaugaagaaccccacgguagaugggauuguggccaucgaccucgauccagucguuuacgacgcuaaauuugagaagcagcuuggacagaucaugcuguugauucuguguaccucccagauccuccugaugcgcacaacuugggccuuaugcgaaucuauaacccuugcaacaggcccucugaccacucucugggaggguucacccgggaaauucuggaauacgacaauugcugugagcauggccaacaucuuucggggauccuaucuagcgggcgccggucuggcauucaguuugaugaagucucugggcgggggacgaagaggcaccggggcucaaggagagacucucggcgaaaaguggaaaaggcagcuuaaucagcugagcaagucagaguucaacauuuacaaacgcuccgguaucauggaagucgaccggagugaggccaaggaaggguugaaaagaggagagaccacacgucacgcagugagcaggggcacugcuaagcugcggugguuuguagagcgcaaucucgugaagccagaagguaaaguuauagauuuaggcugugggcgaggaggcuggucuuauuacugcgccgggcugaagaaagugaccgaggucaagggauauacaaaaggcgguccugggcaugaggaacccaucccgauggccacguacggauggaaccuugugaagcugcacuccggcaaagacgucuucuuuaccccaccugaaaagugugauacucuacucugcgacauuggcgagucaagccccaauccaacaaucgaggaagggagaacccugaggguguugaagaugguugagcccuggcugcggggaaaccaguucuguauuaaaauccucaauccuuacaugccgucgguaguggaaacucuugagcaaaugcagcgcaagcaugguggcaugcuggucagaaaccccuuaucuaggaauaguacacacgagauguauuggguguccugcgggaccggaaacauuguuagcgcggugaauaugacgucacgaaugcuguugaaccgguuuaccauggcucaccguaaaccaacauacgaaagagaugucgaccucggcgcagguacucgccauguggccguagagccugaaguggcuaaccuggauaucauagggcagaggauugagaauaucaagcacgaacauaaauccaccuggcacuaugacgaggauaaccccuacaagacaugggccuaucauggaucuuacgagguuaagccuagcggcagugcauccagcauggucaauggcguggugaaacuacuuacuaagccaugggacgucauccccaugguuacccagauugccaugacagauaccacuccuuucgggcaacagcggguguuuaaagaaaagguagacacgagaacaccaaaagcuaagcgcggaaccgcgcagauaauggaggugacugccagguggcugugggguuuccucucucgaaacaagaaaccccggaucuguaccagagaagaguuuacaaggaagguccgcucaaaugcagcuauuggcgccguguucguugacgaaaaccaauggaauagugcaaaagaggccguggaggaugaacguuuuugggaccugguccagaaggagcgggaauugcacaaacaggggaagugcgcuacgugcguguauaacaugaugggaaagagagagaaaaagcugggcgaguucgguaaagccaagggguccagggcgaucugguacauguggcucggagcacgcuuucuugaguucgaggcccugggcuucaugaaugaagaucacugguuuagccgagagaacucuuuaucgggcguagaaggggagggacugcauaaauuggguuacauucuccgggacaucucaaagauaccgggcgggaauauguaugcugaugacaccgccggaugggauacuagaaucacagaggacgaucugcagaacgaagcaaaaauuaccgacaucauggagccugaacacgcucuacuugccacuagcauuuucaagcugacauaccaaaauaagguugugaggguccagcgcccagcuaaaaacggcaccgugauggaugugaucuccagacgggaccagagggguagugggcaggucggaacauauggccucaauacuuuuaccaacauggaggcccaacugauacgucagauggaaucugagggcauuuucuugcccagcgaguuagaaacgccuaaccuggcagagcgaguucucgauuggcuugaaaaguacgggguggagcgccugaaaagaauggcgaucuccggagacgacuguguagugaagccaaucgaugaccgguuugccaccgcucuaacagcccugaaugauauggguaaagucaggaaggacauuccccagugggaaccgucaaagggcuggaacgauuggcagcaagugccuuucugcagucaucacuuucaccagcucguuaugaaagacgggcgcgagauagugguccccuguagaaaucaggaugaguuggugggacgggcaaggguaucucagggcgcugguuggagccugcgagaaacugccugccuugggaaguccuaugcacaaauguggcagcugauguacuuccaucguagagaccuccgcuuagccgcgaacgcuaucuguucagccguuccaguggauugggucccuaccagccggacaacuuggucuauucacgcacaucaccaguggaugaccacggaggacaugcuguccguguggaauaggguuuggaucgaagagaaccccuggauggaagauaaaacacaugugaguagcuggggagacgucccauauuugggcaagagagaggaccaauggugcggcucgcugauugggcucaccgcccgcgcuacuugggccuccaauauccagguggcaauaaaccagguacggaggcuuaucggaaaugagaacuaccuggauuacaugacaucuaugaaacgauuuaagaaugaaggugaccccgagggcgcucuaugguga

SEQ ID NO: 13897 - RNA, 9879 nt, Artificial Sequence
  derived and/or modified CDS sequence (opt3) from DENV-1__GU131721__SS-prME
agcgugaccaugcugcucaugcuuaugcccacggcccuggcuuuccacuugacuacgcggggaggggaaccucauaugaucgucuccaagcaggaaagagggaaaucuuuacuguuuaagaccucagccgguguuaauaugugcacgcuaauugccauggaccucggagagcugugugaagauacuaugaccuacaaaugcccacggauaacagagaccgaaccggacgauguggacuguuggugcaaugcgacugauacauggguaaccuaugggacguguagucaaacuggggagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcgcagggaaacugguucaucagauauucggaaccgcguacggcguguuguuuuccggugucucuuggacuaugaagaucgggauuggcgugcuccugacaugguuaggacugaauagccgaucaaccagucuauccaugacauguaucgcuguaggccucgugacucuguaccuugggguuaugguccaggccgauagcggaugcgugaucaacuggaaaggccgcgaauugaagugugguucugggauuuucgugaccaaugagguccacacguggacagaacaauauaaguuucaggcagacucaccgaaaagacugagugccgcuauaggaaaggccugggaggagggcguuugcgguaucaggagcgcaacccggcucgaaaacauuauguggaaacagaucuccaacgagcugaaucauauuuuacuggaaaacgacaugaaguucacuguggugguaggcgaugucgcugggauccuugcccagggcaagaagaugauacgcccucaacccauggaguacaaauauucuuggaagucguggggcaaggcgaaaaucauuggggccgacgugcagaauaccacauuuaucauugauggaccaaacacuccugaaugucccgacgaucagagagcuuggaauaucugggagguugaggacuacggcuucgguauauuuaccacaaacauuugguugaagcucagggauagcuauacacaggugugcgaccaccgucugauguccgcagccaucaaagauucaaaggcuguccacgccgacaugggguacuggauugaaagugagaaaaaugaaaccuggaagcuagcacgggcgucuuucaucgaggugaagacuuguauauggccaaaaagccauacacugugguccaacggaguucucgaaucagagaugaucgugcccaagauuuauggcgguccuaucagccaacacaauuaccgaccaggcuacuucacccagacugccgggccguggcaucugggaaaacuugaguuggauuuugaccugugcgaaggcacaaccguagucguggaugagcacugcgggaacagaggacccucuuuaaggacgacuaccgugacaggcaagauuauccacgaaugguguugccgcuccuguacccucccuccacugcgguucagaggugaggacgggugcugguauggaauggagauaaggcccgucaaagaaaaggaggaaaaucuuguuaagaguauggugagcgcuggcucuggugagguagacuccuuuucacugggcuugcucuguauuaguaucaucauugaagaggugaugcgcagccgauggucgcggaaaaugcugaugacugggacacuagccgucuucuuucugcucaucaugggacagcugaccuggaacgaucuuauucguuugugcauaauggugggcgcaaaugcuuccgacagaauggggaugggaacaacuuaccuggccuuaauggcaaccuucaagaugaggccuauguuugccguuggccuccuguuccgccggcuuacgucuagagaggugcugcuacucacaaucggucugagcuuggucgcuucaguggaacugccaaacaguuuagaggaacucggggauggacuggcgaugggcauuaugauccuuaaacuguugaccgacuuucaaucccaucagcucugggccacucugcuaucucugaccuucauuaagacaacuuuuagccuucacuaugcauggaaaaccauggcuaugguucucuccaucgugucacuguuccccuugugucugagcacgacaagucagaagaccacuugguuaccgguccuccugggcucucuugggugcaagccucugacaauguuuuugauagccgagaauaaaaucuggggaaggcgauccuggccacucaacgaagguauuauggccguaggcaucgugagcauucugcuaucgucacugcuuaagaacgauguuccccucgcugggccucugaucgcaggaggcauguugauagccuguuacgugauuucugguaguuccgcggacuuaagccuggagaaagcugccgaggucucuugggaagaggaagcagagcauagcggggccucccacaauauccucguggaaguacaggaugacggaaccaugaagaucaaagaugaggagcgcgacgauacucugacaauucuucugaaggcuaccuugcuagcagugucaggcgucuauccccugaguauaccagccacacucuucguuugguacuucuggcagaagaagaagcagcggagcggcgugcugugggacacuccuucucccccagaaguggagagagcgguccuugaugacgggaucuauaggauuaugcagcguggauuacugggucgcucccaggugggcguugggguauuucaagaaaacguguuccauaccauguggcacgucacacggggagcugugcucauguaccagggcaaaagauuggagccgucaugggccaguguuaagaaagaccugaucagcuacggugggggauggaggcuccagggcuccuggaauaccggcgaggaagugcaggucauugcaguggagccugggaagaaccccaaaaauguacaaacagccccaggaacuuuuaagacccccgaaggugaggucggcgcuaucgcccuggauuucaagccugggacgucuggaucgccaauagugaaccgagaaggcaaaaucguuggucuuuaugggaauggaguggucacaacuagcggcaccuacgugucagcaauugcucaggccaaggcgucccaggagggcccccugccugagaucgaagacgagguuuuucggaaacgcaacuugacaauuauggaucuacacccggggaguggaaagaccagaagguaucugccagccaucgugcgggaagcaauaaaacgaaagcucagaacuuuaauucuggcucccacccgcgucguggccucugagauggcugaagcacuuaaggguaugccuaucagguaccaaacaacggccguaaaaagcgagcauacuggcaaggagaucguggaccugaugugccacgccaccuucacaaugcgucucuuguccccaguucggguccccaauuauaacaugauuaucauggaugaagcucauuuuaccgacccuucaucuauagcggcaagaggguacauuagcacuagggugggaaugggcgaggccgcugccaucuucaugacagcaaccccgcccgguaguguggaagccuuuccacaguccaaugcugucauucaggaugaggaacgcgacaucccugagcgaagcuggaacucuggguaugaguggauaacggauuuccccggaaaaacuguaugguuugugccaucaauuaaguccggcaaugacaucgcgaacugucugaggaaaaauggcaagcggguuauccagcucaguaggaagacauucgauaccgaauaccagaaaaccaagaacaacgacugggacuacguggucacuacagauauuagcgagaugggggccaauuuccgcgcagaccgugugaucgauccuagacggugccugaaacccguuauucuuaaggacggaccagaaagggugauacuagcugguccgaugccugucaccguggccucggcagcccagcgccgaggcagaaucgggcggaaccacaauaaagagggagaucaguauauuuacaugggccagccccugaacaaugacgaggaucaugcucacuggacagaagccaagauguuguuagacaacaucaauacuccagaggguaucauucccgcgcuguuugaaccugagagggaaaagucugcagccauagauggggaguaucgccucagaggcgaggcuaggaaaacguucguagaacugaugcggcguggagaccuuccaguguggcuguccuacaagguugccagcgagggcuuucaauauucagaucgccgauggugcuucgacggggaaagaaacaaucagguccucgaggaaaacauggauguggagaucuggaccaaagagggagaaaggaagaaauugcggccccgcuggcuggacgcuagaacauacagugacccucuagcacugagggaguuuaaggaguucgccgcuggucggcgaucuguguccggcgaucucauucuugagaucgggaaacugccgcagcacuuaacucagagagcccaaaaugcauuggacaaccuggucaugcuccauaauagcgaacagggaggccgcgcguauaggcacgccauggaggagcugccagauaccauugaaacacuuaugcugcucgcuuugaucgccguucugaccgguggggugacuuuauuuuuccuaucaggccggggacugggcaagacgaguauagggcuccuuuguguaauggcaagcuccgugcuguuguggauggcuucugucgagccccauuggaucgccgcaagcauuauccuggaauuuuuccucauggugcugcuuauuccugagcccgaccgucagagaaccccacaggauaaccaacucgccuacguugugaucggacuguuguuuaugauacugacagucgcugcgaaugagauggguuuacuagaaacuaccaagaaagaccugggcauugggcacguagccguggagaaccaccaucacgcagcuaugcucgauguugaccuuaggccugccuccgccuggacacuguacgcaguggcuaccacuaucauuacacccaugaugcgccauacgaucgaaaacaccacugccaauauaucauugacagcgaucgcuaaccaggccgcaauucugaugggacucgauaagggcuggccaaucucuaaaauggacauuggugucccucugcuugccuuagggugcuauagucaggugaauccgcugacccucaccgcugcagucuugaugcugguggcccacuacgcgaucauaggccccggacuacaagcuaaggccacacgggaggcacagaaacgaacugccgcuggcauuaugaagaacccaacgguugaugggaucguggccaucgaccuggauccuguaguguaugacgcaaaguucgaaaaacagcucggacagauuaugcuucugaucuuguguaccucgcaaauacugcucaugagaacaacuugggcucugugcgagagcauuaccuuagccacaggcccccuuaccacucugugggaggguuccccagggaaguuuuggaauacgacaaucgcggucucuauggccaacauuuucaggggaucauaccucgcaggcgcuggucuagccuucagccugaugaaauccuugggcgggggacgccggggcaccggggcacagggagaaacucugggcgagaaguggaaaagacagcucaaucagcuuaguaagucugaauuuaacaccuauaagcguagcgguaucauggagguugacaggucagaagcuaaagaggggcugaagcggggagagacaacuaaacaugccgugucccgcggcaccgccaaguugcgaugguucgucgaaagaaaucuggugaaaccugaggguaagguaauagaucucggcugugggaggggaggcuggaguuacuauugcgcgggguuaaagaaagugacagaaguuaagggauacacgaaaggcggucccgggcacgaggaaccgaucccaauggcuaccuacggauggaaccuggugaaacuucacagcggcaaagacgucuuuuucauuccucccgagaagugugauacucugcuaugcgacaucggcgagucuuccccaaaucccacaauugaagaggggcggacccuccgcgugcugaaaauggucgaaccuugguugagaggaaaccaauuuuguaucaagauucugaauccguauaugcccucagugguugagacucucgagcagaugcagaggaagcaugguggcaugcuuguacgaaacccacugagcagaaauucgacacacgaaauguacugggugucuugcgggaccggaaacaucgucagugcagugaauaugacgucccguauguuacugaacagauucaccauggcccaucgcaaaccuacauaugagagggauguugacuugggcgcugguacucggcacguggccgucgaacccgagguggcaaaccucgauauaauugggcagagaaucgaaaauaucaagcacgagcauaaaagcaccuggcacuacgacgaggauaacccuuauaagacaugggccuaccauggaucauaugaaguaaaaccauccggcucugcuagcaguauggugaauggcguugucaagcugcuaacuaagcccugggacgugauuccuauggugacccaaauagcgaugacagauaccacuccauuugggcagcagcgcgucuucaaagagaagguugacacgaggacacccaaagccaagcgaggaaccgcacaaaucauggaagugacugcuaaauggcuuugggguuuucugucccggaacaagaagccgagaauuuguaccagggaggaguucacacgcaaaguacguagcaaugccgcaaucggcgccguguuugucgacgagaaccaguggaacucugcuaaggaggccguggaagaugagcgguucugggaccucguucacagagaaagggagcugcauaaacaggggaagugcgcgacgugcguguacaacaugaugggaaaacgcgaaaagaaguugggcgaguuugguaaagcaaaggggucacgagccauuugguacauguggcugggagcucgguuccucgaguucgaagcccuuggcuuuaugaaugaggaucacugguucaguagagaaaacucccugagcggcgucgagggggagggauuacacaaacuggguuauaucuugagggacauaucuaagaucccuggcgggaauauguacgcagaugacaccgcuggaugggauacucgcauuacagaagacgaucuccagaacgaggccagaaucaccgacauuauggaaccagagcaugcucugcuagccaaaucgaucuuuaaacuuacuuaucaaaauaaagugguacggguucagaggcccgcaaagaacggcacagugauggaugucauaucacgucgagaccagcgcgguagcggacaggugggaaccuacggccugaauacauucacuaacauggaagcgcaacucauuagacagauggaguccgagggcaucuuuaguccuucugaacuggagaccccaaacuuggccgaacggguguuagauuggcuggagaaguauggggucgaaaggcucaaacgcauggcuaucagcggagacgacuguguugugaagcccauugaugacagauucgccacggcacuuaccgcucugaaugauauggguaaaguacggaaggacauaccgcagugggagccuuccaaaggcuggaacgauuggcagcaagugcccuuuugcucacaccauuuccaccagcuaaucaugaaggacgggagggagauugucgugccaugucgaaaucaggaugaacugguuggacgugccagagugagucagggcgcagguuggucucuccgcgagacagccugcuugggaaagagcuacgcgcaaauguggcagcugauguauuuucaccggagggaccuuagacuggcugccaacgcaaucuguuccgccgucccuguggauuggauucccacuucacgcaccacauggagcauccaugcucaccaucaguggaugacuaccgaagacaugcucucuguauggaaucggguuuggauagaggaaaacccauggauggaggauaaaacgcacaucuccaguuggggagacgugcccuacuuaggcaagagggaggaccaauggugcggcagccugauuggguugacagcccgagcaaccugggcuacuaauauccaggucgccauuaaccaggugagacggcugaucggaaaugaaaacuaccucgauuauaugacaucgaugaaaagguucaagaaugagggugaaccugagggcgcgcuuugguga

SEQ ID NO: 13898 - RNA, 9879 nt, Artificial Sequence
  derived and/or modified CDS sequence (opt3) from DENV-1__GU131723__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggagcacaaauacucguggaaaagcuggggcaaggccaagauaaucggggcggacguucagaauaccacauuuauuaucgauggaccaaacacuccugaaugucccgacgaucagagagccuggaauauuugggagguggaggacuauggcuucgguaucuuuaccacaaacauaugguugaagcucagggauuccuacacgcaggucugcgaccaccgucugaugucagcugcaauuaaagauaguaaggccgugcaugcugacaugggguauuggaucgaaucugagaaaaaugaaaccuggaagcuagcccgggcauccuucauugagguuaagacuuguaucuggccaaaaucccacacacuguggucaaacggagugcucgaaagcgagaugauaauccccaagauuuacggcgguccuaucucucaacauaauuaucgaccaggcuacuucacccagacugcggggccguggcaccugggaaaacuugaguuggauuuugaccugugcgaaggcacaaccguagucguggaugagcacugcgggaacagaggacccuccuuaaggacgacuaccgugacaggcaagauuauccaugaaugguguugccgcaguuguacccucccuccacugcgguucagaggugaggacgggugcugguacggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauugugggacagcugaccuggaacgaucuuauccguuugugcauuaugguuggcgccaaugcaucugacagaauggggaugggaacaacuuaucuggcuuuaauggccaccuucaagaugaggccuauguuugcagugggccuccuguuccgccggcuuacgagcagagagguccugcuacucacaauaggucugucauugguggccaguguugaacugccaaacuccuuagaggaacucggggauggacuggcuaugggcaucaugauucuuaaacuguugaccgacuuucaaucucaccagcucugggcgacucugcuaagccugaccuucaucaagacaacuuuuucccuucauuacgccuggaaaaccauggcaauggugcucucagucguaagccuguuccccuugugucugaguacgacaucucagaagaccacuugguuaccggugcuccugggcucccuugggugcaagccucugacaauguuuuugauugcugagaauaaaaucuggggaaggcgaagcuggccacucaacgaagguauaauggccguuggcaucgugucgauucugcuaucaucucugcuuaagaacgaugucccccucgccgggccucugaucgcuggaggcauguugauugcauguuaugugaucagugguuccagcgccgacuuaucucuggagaaagcggcugagguaagcugggaagaggaagccgagcacuccggggcaucacauaauauacucguggaaguccaggaugacggaaccaugaagauuaaagaugaggagcgcgacgauacucugacaauccuucugaaggccaccuugcuagcuguuaguggcguguacccccugagcaucccagcaacacucuucgugugguauuucuggcagaagaagaagcagcggucuggcguccugugggacacuccuucacccccagaaguggagagagccguucuugaugacgggauuuacaggauaaugcagcguggauuacugggucgcagccagguaggcgugggggucuuucaagaaaacguguuccacaccauguggcacguuacacggggagcggugcucauguaucagggcaaaagauuggagccgaguugggcuagcgucaagaaagaccugaucuccuacggugggggauggaggcuccagggcucuuggaauaccggcgaggaagugcagguaauugccgucgagccugggaagaaccccaaaaaugugcaaacagcaccaggaacuuuuaagacccccgaaggugagguuggcgccaucgcucuggauuucaagccugggacgucgggaagcccaauugugaaccgagaaggcaaaaucgucggucuuuacgggaauggagugguuacaacuucaggcaccuauguguccgccauagcacaggcuaaggccagucaggagggcccccugccugagaucgaagacgaggucuuucggaaacgcaacuugacaauuauggaucuacauccggggucuggaaagaccagaagguaccugccagcgaucgugcgggaagccauuaaacgaaagcucagaacuuuaauccuggcacccacccgcguaguggcuagcgagauggccgaagcucuuaaggguaugccuauaagguaucaaacaacggcaguuaaauccgagcacacuggcaaggagauugucgaccugaugugccaugccaccuucacaaugcgucucuugucaccagugcgggugcccaauuacaacaugaucaucauggaugaagcccacuuuaccgacccuucuagcauugcugcgagaggguauaucaguacuagggucggaaugggcgaggcagccgcuauauucaugacagccaccccgcccgguuccguagaagcauuuccacagagcaaugccgugauucaggaugaggaacgcgacaucccugagcgaucuuggaacucaggguacgaguggauuacggauuuccccggaaaaacuguuugguuugugccauccaucaagaguggcaaugacauagcuaacugucugaggaaaaauggcaagcgggucauucagcucagcaggaagacauucgauaccgaauaucagaaaaccaagaacaacgacugggacuacgugguuacuacagauaucucggagaugggggcgaauuuccgcgccgaccgugugaucgauccuagacggugccugaaacccgucauucuuaaggacggaccagaaagggugauccuagcagguccgaugccuguaaccguggcuucugccgcacagcgccgaggcagaguugggcggaaccauaauaaagagggagaucaguacauuuauaugggccagccccugaacaaugacgaggaucacgcccacuggacagaagcuaagauguuguuagacaacauaaauacuccagaggguaucauucccgcccuguuugaaccugagagggaaaaguccgcggcaaucgauggggaguaccgccucagaggcgaggccaggaaaacguucgucgaacugaugcggcguggagaccuuccaguguggcugagcuauaagguggcuucagagggcuuucaauacagugaucgccgauggugcuucgacggggaaagaaacaaucagguccucgaggaaaacauggauguugagaucuggaccaaagagggagaaaggaagaaauugcggccccgcuggcuggacgccagaacauauucugacccucuagcucugagggaguuuaaggaguucgcagccggucggcgauccgugagcggcgaucucauucuugagauagggaaacugccgcagcauuuaacucagagagcucaaaaugccuuggacaaccugguaaugcuccacaauucagaacagggaggccgcgcauacaggcaugcgauggaggagcugccagauaccaucgaaacacuuaugcugcucgccuugauugcugugcugaccgguggggucacuuuauuuuuccuaaguggccggggacugggcaagacgagcaucgggcuccuuugugugauggccuccucuguucuguuguggauggcaagcguggagccccacuggauugcugccuccaucauacuggaauuuuuccucaugguccugcuuaucccugagcccgaccgucagagaaccccacaggauaaccaacucgcauauguagugauuggacuguuguuuaugauccugacaguugccgcuaaugagauggguuuacuagaaacuaccaagaaagaccugggcauugggcacguggcggucgagaaccaucaccaugccgcaaugcucgauguggaccuucacccugcuucagccuggacacuguacgccgucgcaaccacuaucauaacacccaugaugaggcauacgauugaaaacaccacugcuaauaucucuuugacagccauugcgaaccaggcugccauccugaugggacucgauaagggcuggccaauaaguaaaauggacaucggugugccucugcuugcauuagggugcuacucgcagguuaauccgcugacccucaccgccgcuguguugaugcugguagcacacuaugccauuaucggccccggacuacaagcgaaggcuacacgcgaggcccagaaacggacugcagccggcauuaugaagaacccaacgguggaugggaucgucgcuauagaccuggauccuguuguguacgacgccaaguucgaaaaacagcucggacagauuaugcuucugaucuuguguaccagccaaauccugcucaugcgaacaacuugggcacugugcgaguccauuaccuuagcuacaggcccccuuaccacucugugggaggguucuccagggaaguuuuggaauacgacaaucgccgucucaauggcgaacauauucagaggaagcuaucucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuacaagagaucagguauuauggagguggaccguuccgaagcaaaagaggggcugaagaggggagagacaacuaaacacgcuguaagucggggcaccgccaaguugcgcugguucguggaacgaaaucugguuaaaccugaggguaaggugaucgaucucggcugugggagaggaggcuggagcuauuacugcgccggguuaaagaaagucacagaagugaagggauauacgaaaggcggucccgggcaugaggaaccgauuccaauggcgaccuacggauggaaccuggucaaacuucacucuggcaaagacguguuuuucaucccucccgagaagugugauacucugcuaugcgacauaggcgaguccucaccaaaucccacaaucgaagaggggaggacccuccggguucugaaaaugguagaaccuugguugcgcggaaaccaauuuuguauuaagauccugaauccguacaugcccagcguggucgagacucucgagcagaugcagagaaagcaugguggcaugcuugugaggaacccacugucgcgaaauucuacacacgaaauguauuggguuaguugcgggaccggaaacauuguguccgcugucaauaugacgagccggauguuacugaaccguuucaccauggcacacagaaaaccuacauacgagcgcgauguggacuugggcgccgguacuaggcauguagcuguggaacccgagguugccaaccucgauaucauugggcagcggaucgaaaauauaaagcacgagcauaaaucaaccuggcacuaugacgaggauaacccuuacaagacaugggcauaucauggauccuacgaagucaaaccaucuggcagcgccaguuccauggugaauggcguggucaagcugcuaacuaagcccugggacguuauuccuauggugacccaaaucgcuaugacagauaccacuccauuugggcagcagagaguauucaaagagaagguggacacgcgcacacccaaagcgaagaggggaaccgcccaaaucauggaagucacugcaaaauggcuuugggguuuucugagccgaaacaagaagccgcggauuuguaccagagaggaguucacaaggaaagugcgcucuaaugcugccauaggcgcaguuuuuguggacgagaaccaguggaacucagccaaggaggcugucgaagaugagcguuucugggaccucgugcaccgggaaagagagcugcacaaacaggggaagugcgccacgugcguauauaacaugaugggaaaaagggaaaagaaguugggcgaguuugguaaagcgaaggggagucgcgcaaucugguacauguggcugggagcccgauuccucgaguucgaagcucuuggcuuuaugaaugaggaucauugguucucccgggaaaacagccugucuggcguugagggggagggauuacacaaacuggguuacauuuugagagacaucucgaagauuccuggcgggaauauguaugccgaugacaccgcaggaugggauacuaggaucacagaagacgaucuccagaacgaggcucgcauaaccgacaucauggaaccagagcaugcccugcuagcuaaaucaauuuuuaaacuuacuuaccaaaauaaaguggucagagugcagcggcccgccaagaacggcacagugauggaugucaucagcaggcgugaccagcgagguuccgggcagguuggaaccuauggccugaauacauucacuaacauggaagcacaacucauucgccagauggagagugagggcaucuuuucuccuagcgaacuggagaccccaaacuuggcggaaagaguguuagauuggcuggagaaguacgggguagaacggcucaaaaggauggccauauccggagacgacuguguggucaagcccauugaugaccgcuucgcuacggcccuuaccgcacugaaugauauggguaaagugagaaaggacaucccgcagugggagccuucaaaaggcuggaacgauuggcagcaaguucccuuuugcagucaccacuuccaucagcuaaucaugaaggacgggcgggagauuguggucccauguaggaaucaggaugaacuggugggacgagcucguguaucucagggcgccgguuggagccucagagagacagcaugcuuggggaaguccuaugcccaaauguggcagcugauguacuuucaccgccgggaccuuaggcuggcggcuaacgccauauguucagcaguuccuguggauuggauccccacuagcagaaccacauggucuauucaugcccaccaucaguggaugacuaccgaagacaugcucuccgucuggaaucgcguguggaucgaggaaaacccauggauggaggauaaaacgcacauuaguagcuggggagacguucccuauuuaggcaagcgggaggaccaauggugcggcucgcugaucggguugacagcuagggccaccugggcaacuaauauacagguggcuaucaaccagguccgaagacugauuggaaaugaaaacuaccucgauuacaugacauccaugaaacgguucaagaaugagucugacccugaaggugcccuuugguga

SEQ ID NO: 13899 - RNA, 9879 nt, Artificial Sequence
  derived and/or modified CDS sequence (opt3) from DENV-1__GU131725__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaauaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucucugaaauggucuugcuaacgaugaaggagaaauccuggcuggugcauaagcagugguuucucgaucugccgcuucccuggaccucaggcgcaagcacaagucaagagacauggaaccggcaggaccuguugguaaccuucaaaacagcucacgccaagaagcaggaaguugugguccucgguucucaagagggggcuaugcacacugcccugaccggcgcaacggaaauccagaccuccggaacaacuaccauuuuugccggccauuuaaaaugccgucugaagauggauaaacuaacacucaaggggaugagcuaugugauguguacuggaucguucaaacuggagaaggaagucgcugagacccagcacgguacggugcuuguucagauaaaguacgagggcacagacgcgccuugcaaaaucccauucucuacccaagaugaaaagggggugacucagaauggacgcuugauuacagcaaaccccaucguaaccgacaaagagaagccugucaauauagaagccgagccacccuuuggcgaguccuauauugugaucggugcuggggaaaaagcccugaagcucucaugguucaagaaaggcaguagcaucggaaagauguuugaggcaacugccagaggcgcuaggcggauggccauucugggggauaccgcaugggacuucggauccaucgguggcguuuuuacaucuguggggaaacuuguccaucagauuuucggaacggcguacggcgugcuguuuagcgguguaucauggaccaugaagauagggaucggcguguugcucacuuggcugggauuaaacagucgauccacaagccugucuaugaccuguauugcuguuggccuagucacacucuaccugggggugauggugcaggccgauucaggaugcgucaucaauuggaaaggccgcgaacuuaagugugguagugggaucuucguuacuaacgaggugcacaccuggacggaacaauauaaguuucaggcagacagcccgaaaagauuguccgccgcuauuggaaaggccugggaggagggcgugugcgguauaaggucugcaacacggcuggaaaauaucauguggaaacagauuucgaacgagcucaaccauauccuguuagaaaaugacaugaagcugaccguagucgugggcgauguugcugggauucuuggacagggcaaaaagaugauccgcccucaacccauggaguacaaauauagcuggaaguccugggggaaggccaaaauaaucggagcggacgcccagaacacuaccuucauuaucgauggcccaaauacaccugaaugucccgacgaucagagagcuuggaacauuugggagguggaggacuacgguuuugggaucuucacuaccaauauaugguugaagcucagggauucauauacacaggucugcgaccaccgucugaugagugcagccauuaaagauucuaaggcugugcacgccgacaugggauacuggaucgaaagcgagaaaaacgaaacguggaagcuagcacgggcguccuuuauugagguuaagaccuguaucuggccaaaaucacauacucuguggagcaauggcgugcucgaaucugagaugauaauccccaagauuuaugguggcccuaucucccaacacaacuaccgaccaggguacuucacacagaccgccggaccguggcaucugggcaaacuugaguuggauuucgaccugugcgaagggacuacaguagucguggaugagcacugcggaaauagaggccccaguuuaaggaccacgacugugaccgguaagauuauccacgaaugguguugccgcagcuguacacucccuccacugcgguuuagaggggaggacggaugcugguauggcauggagauaaggcccgucaaagaaaaggaggaaaaccuuguuaagucuaugguguccgcugguucaggcgagguagacaguuucagccugggguugcucuguauuucgaucaugaucgaagaggugaugcgcucccgauggucucggaaaaugcugaugaccggaacucuagccgucuuuuuccugcucauuaugggccagcugacauggaaugaucuuauccguuugugcauuauggugggggcaaacgcuagcgacagaaugggaaugggcaccacauaccuggccuuaauggcaacuuuuaagaugaggccuauguucgccguuggucuccuguuucgccggcuuaccucaagagaggugcugcuacucacgauagggcugaguuuggucgcuuccguggaacugccaaauucuuuagaggaacucggagauggccuggcgaugggcaucaugauucuuaaacuguugacagacuuccaaagcuaucagcucugggccacccugcuaucccugacuuuuaucaagaccacauucucacuucauuacgcauggaaaacuauggcuaugguucucagcauugugagucuguuucccuugugucugucuaccacgucccagaagacaaccugguuaccgguccuccuggggagccuuggaugcaagccucugacuauguucuugaucgccgagaacaaaauaugggguaggaagucguggccacucaaugaaggcaucauggccguagggauugugucaauccugcuaucuagucugcuuaaaaacgauguuccccucgcuggaccucugauugcaggcgguauguugaucgccuguuaugugauauccgggagcucugcggacuuaagccuggagaaggcugccgaggucuccugggaagaggaagcagagcacucaggagccagucauaacauucucguggaaguacaggaugacggcacaaugaaaaucaaggaugaggagcgagacgauacccugacuauccuucugaaagcuacauugcuagcagugagcggcgucuacccccugucuauuccagccacccucuuuguuugguauuucuggcaaaagaagaaacagcgcuccggggugcugugggacacgccuucacccccagaaguggagcgggcgguccuugaugacggaauauacagaaucaugcagagggguuuacugggccguagucagguggggguuggaguauuccaagaaaauguguuucacacuauguggcaugucacccgcggcgcugugcucauguaccaggguaagcgguuggagccgagcugggccuccguuaaaaaggaccugauuucuuaugggggaggcuggagacucaggggcucguggaacacaggggaggaagugcaggucaucgcaguggagccuggcaagaaucccaagaacguacagaccgccccagguacauucaagacucccgaaggcgaggucggggcuauugcccuggauuuuaaaccuggaaccagcggcucaccaaucgugaaucgagaagguaagauaguugggcuuuacggaaacggcguggucacgacauccggcacuuaugugagugcaaucgcucaagccaaagcgucucaggaggggccccugccugagauugaagacgagguuuuccggaagcgcaauuugaccaucauggaucuacacccgggaagcgguaaaacaagaagguaccugccagccauugugcgggaagcaaucaagcgaaagcucagaaccuuaauacuggcucccacucgcgucguggccuccgagauggcugaagcacuuaaaggcaugccuauuagguaucagaccacagccguaaagggggagcacacgggaaaagagaucguggaccugaugugccaugccacuuuuaccaugcgucucuugucaccaguucggguccccaacuacaauaugaucauuauggaugaagcucacuucacagacccuucuagcaucgcggcaagaggcuauauaaguaccaggguggguaugggggaggccgcugccauuuuuaugacugcaacaccgcccggauccguggaagccuucccacaaagcaacgcugucauccaggaugaggaacgcgacauuccugagcgaucuuggaacucaggcuacgaguggaucaccgauuuucccggcaagacgguaugguucgugccauccauaaaaagugggaacgacauugcgaauugucugagaaagaacggaaagcggguuauccagcucagcaggaaaacuuuugauacagaauaccagaagaccaaaaauaacgacugggacuauguggucaccacugauaucucggagaugggugccaacuuccgcgcagaccgugugauugauccuagacggugccugaagcccguuauccuuaaagacggcccagaaagggugauucuagcugggccgaugccugucacaguggccucugcagcccaacgccgaggaagaauaggccggaaucauaacaaggagggugaucaguacaucuauauggggcagccccugaauaacgacgaggaucacgcucauuggaccgaagccaagauguuguuagacaauauuaacacaccagagggcaucauccccgcgcuguucgaaccugagagggaaaaauccgcagccguagauggagaguaccgccucagaggcgaggcuaggaagacuuuuguggaacugaugcggcguggggaccuuccaguuuggcugagcuauaaagucgccucagagggauuccaguacagugaucgccgauggugcuuugacggugaaagaaauaaccaagugcucgaggaaaauauggauguggagauuuggacgaaggagggcgaaaggaaaaaguugcggccccgcuggcuggacgcuagaaccuauucugacccucuagcacugagggaguucaaagaauuugccgcugggcggcgauccgucagcggagaucucauacuugagaucggcaagcugccgcagcacuuaacacagagagcccagaacgcauuggacaaucugguuaugcuccacaacucagaacaaggugggcgcgcguacaggcaugccauggaggagcugccagauacuauugaaacccuuaugcugcucgcuuugaucgccgugcugacaggcggaguaaccuuauucuuucuaaguggccgggggcugggaaagacuagcauuggucuccuuugugugauggcauccucuguccuguuguggauggcuagcguggagccccacuggaucgccgcauccauaauccuggaguucuuucucaugguucugcuuauuccugagcccgaccgucagagaacgccacaggauaaucagcucgccuacguggucaucggccuguuguucaugauucugaccguagcugcgaacgagaugggguuacuagaaacaacuaaaaaggaccugggaaucggccauguggccguugagaaucaccaccaugcagcuaugcucgauguggaccuucacccugccucagccuggacccuguaugcagucgcuacaaccauaauuacucccaugaugaggcauacaaucgaaaacacgaccgccaacauuucuuugacugcgaucgcuaaucaagccgcaauacugaugggucucgauaaaggguggccaaucaguaagauggacauuggcgugccucugcuugccuuaggaugcuacucgcaggucaacccgcugacacucaccgcugcaguguugaugcugguugcccacuaugcgaucauuggccccgggcuacaggcuaaagccacccgcgaggcacaaaagcggacagccgcuggaaucaugaagaauccaacuguggauggcauaguagccauugaccuggauccuguggucuacgacgcaaaauuugaaaagcagcucggucagaucaugcuucugaucuuguguacgagccagauucugcucaugcgaaccacaugggcucugugcgaguccaucacuuuagccaccgggccccuuacaacccugugggagggaucuccaggcaaauucuggaacacuacgauagcgguuucaauggccaauauuuuuagagguagcuaucucgcaggcgcugggcuagccuucucccugaugaagaguuugggaggcgggaggcgcggaacaggcgcacaaggugaaacccugggggagaaauggaagcggcagcucaaccagcuuucuaagagcgaguucaauacuuacaaaagaucaggaaucauggagguggaccguuccgaagcuaaggagggccugaaaaggggugagaccacaaagcaugccgucagucggggcacugccaaauugcgcugguuuguggaacgaaaccugguaaagccugaggggaaggugauugaucucggauguggcagagggggauggagcuauuacugcgcgggccugaaaaagguuaccgaagugaaagguuacacaaaagggggacccggccacgaggaaccgaucccaauggcuacguauggcuggaaucuagucaaacuucacucugggaaggacguguucuuuauaccucccgagaaaugugauacccugcuaugcgacaucggagaguccucaccaaaccccacuauugaagaggguaggacacuccggguccugaagaugguggaaccuugguugcgcggcaaucaguucuguaucaagauucugaacccguacaugcccagcguuguagagacccucgagcaaaugcagagaaaacaugggggaaugcuugugaggaauccacugucgcgaaacucuacucacgaaauguauugggucaguugcggcacagguaauaucguguccgcaguuaacaugaccagccggauguuacugaaucguuuuacgauggcccauagaaagccuaccuacgagcgcgauguggacuuggggacaggaacuaggcacgucgcuguggaacccgagguagccaaccucgauauuaucggccagcggauagaaaacauuaaacacgagcauaagucaaccuggcacuaugacgaggauaauccuuacaaaacaugggcauaucauggcuccuacgaagugaagccaucugggagcgccaguuccaugguuaacggagucgugaagcugcuaacuaaacccugggacgugaucccuauggucacccagaucgcuaugacagauaccacuccauucggucaacagagaguuuuuaaggagaaaguggacacgcgcacacccaaggcgaaaaggggcaccgcccagauuauggaaguaacugcacgauggcuuuggggguuccugagccggaauaagaagccgagaauauguaccagggaggaauuuacacgcaaagugcguucuaacgcugccaucggagcagucuucguggacgagaaucaauggaacucagccaaggaggcuguugaagaugagcgguuuugggaccucgugcacagagaaagggagcugcauaaacagggcaagugcgccacgugcgucuacaauaugauggguaaacgcgaaaagaaguugggggaguucggaaaagcgaagggcagucgagcaauuugguauauguggcugggcgcccgguuucucgaguucgaagcucuuggguucaugaacgaggaucacugguuuuccagagaaaauagccugucuggaguggagggugagggcuuacacaaacugggguacaucuugagggacauuucgaagaucccuggaggcaacauguaugccgaugacaccgcagguugggauacucgcauaacagaagacgaucuccagaaugaggcuaaaaucaccgacauuauggaaccagagcaugcccugcuagcuaaggccaucuucaaacuuacuuaccagaacaagguaguuagagugcaacggcccgcaaagaaugggacagucauggaugugauuucaaggcgugaccagcgaggaagcggccaggugggcaccuaugggcugaacacauuuacuaauauggaagcgcagcucauccgccaaauggaguccgagggaauauucaguccuucugaacuggagaccccaaacuuggccgaaagagcuuuagauuggcuggagaaauacggugucgaacggcucaagaggauggccauuagcggcgacgacuguguugugaaacccaucgaugaccgcuuugcaacggcucuuaccgcccugaacgauauggggaagguaagaaaagacaucccgcagugggagccuucccggggauggaaugauuggcaacaggugcccuucugcucacaccauuuucaccaacuaauuaugaaggacggcagggagauagucgugccaugucgaaaccaggaugaacugguuggucgugcaagagugagucagggggccggauggucucuccgcgagacagcgugcuugggcaagagcuaugcucagauguggcaacugauguacuuccaccggagggaccuuagacuggccgcaaaugccaucuguuccgcugucccuguggauuggguacccacuucacgcaccacauggagcauucaugcccaccaucaguggaugacuaccgaagacaugcucucuguuuggaaccggguguggaucgaggaaaauccauggauggaggauaaaacgcacauuuccaguugggaggacguccccuacuuaggcaagagggaagaccaguggugcgggagccugaucggauugacagcacgagcuaccugggccacuaacauacaaguggcgaucaaucagguuagacggcugauugguaacgagaauuaucucgauuacaugacaucgaugaaaagguuuaagaacgaauccgacccugagggcgcucuuugguga

SEQ ID NO: 13900 - RNA, 9879 nt, Artificial Sequence
  derived and/or modified CDS sequence (opt3) from DENV-1__GU131726__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggagaacugugugaagauaccaugaccuacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcucguucaaacuggagaaggaaguggcugagacccagcacgguacgguccuugugcagauaaaguacgagggcacagacgcgccuugcaaaaucccauucucgacccaagaugaaaagggggcaacucagaacggacgcuugauuacagccaaucccaucguuaccgacaaagagaagccugugaacauagaagcugagccacccuuuggcgagucuuauauuguaaucggugccggggaaaaagcacugaagcucuccugguucaagaaaggcucaaguaucggaaagauguuugaggccacugcuagaggcgccaggcggauggcaauucugggggauaccgcgugggacuucggaagcgucgguggcguguuuacauccguugggaaacuugugcaucagaucuucggaacggcuuacggcguccuguuuucuggugugagcuggaccaugaagauugggauaggcguauugcucacuuggcugggauuaaauucacgaaguacaucccugagcaugaccuguaucgccgugggccuaguuacacucuaccugggggucauggugcaggcagauucuggaugcgugauuaacuggaaaggccgcgaacuuaagugugguucagggaucuucgucacuaaugagguucacaccuggacggaacaauauaaguuucaggccgacaguccgaaaagauugagcgcugccaucggaaaggcaugggaggagggcgugugcgguauuagguccgcuacacggcuggaaaacauaauguggaaacagaucucuaacgagcucaaucauauucuguuagaaaacgacaugaaguucaccgugguagucggcgaugugguugggauccuggcccagggcaaaaagaugauucgcccucaacccauggagcacaaauacucguggaaaagcuggggcaaggcgaagaucauaggggccgacgugcagaauacuaccuuuaucauugauggaccaaacacaccugaaugucccgacgaucagagagcuuggaauaucugggaggucgaggacuauggcuucgguauuuuugcaacuaacaucuggcuuaaguugagggauuccuacacccaggugugcgaccaccgucucaugucagccgcuauaaaagauaguaaggccguucaugcagacaugggguauuggauugaaucugagaaaaaugaaacauggaagcuggcgcgggccagcuucaucgaggugaagacguguauuuggccaaaaucccacacccuauggucaaacggaguacuggaaagcgagaugaucauacccaagaucuacggcgguccuauuucucaacauaauuaucgaccaggcuacuucacucagacagcugggccguggcaccucggaaaacuggagcuugauuuugacuugugcgaaggcaccacugucgugguggaugagcacugcgggaacagaggacccucccugaggacaaccacggucacuggcaagaucauucaugaaugguguugccgcaguuguaccuuaccuccacuccgguucaaaggugaggacgggugcugguacggaauggagaucagacccguuaaggaaaaggaggaaaaucuggugaaaagcaugguaucugccggcuccggugagguggacucauuuagucuuggccuguuguguauaagcauuaugaucgaagaggucaugaggucgcgcuggucccgaaagaugcucaugacagggacccuggcaguguuccuacugcucaucaugggacagcugacuuggaacgaucuuauucgguugugcaucaugguuggcgcuaaugccucugaccguauggggaugggaacaaccuaucuggcauuaauggccacauuuaaaaugagaccuauguucgcugugggccuccugcuuaggcgccugacuagccgggagguccuacuccugaccauugguuugucacugguggcgaguguugaauuaccaaacucccucgaggaacugggggauggacuugccaugggcauaaugauccugaaguugcucacggacuuucaaucucaccagcugugggcaacacuacugagccuuaccuucauuaaaacuacccucucccugcauuacgcuuggaagacaauggccaugguguugucaaucgucagccuguuucccuuaugucucaguacuaccucucagaagacgacauggcugccgguacuucugggcuccuucgggugcaaaccuuugaccauguuucucauuacugagaauaagaucuggggaagaaaaagcuggccacugaacgaagguauaauggccgugggcguugugucgauccuacugucaucucuucucaagaacgaugucccccuggcugggccuuugauugcaggaggcauguuaaucgccuguuaugugauuagugguuccagccccgaccugucucucgagaaagcggcugagguaagcugggaagaggaagccgagcacuccggggcaucacauaauauccugguggaaguccaggaugacggaacaaugaagauaaaagaugaggagagggacgauacccuuacuauucuguugaaggccacacuacuggcuguuaguggcguguacccacucagcaucccugcaacccuguucgugugguauuuuuggcaaaagaaaaagcagcgaucuggcguccuuugggacacgcccuccccaccggaaguggagcgcgccguuuuagaugacgggaucuaccggauuaugcagagaggacugcucgguaggucacagguaggcgugggggucuuccaagaaaacguguuccacacuauguggcacguuacccguggagcgguguugauguaucagggcaaacgccuggagccuaguugggcuagcgucaagaaagaccucauauccuacggugggggauggcggcugcagggcucuuggaauacaggcgaggaagugcagguaaucgccgucgagcccgggaagaacccaaagaaugugcaaaccgcacccggaacauuuaaaacuccugaaggugagguuggcgccauugcucuugauuucaagccagggaccucgggaagccccaucgugaacagagaaggcaaaauugucggucuguacgggaauggagugguuacgacaucaggcacuuauguguccgccaucgcacaggcuaaggccagucaggagggcccuuugccggagauagaagacgaggucuuuaggaaacgaaaccuaaccaucauggaucugcauccagggucuggaaagacacggcgcuaccuccccgcgauugugagagaagccaucaagaggaaauuacggacccugauucuugcaccuacucgaguaguggcuagcgagauggccgaagcucugaaggguaugccaaucagauaucaaaccacagcaguuaaauccgagcacacgggcaaggagauagucgaccucaugugccaugccacuuucaccaugcgcuugcugucacccgugagggugccuaauuacaacaugauuaucauggaugaagcccacuuuacagacccgucuagcaucgcugcgcguggguauauuaguacccgggucggaaugggcgaggcagccgcuaucuucaugacugccacacccccagguuccguagaagcauuuccucagagcaaugccgugauacaggaugaggaaagagacauucccgagaggucuuggaacucaggguacgaguggaucaccgauuucccaggaaaaacgguuugguuugugccuuccauuaagaguggcaaugacaucgcuaacugucuccgcaagaauggcaaacgagucauacagcugagcagaaagacuuucgauacagaauaucagaaaaccaagaacaacgacugggacuacgugguuaccacugauauuucggagaugggggcgaauuuucgggccgacagggugaucgauccccgccguugccuuaaaccagucauccuaaaggacggaccggaaagagugauucuggcagguccuaugcccguaacaguggcuucugccgcacagcggaggggccgcaucgggcgaaaccauaauaaggagggagaucaguacauuuauaugggccagccauugaacaaugacgaggaucacgcccacuggaccgaagcuaaaauguuacuggacaacauaaauacacccgaggguaucauuccugcccucuucgaaccagagagagaaaaguccgcggcaaucgauggggaguaccggcugaggggcgaggcccgcaaaacuuucguugaacuuaugagaaggggagaccugcccgucuggcucagcuauaagguggcuucagagggcuuucaauacagugaucggcguuggugcuucgacggggaacgcaacaaucagguguuggaggaaaacauggaugucgagaucuggacgaaagagggagaacgaaagaaacugagaccuagguggcuagacgcccggaccuauucugacccgcuggcucuccgcgaguuuaaggaguucgcagccgguagaagguccguuagcggcgaucuuauucuggagauagggaaguuaccacagcauuugacacagcgggcucaaaaugcccuggacaaccucgugaugcugcacaauucagaacagggaggccgagcauacagacaugcgauggaggagcuucccgauacuaucgaaacccugaugcucuuggcccugauugcuguauuaacagguggggugacccuauuuuuccugaguggccgcggacucggcaaaacuagcaucgggcuucugugugucauggccuccucuguguugcuguggauggcaagcguugagccucacuggauugcugccuccaucauacucgaauuuuuccugauggugcuucucauccccgagccagacaggcagcggacgccucaggauaaccaacuggcauaugucguaauuggauugcuguuuaugaucuuaaccguggccgcuaaugagaugggucuacuggaaacaacuaagaaagaccucggcauugggcacguugcgguggagaaccaucaccaugccaccaugcuugaugucgaccugcaccccgcaucagcuuggacauuguacgccguggccaccacuaucauaacaccaaugaugcgucauacgauugaaaacaccacugcaaauaucucucugacagcuauugccaaccaggcggcuauccucaugggacuggauaagggcuggccuauaaguaaaauggacaucggugucccgcuuuuagcccuggggugcuacagccaggugaauccccucaccuugaccgcagccguucugaugcuaguggcucacuaugcaauuaucggcccaggacugcaagccaaggcgacaagagaggcucagaagaggacugccgcaggcauuaugaaaaacccuacgguagaugggaucguggccauagaccucgaucccgucguuuacgacgcuaaguucgaaaaacagcuuggacagauuaugcuguugauccuguguaccagccaaauccuccugaugcgcacaacuugggccuuaugcgaguccauuacccuugcaacaggcccacugaccacucucugggaggguucuccugggaaguuuuggaauacgacaaucgcugugucaauggccaacauauuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacauuuacaagcgcucagguaucauggaggucgaccgguccgaagccaaagagggguugaagagaggagagaccacacgucacgcagugaguaggggcacugcuaaacugcggugguucguagaacgcaaucucgugaagcccgaggguaagguuauugauuuaggcugugggcgaggaggcuggagcuauuacugcgccgggcugaaaaaggugaccgaagucaaaggauauacaaagggcgguccggggcaugaggaaccaaucccuauggccacguacggauggaaccuugugaaacugcacucuggcaaggacgucuuuuucacacccccagagaaaugugauacucuacucugcgacauaggcgaguccucacccaauccuacaaucgaagaggggagaacccugaggguguugaagaugguugaaccguggcugcggggaaaccaauuuuguauuaagauccucaaucccuacaugccaagcguaguggagacucuugagcagaugcagcgcaaacaugguggcaugcuggucagaaacccuuuaucgagaaauucuacacacgaaauguauugggugaguugcgggaccggaaacauuguuuccgcggugaauaugacgagccgaaugcuguugaaccgguucaccauggcucaccguaagcccacauacgagagagaugucgaccucggcgcagguacucgccauguggccguagaaccugagguggcuaaccuggauaucauugggcagaggaucgaaaauauaaaacacgagcauaagucaaccuggcacuaugacgaggauaacccauacaaaacaugggccuaucauggauccuacgaaguuaagcccucuggcagcgcaaguuccauggucaauggcguggugaagcuacuuacuaaaccuugggacgucauuccaaugguuacccaaaucgccaugacagauaccacucccuuugggcagcagcggguguucaaggagaaaguagacacgagaacaccgaaggcuaaacgcggaaccgcgcaaaucauggaagugacugccagguggcugugggguuuucucagccgaaacaagaagccucggauuuguaccagagaggaguucacaaggaaaguccgcucuaaugcagcuauaggcgccguguuuguugacgagaaccaguggaacucagcaaaggaggccguggaagaugagcguuucugggaccugguccagaaagaacgggaguugcacaagcaggggaaaugcgcuacgugcguguauaacaugaugggaaagagagaaaagaaacugggcgaguuugguaaggccaaagggaguagggcgaucugguacauguggcucggagcacgcuuccuugaguuugaagcccugggcuucaugaaugaggaucacugguucucccgagaaaacagcuuaucuggcguagagggggagggacugcauaaguuggguuacauucuccgggacaucucgaaaauuccaggcgggaauauguaugcugaugacaccgccggaugggauacuagaaucacagaagacgaucugcaaaacgaggcaaagauaaccgacaucauggaacccgagcacgcucuacuugccacuucaauuuuuaaacugacauaccagaauaagguugugaggguccagcgcccugcuaagaacggcaccgugauggaugugaucagcagacgggaccagagggguuccgggcaagucggaacauauggccucaauacuuucaccaacauggaagcccagcugauucgucagauggagagugagggcaucuuuuugccaucugaauuagagacgcccaaccuggcagaacgaguucucgauuggcuugagaaauacgggguggaacgccugaagagaauggcgauaagcggagacgacuguguagugaaaccgauugaugaccgguucgccaccgcucuaacagcccugaaugauauggguaaggucaggaaagacaucccucagugggagcccuccaagggcuggaacgauuggcaacaggugccauuuugcucacaucacuuccaccagcucaucaugaaggacgggcgcgagauuguugugccuuguagaaaucaggaugaauuggucggacgggcaagggugagucaaggcgcugguuggucucugcgagagacugccugccuugggaaaagcuaugcacagauguggcagcugauguacuuucaucguagagaccuccgcuuagccgcgaacgcuauauguuccgccguacccaucgauuggguuccaaccucacggacaacuuggagcauucacgcacaucaccaauggaugaccacggaagacaugcugucuguguggaauagggucuggaucgaggaaaaccccuggauggaggauaagacacauguguccaguuggggagacguuccuuauuugggcaaaagagaggaccaguggugcggcagccugauugggcucaccgcccgcgcuacuugggccucgaauauccagguggcaauaaaccagguccggaggcuuaucggaaaugaaaacuaccuggauuacaugacauccaugaagcgauucaaaaaugagggugacccagaaggcgcucuaugguga

SEQ ID NO: 13901 - RNA, 9879 nt, Artificial Sequence
  derived and/or modified CDS sequence (opt3) from DENV-1__GU131727__SS-prME
agcgugaccaugcugcucaugcuuaugcccaccgcccuggcuuuccacuugacuacgaggggaggggagccucauaugaucguaaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgucagcuuguucccccuguguuuaaguaccacgucucagaagacaaccuggcucccggugcugcuuggcucccuggggugcaaaccuuugacuauguaucucauuacagagaauaagaucuggggaagaaaaagcuggccacugaacgaagguauaauggcuguuggcguggucucgauccuacugucaucucuucucaagaacgaugugccccuggccgggccuuugauugccggaggcauguuaaucgcuuguuacguaauuagugguuccagcgcagaccugucucucgagaaagccgcggaggugagcugggaagaggaagcugagcacuccggggccucacauaauauccuggucgaaguucaggaugacggaaccaugaagauaaaagaugaggagagggacgauacucuuacaauucuguugaaggcaacccuacuggccgugaguggcguguauccccucagcaucccagcuacgcuguuugucugguacuucuggcaaaagaaaaagcagcgaucuggcgugcuuugggacacuccuucacccccagaaguugagcgcgcaguauuagaugacgggaucuaucggauuaugcagagaggacugcucgguaggagccaggugggcgucgggguguuucaagaaaacguuuuccacaccauguggcacgugacacguggagccgucuugauguaccagggcaaacgccuggagccgaguugggcgagcgugaagaaagaccucauauccuacggugggggauggcggcugcagggcucuuggaauaccggcgaggaaguacaggucaucgcuguggagccugggaagaaccccaagaauguucaaacagccccaggaacuuucaaaacccccgaaggugaggugggcgcaauugcccuugauuuuaagccugggacgucgggaagcccaaucgucaacagagaaggcaaaauugugggucuguaugggaauggaguugugacaacuucaggcaccuacgucuccgcuaucgcccaggcaaaggcuagucaggagggccccuugccugagauagaagacgagguguucaggaaacgaaaccuaacaaucauggaucugcauccggggucuggaaagacccggcgcuaucucccagccauuguaagagaagcgaucaagaggaaauuacggacucugauucuugcccccacccgagugguugcaagcgagauggcugaagcccugaaggguaugccuaucagauaccaaacaacggcugucaaauccgagcacacuggcaaggagauaguggaccucaugugccaugcaaccuuuacaaugcgcuugcugucaccagugaggguccccaauuauaacaugauuaucauggaugaagcccacuucaccgacccuucuagcaucgccgcucguggguacauuaguacucggguaggaaugggcgaggcggcagccaucuuuaugacagcuaccccgcccgguuccguggaagccuucccacagagcaaugcaguuauacaggaugaggaaagagacauuccugagaggucuuggaacucaggguaugaguggaucacggauuuucccggaaaaacugugugguucgucccauccauuaagaguggcaaugacaucgccaacugucuccgcaagaauggcaaacgagugauacagcugagcagaaagacauuugauaccgaauaccagaaaaccaagaacaacgacugggacuacguugugacuacagauauuucggagaugggggcuaauuuccgggcggacagggucaucgauccucgccguugccuuaaacccgugauccuaaaggacggaccagaaagaguaauucuggccgguccgaugccugugaccguugcaucugcugcccagcggaggggccgcaucgggcgaaaccauaauaaggagggagaucaguauauuuacaugggccagcccuugaacaaugacgaggaucacgcacacuggacagaagccaaaauguuacuggacaacauaaauacuccagaggguaucauucccgcucucuuugaaccugagagagaaaaguccgccgcgaucgauggggaguaucggcugaggggcgaggcacgcaaaacguucgucgaacuuaugagaaggggagaccugccaguguggcucagcuacaagguggccucagagggcuuccaauauagugaucggcguuggugcuuugacggggaacgcaacaaucaggucuuggaggaaaacauggauguugagaucuggaccaaagagggagaacgaaagaaacugagacccagguggcuagacgcucggacauacucugacccucuggcccuccgcgaguucaaggaauuugcugcagguagaagguccgugagcggcgaucuuauucuggagauagggaaguuaccgcagcauuugacucagcgggcccaaaaugcucuggacaaccucguaaugcugcacaauucagaacagggaggccgagccuauagacaugcaauggaggagcuuccagauaccaucgaaacacugaugcucuuggcgcugauugccguguuaaccgguggggucacucuauucuuucugaguggccgcggacucggcaaaacgagcaucgggcuucugugugugauggcuuccucuguuuugcuguggauggccagcguggagccccacuggauugcagcuuccaucauacucgaguucuuucugaugguccuucucaucccugagcccgacaggcagcggaccccacaggauaaccaacuggccuacguagugauuggauugcuguucaugaucuuaacaguugcagccaaugagaugggucuacuggaaacuaccaagaaagaccucggcauugggcacguggcugucgagaaccaucaccaugcgacaaugcuugauguggaccugcacccugccucagcauggaccuuguacgcugucgccacuacaaucauaacgcccaugaugcgucauaccauugaaaacacuacagccaauaucucucugaccgcaauugcuaaccaggccgcgauccucaugggacuggauaagggcuggccaauaaguaaaauggacaucggugugccucuuuuagcucuggggugcuauucgcagguuaauccgcucaccuugacagccgcagugcugaugcuaguagcccacuacgcuauuaucggccccggacugcaagcaaaggccacuagagaggcgcagaagaggacggcugccggcauuaugaaaaacccaaccguggaugggaucgucgcaauagaccucgauccuguuguguaugacgccaaguuugaaaaacagcuuggacagauuaugcuguugauccuguguacaagccaaauccuccugaugcgcacuaccugggcuuuaugcgaguccauuacacuugccaccggcccccugacuacgcucugggaggguucuccagggaaguucuggaauacaaccaucgcagucucaauggcuaacauauuucggggaagcuaccuagccggcgcgggucuggccuucuccuugaugaaaagucugggcgggggacgaagaggcacuggggcacagggagaaacccucggcgagaaguggaagaggcagcuuaaucagcugucuaaaagcgaauuuaacauuuauaagcgcucagguaucauggagguggaccgguccgaagcuaaagagggguugaagagaggagagacaacucgucacgccguaaguaggggcaccgcaaaacugcggugguucguggaacgcaaucucguuaagccugaggguaaggugauugauuuaggcugugggcgaggaggcuggagcuacuauugcgcugggcugaaaaaggucacagaagugaaaggauacacgaagggcggucccgggcaugaggaaccgaucccaauggccaccuacggauggaaccuugucaaacugcacucuggcaaggacguguucuuuacuccucccgagaaaugugauacacuacucugcgacauaggcgaguccucaccaaaucccaccaucgaagaggggagaacucugaggguuuugaagaugguagaaccuuggcugcggggaaaccaauucuguauuaagauccucaauccguauaugcccagcguggucgagacacuugagcagaugcagcgcaaacaugguggcaugcuggugagaaacccauuaucgagaaauucuacccacgaaauguacuggguuaguugcgggacgggaaacauuguguccgccgucaauaugaccagccgaaugcuguugaaccgguuuacaauggcgcaccguaagccuacuuaugagagagauguggaccucggcgcugguacccgccauguagcaguggaacccgagguugccaaccuggauaucauugggcagaggaucgaaaauauaaaacacgagcauaagucaacauggcacuacgacgaggauaacccuuauaaaacuugggcuuaccauggauccuaugaagucaagccaucuggcagcgccaguuccauggugaauggcguggucaagcuacuuaccaaacccugggacguuauuccuauggugacacaaaucgcaaugaccgauacuacgccauucgggcagcagcggguauuuaaggagaaaguggacacaagaacccccaaggccaaacgcggaacugcucaaaucauggaagucaccgcgagguggcugugggguuuccucagccgaaacaagaagccgcggauuuguacaagagaggaauuuacgaggaaagugcgcucuaaugccgcaauaggcgcuguuuucguggacgagaaccaguggaacucagccaaggaggcagucgaagaugagcguuuuugggaccuggugcagaaagaacgggaguugcacaagcaggggaaaugcgcaaccugcguauacaacaugaugggaaagagagaaaagaaacugggcgaguucgguaaggcuaaagggaguagggccaucugguacauguggcucggagcgcgcuuucuugaguucgaagcacugggcuuuaugaaugaggaucacugguucucccgagaaaacagcuuaucuggcguugagggggagggacugcauaaguuggguuauauucuccgggacaucucgaaaauuccuggcgggaauauguacgccgaugacacugcuggaugggauacaagaaucaccgaagacgaucugcaaaacgaggccaagauaacugacaucauggaaccagagcacgcacuacuugcuacaucaauuuucaaacugaccuaucagaauaagguggucagggugcagcgccccgccaagaacggcacagugauggaugucaucagcagacgggaccagagggguuccgggcaaguuggaacuuacggccucaauaccuuuacgaacauggaagcucagcugauucgucagauggagagugagggcaucuucuugccuucugaauuagagaccccaaaccuggccgaacgagugcucgauuggcuugagaaauaugggguagaacgccugaagagaauggcaauaagcggagacgacuguguggucaaacccauugaugaccgguuugcgacagcccuaacugcucugaaugauauggguaaggugaggaaagacaucccgcagugggagccuuccaagggcuggaacgauuggcaacagguucccuucugcucacaucacuuucaccagcucaucaugaaggacgggcgcgagauuguggucccauguagaaaucaggaugaauuggugggacgggccaggguaagucaaggcgcagguuggucucugcgagagaccgcuugccuugggaaaagcuacgcccagauguggcagcugauguauuuccaucguagagaccuccgcuuagcagccaacgcgauauguuccgcuguuccuguggauuggguccccacaucacggacuaccuggagcauccacgcccaucaccaauggaugacgacagaagacaugcugucuguguggaauaggguuuggauugaggaaaacccauggauggaggauaagacccauguguccaguuggggagacguccccuacuugggcaaaagagaggaccaguggugcggcagccugaucgggcucacugcacgcgccacaugggcuucgaauauucagguggccaucaaccagguacggaggcuuauaggaaaugaaaacuaccuggauuauaugaccuccaugaagcgauuuaaaaaugagggugacccugaaggcgcacuaugguga

SEQ ID NO: 13902 - RNA, 9879 nt, Artificial Sequence
  derived and/or modified CDS sequence (opt3) from DENV-1__HM631850__SS-prME
agcgugaccaugcugcuaaugcuuaugcccacagcacuggcuuuccacuugacuacgagaggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagaacaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucaccccacaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucucccgaccugagcuuggagaaggcggcugagguguccugggaagaggaagccgagcauucaggggcaagucacaauauauuaguagaagugcaggaugacggaacaaugaaaauuaaggaugaggagagggacgauacccugacuauccuccugaaggccacacuucuggcugucagcggcguuuauccauugucuaucccugcaacccuauucgugugguacuuuuggcagaaaaagaaacaacgauccggcgugcugugggacacgcccucaccaccggaagucgagcgcgccgugcucgaugacgggauuuaucggauaaugcagagaggacugcuugguaggagucagguuggcguagggguguuccaggaaaacgucuuucauacuauguggcacgugacccguggagcgguuuuaauguaccaaggcaagcgccuggagccuagcugggcuuccgugaaaaaggaccucaucucuuacggugggggauggcgguugcagggcucguggaauacaggcgaggaaguccaggugauugccguagagcccgggaagaaccccaagaauguccagaccgcacccggaacauucaagacuagcgaaggugaggugggcgccaucgcucuggauuuuaaaccugggaccucaggauccccaauuguuaacagagaaggcaagaucgugggucucuaugggaauggagucgugacgacaaguggcacuuacguuucugccauagcacaagcuaaagccagccaggagggcccccugccugagaucgaagacgagguguucaggaagcgaaaccuuaccauuauggaucugcacccgggguccggaaagacacggcgcuauuugccagcgaucgucagagaagccauuaaaaggaagcuacggacccugauccucgcacccacucgagugguagcuucagagauggccgaggcuuuaaaagguaugccuauaagauaccagaccacagcagugaagucugagcauacgggcaaagagauuguugaccugaugugccacgccacuuuuaccaugcgccuucugagcccagucagggugcccaauuauaacaugaucaucauggaugaagcccauuucacagacccuaguuccauugcugcgcguggguacaucagcacccgggugggaaugggcgaggcagccgcuauauuuaugacugccacaccgcccgguucugucgaagcauucccacaaucaaaugccguaauucaggaugaggaaagagacaucccugagagguccuggaacaguggguaugaguggauuaccgauuuucccggaaagacggugugguucguuccaagcaucaagucgggcaaugacauagcuaacugucuccgcaaaaauggcaagcgagugauucaguugucuagaaaaacuuucgauacagaauaccagaagaccaaaaacaacgacugggacuacgucgugaccacugauaucuccgagaugggggcgaauuuucgggccgacaggguuaucgauccucgccguugccugaagcccgugauucucaaggacggaccagaaagagucauccuggcagguccgaugccugugacaguagcuagcgccgcacaacggaggggccgcauugggcgaaaccacaauaaagagggagaucaguauauauacaugggccagccccuuaacaaugacgaggaucaugcccacuggaccgaagcuaagaugcuacuggacaacaucaauacaccagaggguauuauccccgccuuguucgaaccugagagagaaaaaucagcggcaaucgauggggaguaucgguuaaggggcgaggcccgcaagacuuuuguggaacugaugagaaggggagaccucccaguuuggcugaguuacaaagucgcuucugagggcuuccaguauuccgaucggcguuggugcuuugacggggaacgcaacaaucaagugcuugaggaaaacauggauguggagauuuggacgaaggagggagaacgaaagaaacugagacccagguggcucgacgcccggaccuacagcgacccuuuggcucugcgcgaguucaaagaauuugcagccgguagaaggucagucaguggcgaucuaauacuggagaucgggaaacucccgcagcaccuuacacagaaggcucagaaugcccuggacaacuuaguuauguugcauaauagcgaacaaggaggccgggcauaucgacacgcgauggaggagcugccagauacuauugaaacccucaugcugcuugcccugaucgcugugcucacaggugggguaaccuuguucuuucuguccggcagaggauuaggcaaaacuucuauugggcuacugugugugauggccagcuccguccuccuuuggauggcaucaguggagccccauuggaucgcugccucuauaauccuggaguucuuuuugaugguucugcucauuccugagcccgaccgccagaggacgccacaggauaaccagcuggcauacguggucaucggacuucucuucaugauucugaccguagccgcuaaugagauggguuugcuggaaacaacuaagaaagacuuaggcaucgggcacguggcgguugagaaccaccaucacgccgcaaugcuagauguggaccugcauccugcuagugccuggacccucuacgccgucgcaacaaccauaauuacucccaugaugcggcacacaaucgaaaacacgaccgcuaauauuucgcuuacugccaucgcgaaccaagcugccauacugaugggauuggauaagggcuggccaaucagcaagauggacauuggugugccucugcucgcacuggggugcuauucccaggucaauccgcuuacauuaaccgccgcugugcugaugcucguugcacauuacgccaucauuggccccggauugcaggcgaaagcuacccgugaggcccaaaagagaacagcagccggcaucaugaaaaacccaacuguggaugggauaguagcuauugaccuggauccuguggucuaugacgccaaguuugaaaaacagcuaggacagaucaugcugcucauccuuuguacgucucagauucuguugaugaggaccacaugggcacugugcgagucaaucacucucgcuaccggcccccugacaaccuuaugggaggguagcccagggaaguucuggaauacuacgauagccguuuccauggcgaacauuuuccgcggaaguuaccuugccggcgcaggucuggcuuuuucucucaugaaaagccuaggcgggggacggcgaggcacaggggcccaaggagaaacccugggcgagaaauggaagagacaguugaaucagcugucaaaauccgaguucaacacuuauaagaggagugguaucauggagguggaccgcagcgaagcaaaagaggggcucaagcggggagagaccacaaagcacgcugucucuagaggcacugccaaacuucguugguuuguggaaaggaaucugguaaagccugaggguaaagugauugauuugggcugugggcggggaggcugguccuacuauugcgccgggcugaagaaaguuaccgaagugaagggauacacaaaaggcggucccgggcacgaggaaccgaucccaauggcgacguacggauggaaccucgucaaguuacauucaggcaaggacguguucuuuauaccucccgagaaaugugauacccugcuuugcgacaucggcgagagcucgccaaaucccacuauugaagaggggcgcacacugcgaguccuaaagaugguggaaccuuggcucagaggaaaccaguucuguaucaaaauucugaauccguauaugcccucuguuguagagaccuuggagcaaaugcagaggaagcacgguggcaugcuggugcggaacccacucagucgcaauuccacucaugaaauguacugggucagcugcgggacaggaaacaucgugucagcuguuaauaugaccuccagaaugcuucugaacagguuuacgauggcacaccgaaaaccuaccuaugagcgggauguggacuuaggcgccgguacacgucacgucgcuguggaacccgagguagccaaccuggauauuaucgggcagagaauagaaaauauuaagcaugagcacaagucuacuuggcauuacgacgaggauaacccuuauaaaaccugggcauaccacggaagcuaugaagugaagccaaguggcuccgccagcucuaugguuaauggcgucgugaaauugcucacaaagcccugggacgugaucccuauggucacucagaucgcuaugaccgauacaaccccauucgggcaacagcgcguuuuuaaagagaagguggacacuaggacgcccaaggcgaaacggggaacagcccagauuauggaaguaaccgcaaaguggcugugggguuuccuaucaagaaacaaaaagccgcgcauauguacuagggaggaauuuacccgaaaagugcggaguaaugcugccaucggcgcagucuucguggacgagaaccaauggaacuccgccaaggaggcuguugaagaugagagauuuugggaccuugugcauagggaacgcgagcugcacaagcaggggaaaugcgccacaugcgucuacaacaugaugggaaagcgugagaaaaagcucggcgaguucgguaaagcgaaggggagccgggcaauuugguacauguggcugggagccagauucuuggaguuugaagcucugggcuucaugaaugaggaucacugguuuucuagggaaaacucgcucucaggcguggagggggagggacuucauaaacuggguuauaucuuacgcgacauuagcaagaucccuggcgggaauauguacgccgaugacacggcaggaugggauacccgaauaacugaagacgaucugcagaacgaggcuaagaucacagacauuauggaaccagagcacgccuugcucgcuaaauccaucuucaagcugaccuaucagaauaaaguaguucgggugcaaagacccgccaagaacggcacugucauggaugugauuaguaggcgcgaccagagagguucuggacaggugggaacauacggccuaaauaccuuuacaaacauggaagcacagcuuauccggcaaauggagagcgagggcauauucuccccuucagaacuggagacuccaaaccucgcggggaggguccuggauugguuggaaaaacauggaguugagcguuuaaagcgaauggccauuaguggugacgacugugugguaaagcccaucgaugaccgcuuugcuaccgcccugacggcacucaaugauaugggcaaagugagaaaggacaucccgcagugggaaccuucuaaaggguggaacgauuggcagcagguccccuucugcagccaccacuuucaucaacuuauuaugaaggacggacgggagauagugguuccauguaggaaucaggaugagcuggugggccgcgcuagagucucccagggugccggguggucacuacgggaaaccgcaugccugggaaaaagcuaugcccagauguggcaacucauguacuuccacaggcgagacuugcgucuggcggcuaacgccaucuguucugcagugccuguagauuggguucccacauccagaacuaccuggaguauucaugcccaccaucaguggaugacaacugaggacaugcuuagcguguggaaucgcgucuggaucgaagagaacccauggauggaagauaagacccacauuucgaauuggggcgacgugcccuaucugggcaagcgggaggaccaguggugcgggucccucaucggauuaacggcuagggccacaugggcaaccaacauacaaguugcuaucaaucaggugagacgccugauugguaacgagaauuacuuggauuacaugacuucuaugaaacgguuuaagaacgaaucagacccugagggcgcccugugguga

SEQ ID NO: 13903 - RNA, 9879 nt, Artificial Sequence
  derived and/or modified CDS sequence (opt3) from DENV-1__KF955446__SS-prME
agcgugaccauguuccugaugcucaugcccacagcccuugcuuuucaccugacuacgaggggaggggaaccucauaugaucgucuccaagcaggaaaggggaaaaucuuuguuauucaagaccucagccgguguuaauaugugcacacugauugccauggaccuaggcgaacucugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuggcaccccaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagccgggauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcugcccuggacuuccggcgccucaacaagccaagagaccuggaaucggcaggaccuucugguaacauuuaaaacugcacacgcuaagaagcaggaaguuguggucuuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugugauguguaccgguagcuucaaacucgagaaggaacuggccgagacgcagcacggaacaguccuugugcagauaaaguacgagggcaccgacgcuccuugcaaaaucccauuuucgacucaagaugaaaaggggguuacacagaacggacgcuugauuaccgcgaaucccaucgugacugacaaagagaagccuguaaacauagaagcagagccacccuucggcgagucuuauauugucaucggugccggggaaaaagcucugaagcucuccugguuuaagaaaggcucaaguaucggaaagauguucgaggccaccgcaagaggcgccaggcggauggcuauucugggggauacagccugggacuuuggaagcaucgguggcguguucacguccguugggaaacuugugcaucagauuuuuggaaccgcauacggcguccuguucucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuuugucaccaaugagguucacacguggacagaacaauauaaguuccaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguuuacugugguagucggcgauguggcagggauucuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcuuaaguugagggauuccuauacgcaggucugcgaccaccgucucaugucagcugcaauuaaagauaguaaggccgugcacgcugacaugggguacuggaucgaaucugagaaaaaugaaaccuggaagcuggcccgggccuccuucauugagguuaagacuuguaucuggccaaaaucccauacacuauggucaaacggagugcuggaaagcgagaugauaauccccaagauuuauggcgguccuaucucucaacacaauuaccgaccaggcuacuuuacccagacugcggggccguggcaucucggaaaacuggagcuugauuucgacuugugcgaaggcacaaccguagucguggaugagcacugcgggaacagaggacccucccugaggacgacuaccgugacaggcaagauuauccacgaaugguguugccgcaguuguaccuuaccuccacuccgguuuagaggugaggacgggugcugguauggaauggagauaaggcccgucaaagaaaaggaggaaaaucugguuaagagcauggugucugccggcuccggugagguagacucauucagucuuggccuguuguguauuagcaucaugaucgaagaggugaugcgcucgcgauggucccggaaaaugcucaugacugggacacuggcugucuuuuuccuacugauuaugggacagcucaccuggaacgaucugauccgucuuugcauuauggugggcgccaaugcaucugacagaauggggaugggaacaacuuacuuggcucugauggccaccuuuaagaugaggccuauguucgcaguuggcuuacucuuucgccggcugacgagcagagaggugcuucugcuaacaauaggucucucacuggucgccaguguggaauugccaaacucccuggaggaauuaggggauggacucgcuaugggcaucaugauucugaaacuucugaccgacuuccaaucucaucaguugugggcgacucuccugagccuaaccuuuaucaagacaacuuucucccugcacuaugccuggaaaaccauggcaaugguucuuucaauugugagccucuuuccccuguguuugaguacgacaucucagaagaccacuuggcugccggucuuacucggcucccuggggugcaagccucuuacaauguuccugaucgcugagaauaaaauauggggaaggcgaagcuggccauugaacgaagguaucauggccguaggcauugugucgauccuccugucaucucuacugaagaacgauguuccccuugccgggccucucauugcuggaggcaugcugaucgcauguuacgugauaagugguuccagcgccgacuugucuuuagagaaagcggcugaggucagcugggaagaggaagccgagcauuccggggcaucacacaauauucugguggaaguacaggaugacggaaccaugaagaucaaagaugaggagcgcgacgauacucucacaauccugcuuaaggccacccuguuggcugugaguggcgucuauccccuaagcauuccagcaacgcuguucguuugguacuuuuggcagaaaaagaagcagcggucuggcgugcucugggacacuccuucacccccagaaguggagagagccguccuggaugacgggauauauaggaucaugcagcguggacuuuuaggucgcagccaggugggcguugggguauuccaagaaaacguguuucauaccauguggcacgucacacggggagcggugcugauguaccagggcaaaagacucgagccgaguugggcuagcguuaagaaagacuugauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucucgauuuuaagccugggacgucgggaagcccaaucgugaaccgagaaggcaaaauaguuggucuguaugggaauggaguggucacaacuucaggcaccuacguguccgccaucgcacaggcucgggccagucaggagggcccccuuccugagauugaagcggagguuuuccgcaagagaaaccugacaaucauggacuugcacccggggucuggaaaaaccaggcgguaucuaccagccauugugcgagaagcaaucaagagaaaacugcgcacucucauauuagcucccaccagggucggugccagcgagauggcugaagcacugaagggcaugccuauucguuaccaaacaacggccgugaaguccgagcauacugggaaagagaucguagaucuuaugggacacgccaccuuuacaaugggccugcucgcuccaggucgggugcccaauuauaacaugguuaucauggacgaagcgcauuucaccgauccuucaagaauugcagccaggggguacaucucuacucgcgucggaaugggcgaggcugccgcaauauuuaugacagccaccccgcccggcagcguggaggcuuucccacagaguaaugcggugauucaggacgaggaacgagauaucccugagagauccuggaacagcggguaugaguggauuacggacuuucccggaaagacugucugguucguaccaucuaucaaaucagguaaugauauagccaacugcuugcggaagaauggcaaaagggugauucagcugucccgcaagacauucgacaccgaauaccaaaagaccaaaaacaacgauugggacuacguugugacuacagacaucagugagaugggggcaaauuuucgugcugauagagucaucgacccucggaggugucucaaccccgugauucugaaggauggaccagaacgcguuauccuugccggcccgaugccugugaccgucgcaagcgccgcucagcgaagaggucggauugggaggaaucacaacaaagagggcgaccaguauauauacaugggacagccccuaaauaacgaugaggaccaugccccauggacagaagcgaagaugcuguuggauaauaucaacacucccgagggcauuaucccugcauuauucgaaccagagcgcgaaaaaucggccgcuaucgacggggagucuagacugaggggagaggcccggaagacguuuguggaacucaugcgucgcggugaucugcccguauggcuuuccuauaagguggcuagcgagggcuuccaauacucagaccgaagauggugcuuugauggggaaaggaccaaucagguucuggaggaaaacauggcagucgagauuuggccuaaagagggagaacggaagaaacuccgcccgagaugcuuggacgccaggacauauagugauccacuggcucuacgggaguucaaggaauuucccccuggccgaagaucuguguccggugaccugauacucgagaucgggaaacuuccccacccacugacucagcgcccucagaaugccuuagcaaccuuggugaugagccacacaucagaacaaggcggaagggcguaccggcaugccauggaggagcugcccgcuaccauugaaacucucaugcugcuugcccugaucgcaguccucacgggcgggguuaccuuguucuuucugaguggacgugguuuaggcaagacaagcauugggcuacugugugugauggcuuccucuguacuccuuuggauggccagcguggagccacacuggaucgcagccuccauaauccuggaguucuuuuugaugguccugcucauuccugagccggacucaaacgcuacuagacaggauaaucagcuggcguaugugguuaucggacuucucuucaugauucugaccguggccgcaaacgagaugggcuugcuggaaacaaccaaaaaggacuuagguaucgggcaugucgcuguagagaaucaccaccaugccgccaugcuagauguggaccugcaccccgcaucugcuuggacucucuacgccguugcgacaacgauaauuaccccaaugaugaggcauacuaucgaaaacacaaccgcuaacauuagucuuaccgccaucgcaaaucaggccgcuauacugaugggcuuggcaaagggauggccuaucucgaaaauggauauuggcgugccccugcucgcccuggggugcuacagccaagucaacccacuuacauuaacugcgccugugcugaugcucgucccccacuauccgaucauuggaccaggcuugcaggcuaaggccacgcgcgaggcacagaaacggaccgccgcugguaucaugaagaauccuacaguggacgggauaguugccauugaucuggaccccgugguauacgaugcaaaauuugaaaagcaacuaggacagaucaugcugcucauccuuuguacuucccagauucuguugaugcgaaccacaugggcucugugcgagucuaucacccucgccacuggcccacugacgacauuaugggaggguucacccggcaaguucuggaacaccacuauagcggugagcauggccaauauuuucagaggguccuaucuugcaggagcuggccuggccuuuagucucaugaaaucucuagggggaggcaggcgcgguaccggggcacagggagaaacacugggcgagaaguggaaacggcaauugaaccagcugacuaagagcgaguucaauaccuacaaaagaucagguaucauggaggucgaccguuccgaagcuaaggagggccucaagagaggggaaacaacgaaacauccuguuagucggggaaccgccaaacuucgcugguuuguggaacgaacucuggucaaaccggagggcaaggugauugauuugggguguggaagaggcgguuggagcuauuacugcgccgggcugaaaaagguaacagaagugaagggauauaccaaaggcggccccgggcacgaggacccaaucccuaugggaacuuacgguuggaaccucguuaaguuaaggucuggcaaagauguguucuuuauacccccugaaaagugugacacacugcuuugcgacaucggggaguccucaccaaaucccaccauugaggaaggacggacgcugcgcguccuaaaaaugguggagccuuggcucagaggcaaccaguucuguaucaagauucugaauccauacauggcgagcgucguggaaaccuuggagcagaugcaaaggaaacacggugggaugcugguucgaaacccccucucgagaaauucuacacaugagauguauuggguaaguuggggaacuggcaacaucguguccgcugucaauaugaccagccguaugcuucugaacagauuuacaauggcacaccgcaagccgacuuacgaaagggauguggacuuaggcgccgggacccggcauguugcuguggagccugaagucgccaaucuggauauuaucggacagagaauagagaacauuaagcacgaacacaaaucaacauggcauuaugacgaggauaacccauacaagaccugggcauaucacgguuccuacgagggcaaacccucugggagcgccaguuccauggugaauggaggcguaaaguugcucacuaaaccuugggacgguaucccaauggugacgcagaucgcuaugacagauaccacucccuucgggcagcaacgcguuuuuaaggaaaaggucgacaccaggacaccgaaagcgaagcgaggaacggcccagauuauggaggugaccgcaaaauggcuguggggcuuccuaagccggaacaagaaaccuagaauaugcacuagggaagaguuuacacgcaaggugcguucuaaugcugccaucggcgcagucuucguugaugaaaaccaguggaacucagccaaggaggcuguggaggacgaacgguuuugggaucuuguacauagagagagggaacugcacaaacaagggaagugugcaaccugcguguauaacaugaugggaaaacgcgagaagaaacucggugaguucggcaaggcgaaggggagucgagcaauuugguacauguggcugggagcccgguucuuggaguuugaggcucugggcuucaugaaugaagaccauugguuuuccagagagaacagccucucuggugucgaaggggagggacuucacaaacugggcuacaucuuaagggacauuucgaagauccccggcgggaauauguaugccgaugacacugcaggaugggauacacgcauaaccgaggacgaucugcagaacgaagcuagaaucacagacauuauggagccagaacacgccuugcucgcuaaaucaaucuucaagcugacuuaccagaauaaagugguucgggugcagaggccugccaagaacgguaccgucauggaugugauuagccgucgagaccaacgcggcuccgggcagguaggaacguauggccuaaauaccuuuacaaacauggaggcacagcuuaucagacagauggaaaguggugggauauucucuccccgggagcuggagacuccaaaucucgcggaaaggguucuggauuggguggagaaauacggagucgaacgcuuggagagaauggccauuagcggcgacgauugcuuaggcgaacccaucuaugaccgguuugcuaccgcccugacagcacucaacgauauggggaaggugaggaaggacaucccucaaugggagccauccaaaggauggaacgacuggcagcaggguccguucuguucacaucacuuucaucagcuuauuaugaaggauggccgagagauagugguccccugccguaaucaagacgaacugguugggagagcucgcgugagucagggagccggcuggucucuacgggagacugcaugucuggguaaaagcuacgcccagauguggcagcucauggauuuccacaggagagacuugcgccuggcggcuaacgccaucugguccgcagggccuggagauuggauuccaacccggaggacgacauggucaauccacgcccaucaccaauggaugaccacugaagacaugcuuagcguauggaaucgaguguggauugaggaaaaccccuggauggaggauaagacacauaucucuuccuggggcgacgucccuuaucugggcaaaagagaggaucaguggugcgggagucucauaggauuaaccgcucgggccacuugggcaaccaauauccagguggcuauuaaccaaguuaggcgccugaucgguaaugaaaacuacuuggacuacauggccagcaugaagcguuuuaagaaugagucggauccagaaggcgcgcugugguga

SEQ ID NO: 13904 - RNA, 9879 nt, Artificial Sequence
  derived and/or modified CDS sequence (opt3) from DENV-1__KF921942__SS-prME
uccgugaccaugcugcucaugcuuaugcccacagcccuggcuuuccacuugacuacgagaggaggggaaccucauaugaucgucuccaagcaagaaagaggaaaaucuuuacuguuuaagaccucagccgguguuaauaugugcacacugauugccauggaccucggcgaacugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgagguggcaaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaacuugcugagacccagcacggaacggucuuggugcagauaaaguacgagggcacagacgcgccuugcaaaaucccauucucgacccaagaugaaaaggggguuacucagaacggacgccugauuacagcaaaucccaucgugaccgacaaagagaagccuguaaacauagaagccgagccacccuuuggcgagucuuauauugucaucggugcuggggaaaaagcccucaagcuguccugguucaagaaaggcucaaguaucggaaagauguuugaggcaacugccagaggcgcuaggcggauggccauucuuggggauaccgcaugggacuucggaagcaucgguggcguguuuacauccgcggggaaacugguucaucagauuuucggaacggcuuacggcguguuguuuucuggugucagcuggaccaugaagauagggaucggcgugcuccugacuugguuaggacuaaauucacgaaguacaucccuaagcaugaccuguauugccguaggccucgugacacuguaccuugggguuaugguccaggcagauucuggaugcgugaucaacuggaaaggccgcgaauugaagugugguucagggaucuucgugacuaaugagguccacaccuggacggaacaauauaaguuucaggccgacaguccgaaaagacugagcgcugccauuggaaaggcaugggaggagggcguuugcgguauaagguccgcuacacggcucgaaaacaucauguggaaacagauuucuaacgagcugaaucauaucuuacuggaaaacgacaugaaguucaccguggugguaggcgaugucgccgggauucuugcgcagggcaagaagaugauccgcccucaacccauggaguacaaauauucguggaaaagcuggggcaaggccaagauaaucggggcugacgugcagaauacuaccuuuauuaucgauggaccaaacacaccugaaugucccgacgaucagagagcauggaauauuugggagguugaggacuacggcuucgguaucuuuacuaccaacauaugguugaagcucagggauuccuauacacaggugugcgaccaccgucugaugucagccgcuauuaaagauaguaaggccguccacgcagacaugggguacuggaucgaaucugagaaaaaugaaacguggaagcuagcgcgggccagcuucauugaggugaagaccuguaucuggccaaaaucccauacucuguggucaaacggaguucucgaaagcgagaugauaauccccaagauuuauggcgguccuaucucucaacacaauuaccgaccaggcuacuucacacagaccgcugggccguggcaucugggaaaacuugaguuggauuuugaccugugcgaaggcacuacagugguagucgaugagcacugcgggaacagaggacccuccuuaaggaccacgacugugaccggcaagauuauccacgaaugguguugccgcaguuguacacucccuccacugcgguucagaggugaggacgggugcugguauggaauggagauaaggcccgugaaagaaaaggaggaaaaucuugucaagagcaugguuucugccggcuccggugagguggacucauuuagucugggcuugcucuguauuagcaucaugaucgaagagguaaugcgcucgcgauggucccggaaaaugcugaugaccgggacucuagcaguguucuuucugcucauuaugggacagcugacauggaacgaucuuauccguuugugcauuauggucggcgcuaaugccucugacagaauggggaugggaaccacauaccuggcauuaauggccacuuucaagaugaggccuauguuugcugugggccuccuguuccgccggcuuaccagcagagagguucugcuacucacgauaggucugucauugguggcgagugucgaacugccaaacuccuuagaggaacucggggauggacuggccaugggcaucaugauucuuaaacuguugacagacuuucaaucucaucagcucugggcaacccugcuaagccugacuuucaucaagaccacauuuucccuucacuaugcuuggaaaacuauggccauggugcucucaauuguuagccuguuccccuugugucugaguaccacgucucagaagacaaccugguuaccggugcuccugggcucccuugggugcaagccucugacuauguuuuugaucgccgagaauaaaauauggggaaggcgaagcuggccacucaacgaagguaucauggcugucggcauuguaucgauccugcuaucaucucugcuuaagaacgaugugccccucgcagggccucugauugccggaggcauguugaucgcguguuacguuauaagugguuccagcgcugacuuaucucuggagaaagccgcagaggugagcugggaagaggaagccgagcauuccggggcuucacacaauauucucgucgaagugcaggaugacggaacaaugaagaucaaagaugaggagcgcgacgauacccugacuauccuucugaaggcaacauugcuagccguaaguggcguguauccccugagcauuccagcgacccucuucgucugguacuucuggcagaagaagaagcagcggucuggcguucugugggacacgccuucacccccagaaguggagagagcugugcuugaugacgggauauauaggaucaugcagcguggauuacugggucgcagccaggucggcguggggguuuuucaagaaaacguauuccauacuauguggcacgugacccggggagccguccucauguaccagggcaaaagauuggagccgaguugggcaagcgugaagaaagaccugauuuccuacggugggggauggaggcuccagggcucuuggaauacaggcgaggaaguucaggugaucgccgucgagccugggaagaaccccaaaaaugugcaaaccgcuccaggaacauuuaagacucccgaaggugagguaggcgccauugcacuggauuucaagccugggaccucgggaagcccaaucgucaaccgagaaggcaaaauagugggucuuuaugggaauggaguugugacgacaucaggcacuuacgucuccgcuaucgcccaggcgaaggccagucaggagggcccccugccugagauugaagacgagguguuucggaaacgcaacuugaccaucauggaucuacacccggggucuggaaagacaagaagguaucugccagcaauuguucgggaagcuaucaaacgaaagcucagaaccuuaauacuggcccccacucgcguggucgcuagcgagauggcagaagcccuuaaggguaugccuauuagguaccaaaccacagccgugaaauccgagcauacgggcaaggagaucguagaccugaugugccacgcuacuuucaccaugcgucucuugucaccagugcggguucccaauuauaacaugaucauuauggaugaagcgcauuuuacagacccuucuagcaucgcagccagaggguacauaaguaccagggucggaaugggcgaggcugccgcaauuuucaugacugccacaccgcccgguuccguggaggcuuuuccacagagcaaugcggugauccaggaugaggaacgcgacauuccugagcgaucuuggaacucaggguaugaguggaucaccgauuuccccggaaaaacggucugguuuguaccauccauaaagaguggcaaugacauugccaacugucugaggaaaaauggcaagcgggugauccagcucagcaggaagacuuucgauacagaauaccagaaaaccaagaacaacgacugggacuacguugugaccacugauaucucggagaugggggcaaauuuccgcgcugaccgugucauugauccuagacggugccugaaacccgugauccuuaaggacggaccagaaaggguuauucuagccgguccgaugccugugacagucgcaucugccgcucagcgccgaggcagaauagggcggaaccacaauaaagagggagaucaguauaucuacaugggccagccccugaacaaugacgaggaucaugcccacuggaccgaagcgaagauguuguuagacaacauuaauacaccagaggguaucauccccgcacuguuugaaccugagagggaaaaguccgccgcuauugauggggaguaucgccucagaggcgaggccaggaaaacuuucguggaacugaugcggcguggagaccuuccaguauggcugagcuacaagguggcuucagagggcuuucaauauagugaucgccgauggugcuucgacggggaaagaaacaaucagguucucgaggaaaacauggaugucgagauauggacgaaagagggagaaaggaagaaauugcggccccgcuggcuggacgcaagaaccuacucugacccucuagcccugagggaguuuaaggaguucgcugccggucggcgauccgugagcggcgaucucauccuugagauugggaaacugccgcagcacuuaacacagagagcacaaaaugcguuggacaaccuggugaugcuccauaauucagaacagggaggccgcgccuauaggcacgcuauggaggagcugccagauacuaucgaaacccuuaugcugcucgccuugauugcaguccugacaggugggguuaccuuauuuuuccuaaguggccggggacugggcaagacuagcaucgggcuccuuugugugauggcuuccucuguacuguuguggauggccagcguggagccccauuggauagcagccuccaucauucuggaauuuuuccucaugguccugcuuaucccugagcccgaccgucagagaacgccacaggauaaccaacucgcuuacgugguuauuggacuguuguuuaugauccugaccguggcggccaaugagauggguuuacuagaaacaacuaagaaagaccugggcauagggcacgucgcaguagagaaccaccaucacgcugccaugcucgauguggaccuucauccugccucagcauggacccuguacgcuguugccacaaccauuaucacucccaugaugaggcacacaauugaaaacacgaccgcgaauaucucuuugacugcuauagccaaccaggcagccauccugaugggacucgauaagggcuggccaauuaguaaaauggacaucggugugccucugcuugcuuuagggugcuauucgcaggucaauccgcugacacucaccgcagccguguugaugcuggucgcgcauuacgcuauuaucggccccggacuacaagccaaggcaacccgcgaggcccagaaacggacagcugccggcauaaugaagaacccaacuguggaugggauuguugcaaucgaccuggauccugugguauaugacgcuaaguucgaaaaacagcucggacagaucaugcuucugauuuuguguacgagccaaauccugcucaugcgaaccacaugggcccugugcgaguccauaacuuuagcgaccggcccccuuacaacccugugggaggguucuccagggaaguuuuggaauacuacgauugccgugucaauggcaaacaucuucagaggaagcuaccucgcuggcgccggucuagcauucucccugaugaaaaguuugggcgggggaaggcgcggcacaggggcucagggagaaacccugggcgagaaguggaaacggcagcucaaucagcuuucuaagagcgaauuuaacacuuauaagagaucagguauuauggaggucgaccguuccgaagccaaagaggggcugaagaggggagagaccacaaaacacgccguuagucggggcacugcgaaguugcgcugguucguggaacgaaaucuggucaaaccugaggguaaggugaucgaucucggcugugggagaggaggcuggagcuacuauugcgcuggguuaaagaaaguaaccgaagugaagggauacacaaaaggcggucccgggcacgaggaaccgauaccaauggcaacguacggauggaaccugguuaaacuucauucuggcaaagacguguuuuucaucccucccgagaagugugauacccugcuaugcgacauuggcgaguccucaccaaaucccacuaucgaagaggggaggacacuccggguccugaaaaugguggaaccuugguugcgcggaaaccaauuuuguauuaagauccugaauccguauaugcccagcgucguggagacccucgagcagaugcagagaaagcacgguggcaugcuuguuaggaacccacugucgcgaaauucuacucaugaaauguacuggguaaguugcgggacaggaaacauuguguccgccgucaauaugaccagccggauguuacugaaccguuucacgauggcucacagaaaaccuaccuaugagcgcgauguggacuugggcgccgguacaaggcacguugcaguggaacccgaggucgccaaccucgauaucauagggcagcggauugaaaauaucaagcaugagcacaaaucaacuuggcauuacgacgaggauaacccuuauaagaccugggcuuaccacggauccuaugaagugaaaccaucuggcagcgcgaguuccaugguaaauggcgugguuaagcugcuaacaaagcccugggacgucaucccuauggugacucaaauugccaugaccgauacaaccccauuugggcagcagagaguguucaaagagaaggucgacacucgcacgcccaaagcaaagaggggaacagcucaaauaauggaaguuaccgccaaauggcuuugggguuuucugagccgaaacaagaagccgcggaucuguacuagagaggaguucaccaggaaagugcgcucuaaugcagccauuggcgcuguauuuguggacgagaaccaguggaacucagccaaggaggcggucgaagaugagcguuucugggaccucgugcaucgggaaagagagcugcacaaacaggggaagugcgcaacaugcguuuacaacaugaugggaaaaagggaaaagaaguugggcgaguuugguaaagccaaggggagucgcgcuaucugguacauguggcugggagcccgauuccucgaguucgaagcacuuggcuuuaugaaugaggaucacugguucucccgggaaaacagccugucuggcguggagggggagggauuacauaaacuggguuauauuuugagagacaucucgaagauaccuggcgggaauauguacgcugaugacacggccggaugggauaccaggaucacugaagacgaucuccagaacgaggcucgcauuacagacaucauggaaccagagcacgcccugcuagcaaaaucaauuuuuaaacuuaccuaucaaaauaaagucgugagaguacagcggcccgcgaagaacggcacuguuauggaugugaucagcaggcgugaccagcgagguuccgggcaggucggaacauacggccugaauaccuucacaaacauggaagcccaacucauacgccagauggagagugagggcauauuuucuccuagcgaacuggagacuccaaacuuggcugaaagaguguuagauuggcuggagaaguaugggguggaacggcucaaaaggauggccaucuccggagacgacugugucguuaagcccaucgaugaccgcuucgcaaccgcucuuacggcccugaaugauauggguaaagugagaaaggacauuccgcagugggagccuucaaaaggcuggaacgauuggcagcaaguacccuuuugcagucaucacuuccaccagcuaauaaugaaggacgggcgggagaucguggucccauguaggaaucaggaugaacuggugggacgagcacguguuucucagggcgccgguuggagccucagagagaccgcgugcuuggggaaguccuacgcucaaauguggcagcugauguauuuucaucgccgggaccuuaggcuggccgcaaacgccauuuguucagcugugccugucgauuggauccccacaagcagaacuaccuggucuauucacgcccaucaccaguggaugacaacugaagacaugcucuccguguggaaucgcguauggaucgaggaaaacccauggauggaggauaaaacccauauaaguagcuggggagacguucccuacuuaggcaagcgggaggaccaauggugcggcucgcugaucggguugacggcaagggcuacaugggccaccaauauucagguggcgaucaaccagguccgaagacugauuggaaaugaaaacuaccucgauuauaugacuuccaugaaacgguucaagaaugagucugacccugaaggugcucuuugguga

SEQ ID NO: 13905 - RNA, 9879 nt, Artificial Sequence
  derived and/or modified CDS sequence (opt3) from DENV-1__JF937602__SS-prME
uccgugacaaugcugcucaugcuuaugcccacagcacuggcuuuccacuugacuacgagaggaggggagccucauaugaucgucuccaagcaggaaaggggaaaaucuuuacuguuuaagacaucagccgguguuaacaugugcacauuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaggaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuucuuacacaagaugaaaagggggugacccagaacggacgcuugauuacugcaaaucccaucguaacagacaaagagaagccugucaacauagaagccgagccacccuucggcgagucuuauauugugaucggugcuggggaaaaagcccugaagcucuccugguuuaagaaaggcucaaguaucggaaagauguucgaggcaaccgccagaggcgcuaggcggauggccauucugggggauacugcaugggacuuuggaagcaucgguggcguuuucaccuccguggggaaacuuguccaucagauuuuuggaacagcguacggcgugcuguucucugguguaagcuggacgaugaagauagggaucggcguguugcucaccuggcugggauuaaauucacgaaguacuucccugagcaugacauguauugcuguuggccuagucacccucuaccugggggugauggugcaggccgauucuggaugcgucaucaacuggaaaggccgcgaacuuaagugugguucagggaucuuuguuacaaaugaggugcacacuuggaccgaacaauauaaguuccaggcagacaguccgaaaagauugagcgccgcuauuggaaaggccugggaggagggcgugugcgguauaagguccgcaacgcggcuggaaaacaucauguggaaacagauuucuaacgagcucaauuacauccuguuagaaaacgacaugaagcugacaguagucgugggcgauguugcugggauucuugcccagggcaagaagaugauccgcccucaacccauggaguauaaauacucguggaaaagcuggggcaaggcgaaaauaaucggggccgacgugcagaauaccacuuuuauuaucgauggaccaaacaccccugaaugucccgacgaucagagagcuuggaauauuugggaggucgaggacuauggcuucgguaucuuuacaacuaacauaugguugaagcucagggauuccuacacccaggugugcgaccaucgucugaugucagcagccauuaaagauaguaaggcuguucacgccgacaugggguauuggaucgaaucugagaaaaaugaaacauggaagcuagcacgggcgagcuucauugaggugaagacguguaucuggccaaaaucccacacccuguggucaaacggaguacucgaaagcgagaugauaauccccaagauuuacggcgguccuaucucucaacauaauuaccgaccaggcuauuucacucagacagccgggccguggcaccugggaaaacuugaguuggauuuugaccugugcgaaggcaccacugucgugguggaugagcauugcgggaacagaggacccuccuuaaggacaaccacggucacuggcaagauuauccacgaaugguguugccgcaguuguacccucccuccacugcgguucaaaggugaggacgggugcugguacggaauggagauaagacccguuaaggaaaaggaggaaaaucuugugaaaagcaugguaucugcuggcuccggugagguggacucauuuagucugggcuugcucuguauuagcaucaugaucgaagaggucaugaggucgcgcuggucccgaaagaugcugaugacagggacccuagccguguucuuucugcucauuaugggacagcugacuuggaacgaucuuauccgguugugcauuaugguuggcgcaaaugcuucugaccguauggggaugggaacaaccuaucuggccuuaauggcaacauucaaaaugagaccuauguuugccgugggccuccuguucaggcgccuuacuagccgggagguccugcuacucaccauaggucugucauugguggcuaguguugaacugccaaacuccuuagaggaacucggggauggacuggcgaugggcaucaugauucuuaagcuguugacggacuuucaaucucaccagcucugggccacacugcuaagccugaccuucgugagaacuaccuuuucccuucauuacgcauggaaaacaauggcuaugguccucucaaucguaagccuguuccccuugugucugaguacuaccucucagaagacgacaugguuaccggugcuccugggcucccuugggugcaagccucugaccauguuuuugauugccgagaauaaaaucuggggaagaaagagcuggccacucaacgaagguauaauggccguuggcaucgugucgauucugcuaucaucucugcuuaaaaacgaugucccccucgcugggccucugaucgcaggaggcauguugauugccuguuaugugaucagugguuccagcgcggacuuaucucuggagaaggcugccguagugagcugggaggaagaggcagaacacuccggggccucacauaauauacucgucgagguucaggaugacggaacuaugaaaauuaaggaugaggaacgagacgauacacugaccauccuucugaaagcuacuuugcuagcagugaguggcguguacccccugagcaucccagccacacucuucgucugguauuucuggcaaaagaagaaacagcgcucuggcgugcugugggacaccccuucacccccagagguugaacgggcgguacuugaugacgggauuuacagaauaaugcagaggggauuacugggucguagccaggugggcgucgggguguuucaagagaacguuuuccacacgauguggcaugugacucgcggagcuguccucauguaccagggcaagcgguuggaaccgaguugggccagcgugaaaaaggaccugaucuccuauggugggggauggagacuccagggcucuuggaauaccggcgaggagguacaggucauugcaguggaaccugggaaaaaccccaagaauguucaaacagccccaggaaccuuuaagacaucggagggugaagugggcgcuaucgcccuggauuucaaacccgggacuagcggaucaccuauugucaacagggagggcaagaucgugggucuuuacgggaauggaguugugaccacguccggcacauaugucagugcaauagcucaggccaaagcgucucaggaaggcccacugcccgagaucgaggacgaaguguuucgaaagcggaacuugacuauuauggaucuacacccugggagcggaaaaacccgcagauaccugccggccaucguaagggaggcaauuaagcggaagcuccgaacauuaauccuggcuccaaccagagugguugccuccgaaauggcugaggcacuuaaagguaugcccauacgcuaucaaacuaccgccgucaagucagaacacacaggcaaagagauuguggaccugaugugccaugccacguucacuaugaggcucuugucuccugugcgugucccaaauuacaacaugaucaucauggaugaggcucacuuuaccgaccccagcaguauugcggcacggggguauaucuccacaagaguaggaaugggcgaagccgcugccauauucaugaccgcaacuccuccggguagcguggaggccuuuccccagucuaaugcuguuauucaggaugaagagagggacaucccagaacgcucauggaacuccggguacgaguggauuacagauuucccuggaaagaccgugugguuuguccccaguaucaaaagcggcaaugacauagcgaacugucugcgaaagaauggcaagagagugauucagcucucgcggaaaacguucgauacugaguaccaaaagaccaaaaacaacgacugggacuauguugugaccaccgauaucucugaaaugggggccaauuucagggcagaccgcgucaucgauccacguagaugccugaagccugugauucuuaaagacggacccgagcggguaauccuagcugguccaaugccggugacuguugccuccgcagcccagaggcgcggccgaauugggagaaaccauaauaaggaaggagaucaguacauauauaugggccagccucugaacaaugacgaggaucacgcucauuggacagaggccaagauguuguuagacaacaucaauacccccgaagguauuaucccagcgcuguuugagcccgaacgggagaaaagcgcagccaucgauggggaauacaggcuccgcggcgaggcuagaaagacauucgucgagcugaugaggcggggagaccuuccuguguggcugucauauaaaguggccagugaaggcuuucaauacucugaucgucgcuggugcuucgacggggagcgaaacaaucagguccucgaagagaacauggauguugaaauuuggacuaaggagggagagaggaaaaaguugaggccacgguggcuggacgcucgcacguauuccgacccccuagcacugagagaauuuaaagaguucgccgcugguaggcggagcgugucaggcgaucucauacuugaaaucgggaagcugccucagcacuuaacccagcgagcccaaaaugcauuggacaaccugguaaugcuccacaauagugagcagggaggcagagcguaccgccaugccauggaggaacugccggauacaauugagacucuuaugcugcucgcuuugaucgccgugcugaccgguggggucacauuauuuuuccuaagcggcaggggacugggcaagaccuccauugggcuccuuugugugauggcaucuagcguucuguuguggauggcuuccguggaaccacacuggaucgccgcaucaauaauccuggaguuuuuccucaugguccugcuuauucccgaaccugaccggcagcguacuccccaggauaaccaacucgccuacguagugaucggacuguuguuuaugauucugacgguugcugcgaaugagauggguuuacuagagaccaccaaaaaggaccugggcaucgggcauguggccgucgaaaaccaccaccaugcagcuaugcucgauguggaccuucacccagccucugccuggacucuguaugcagucgcuaccacaauaauuaccccuaugaugagacauacuaucgagaacacaacggccaauauuaguuugaccgcgaucgcuaaccaggccgcaauacugaugggacucgauaaaggcuggcccaucucgaagauggacauuggugugccacugcuugccuuagggugcuacagccagguuaauccucugacucucacagcugcaguguugaugcugguagcccacuaugcgaucauuggcccgggacuacaagcuaaagccaccagggaagcacagaagcgcaccgccgcuggcaucaugaagaaccccacaguggaugggauagucgccauugaccuggauccaguuguguacgacgcaaaauucgagaagcagcucggacagaucaugcuucugaucuuguguacuucccaaauucugcucaugcggacgaccugggcucugugcgaaucuaucacauuagccacuggcccucuuaccacacugugggaggguucacccgggaaauuuuggaauaccacuauagcggucagcauggccaacauuuuccgaggauccuaucucgcaggcgcuggucuagccuucagucugaugaagucuuugggcgggggaagaaggggcacgggggcacagggagagacacugggcgaaaaauggaagcgccagcucaaucagcuuagcaagucagaguuuaacaccuacaaacgguccgguaucauggaaguggacagaagugaggcuaaggaagggcugaaacguggagagacuaccaagcaugccguaagcaggggcacagccaaauugcggugguucguggagcgcaaucugguuaagccagaagguaaggugauugaucucggcugugggcgaggaggcuggucuuauuacugcgcggggcuaaagaaggucacugaggugaaaggauacaccaagggcgguccugggcacgaggaacccaucccgauggcuacauauggauggaaccuggucaaacuucacuccggcaaggacguguuuuucauaccaccugaaaaaugugauacgcugcuaugcgacaucggcgagucaagccccaauccaaccauugaggaagggagaacucucaggguucugaagaugguagagcccugguugcggggaaaccaauuuuguaucaagauucugaauccuuacaugccgucgguggucgaaacacucgagcagaugcagcgcaaacaugguggcaugcuugugagaaacccccugucuaggaauaguacccacgagauguauuggguuuccugcgggacuggaaacaucgugagcgcagucaauaugacaucacgaauguuacugaaccgguucaccauggcccaucguaagccaacguacgaaagagauguggacuugggcgcugguacccgccacguagccguggagccugaaguugcaaaccucgauauuaucgggcagaggauagagaauauuaaacacgaacauaaguccacauggcacuaugacgaggauaaccccuacaaaacuugggccuaucauggaucuuacgaggucaagccuagcggcagugcuuccagcauggugaauggcguggucaagcugcuaaccaaaccaugggacguuauccccauggugacacaaaucgcgaugacugauaccacaccuuuugggcagcagcggguauucaaggaaaaaguggacaccagaacuccaaaggccaaacgcggaacggcacaaauuauggaggucacagcuaaguggcuuugggguuuucugucuaggaacaagaaaccccgaauauguacccgggaagaguucacuagaaaggugaggucaaaugccgcaaucggcgccguuuuuguggacgaaaaccaguggaauagugcuaaagaggccgucgaggaugaacgcuucugggaccucgugcaccgugagcgggaacugcauaagcaggggaaaugcgcgaccugcguauacaacaugaugggaaagagagagaagaaauugggcgaauuugguaaggcaaaaggguccagggccauuugguauauguggcugggagcucgcuuccucgaguucgaggcccuuggcuuuaugaaugaagaucacugguucagccgagagaacucucugucgggcguugaaggggagggauuacacaagcuggguuacaucuugcgggacauuucaaaaaucccgggcgggaauauguaugcagaugacacagcuggaugggauacgagaauaaccgaggacgaucuccagaacgaagccaagaucacugacauuauggagccugaacaugcucugcuagccaaaagcaucuuuaaacuuacauaccaaaauaagguggucagggugcagcgcccagccaaaaacggcaccgugauggaugucauuuccagacgggaccagagggguagugggcagguuggaacuuauggccugaauacauucaccaacauggaggcgcaacucauccgucagauggaaucugagggcauauuuagccccuccgagcuggaaacaccuaacuuggccgggcgaguguuagauuggcuggagaagcacggaguagaacgccucaaaagaauggcuauuucaggugacgacuguguggucaagccaaucgaugaccgguucgccacugcacuuaccgcucugaaugauaugggcaaagugaggaaggacaucccccagugggagccgaguaagggguggaacgauuggcagcaaguuccuuuuugcucucaucacuuccaccagcuaauuaugaaagacggacgcgaaauagugguccccuguagaaaucaggaugagcuggugggccgggccaggguaagccagggugcaggguggucccuccgagagacggccugcuugggaaagucauacgcgcaaauguggcagcugauguauuuucaucguagagaccuucgccuggcugccaacgcaaucuguagcgccguuccaguggauugggucccuaccucucggacaacuugguccauucacgcucaucaccaguggaugaccacagaagacaugcucaguguguggaauaggguuuggaucgaggaaaaccccuggauggaggauaaaacucauauuagcucguggggcgacgugccauacuuaggcaagagagaagaccaauggugcgggucccugaucggauugaccgcccgcgcaacgugggcuacaaauauacaggucgccaucaaccaggugcggaggcugcucgguaaugagaacuaccuugauuauaugaccucuaugaaacgauucaagaaugagucagaccccgaaggcgcgcugugguga

SEQ ID NO: 13906 - RNA, 9879 nt, Artificial Sequence
  derived and/or modified CDS sequence (opt3) from DENV-1__GU131729__SS-prME
agcgugaccaugcugcucaugcuuaugcccacagcacuggcuuuccacuugacuacgcgaggcggggagccucauaugaucgucuccaagcaggaaaggggaaaaucuuuacuguuuaagaccucagccgguguuaacaugugcacauugauugccauggaccucggcgagcugugugaagauacuaugaccuacaaaugcccacggauaacagagaccgaaccggacgauguggacuguuggugcaaugcgacugauacauggguaaccuaugggacguguagccaaacuggagagcaccgccgagacaagcguagcguggcucuugcaccacaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagccgggauuuuguggagggucuuaguggcgccacauggguagacguuguguuggagcacggguccugugucaccacuauggcgaaggauaaacccacacuggacaucgaacugcucaagaccgaggugacgaacccugcagugcugggaaaacuuugcauugaagccaagaucucuaauaccacaacugauaguagguguccaacccaaggcgaggcuacacuggucgaagaacaagacgccaacuucguuugccggcgcacuuuuguggaucgagguugggggaauggauguggcuuguucggcaaagggucccucauaaccugcgcaaaguuuaagugcguaacaaaacuggagggaaagauugugcaguacgaaaacuuaaaauauucagucaucgugaccguucacacuggugaccagcaucaagugggcaaugagaguacggaacacgggacaaccgcuacuauuacaccccaagccccuaccaccgagauccagcugacugacuacggagcgcucacacuugauuguagcccaagaacgggccuggacuucaacgaaauggucuugcuaaccaugaaggagaaaucuuggcuggugcauaagcagugguuucucgaucugccgcuucccuggacuuccggugccucaacaagccaagagaccuggaauaggcaggaccuguugguaacauucaaaacugcacacgcuaagaagcaggaaguugugguccucgggagucaagagggcgccaugcacaccgcucugacgggagccaccgaaauccagacaucuggcacuaccacaauuuuugcagggcauuuaaaaugccggcugaagauggauaaacuaacucucaagggaauguccuaugugauguguaccgguagcuucaaacuggagaaggaacuugccgagacgcagcacggcacagucuuggugcagauaaaguacgaggggaccgacgcuccuugcaaaaucccauucucgacucaagaugaaaagggaguuacacagaacggccgucugauuaccgcgaaucccaucgugacugacaaagagaagccuguaaacauagaagcagagccacccuuuggugagucuuauauugucaucggggccggcgaaaaagcucucaagcuguccugguucaagaaaggaucaaguaucggcaagauguuugaggccaccgcacgcggggccagaaggauggcuauucuuggagauacagccugggacuucgguagcaucggcgggguguuuacguccguuggaaaacuggugcaucagauuuucggcaccgcauacggugucuuguuuucuggggugagcuggacuaugaagauaggcaucggaguacuccugacaugguuaggccuaaauucacggaguaccucccuaagcaugacauguauugcgguggggcucguuacucuguaccuuggagucauggugcaggcugauucuggcugcgugaucaacuggaaaggucgagaauugaagugugggucaggaaucuucgucaccaaugagguucacacguggacagaacaauauaaguuucaggccgacaguccgaaacgccugagcgcagccauuggcaaggcuugggaggagggugugugcggcauaagauccgccaccaggcucgaaaacaucauguggaaacagauuucuaacgagcugaaucauaucuuacuggaaaacgacaugaaguucacugugguagucggggauguggcagggauucuugcucagggcaaaaagaugauccggccucaacccauggaguacaaauauucguggaaaagcugggggaaggccaaaauaaucggagcggacguucagaauaccacauuuauuaucgauggcccaaacacuccugaaugucccgacgaucagcgcgccuggaauauuugggagguggaggacuacgguuucgggaucuuuaccacaaacauaugguugaagcucagagauuccuauacgcaggucugcgaccacaggcugaugucagcugcaauuaaagauaguaaggccgugcacgcugacaugggauacuggaucgaaucugagaaaaaugaaaccuggaagcuagcccgugccagcuucauugagguuaagacuuguaucuggccaaaaucccauacacuguggucaaacggcgugcucgaaagcgagaugauaauccccaagauuuaugguggcccuaucucucaacacaauuaccggccaggguacuucacccagacugcgggaccguggcaucugggcaaacuugaguuggauuuugaccugugcgaagggacaaccguagucguggaugagcacugcggaaaccgaggccccuccuuaagaacgacuaccgugacagguaagauuauccacgaaugguguugcaggaguuguacccucccuccacugcgcuucagaggggaagacggaugcugguauggcauggagauaagacccgucaaagaaaaggaggaaaaucuuguuaagagcauggugucugccgguuccggcgagguagacucauuuagucugggguugcucuguauuagcaucaugaucgaagaggugaugaggucgcgcuggucccgaaaaaugcugaugacuggaacacuagcugucuucuuucugcucauuaugggccagcugaccuggaacgaucuuauccgguugugcauuauggugggggccaaugcaucugaccguaugggaaugggcacaacuuaccuggcuuuaauggccaccuucaagaugagaccuauguuugcaguuggucuccuguucaggcgccuuacgagccgggaggugcugcuacucacaauagggcugucauuggucgccaguguggaacugccaaacuccuuagaggaacucggagauggccuggcuaugggcaucaugauucuuaaacuguugaccgacuuucaaucucaucagcucugggcgacucugcuaagccugaccuucaucaagacaacuuuuucccuucacuaugccuggaaaaccauggcaaugauucucucaaucguuagccuguuccccuugugucugaguacgacaucucagaagaccacuugguuaccggugcuccuggggucccuuggaugcaagccucugacaauguuuuugauagcugagaauaaaaucugggguagaaggagcuggccacucaacgaaggcauuauggccgucgggaucguaucgauucugcuaucaucucugcuuaagaacgaugugccccucgccggaccucugaucgcuggcgguauguugauagcauguuacguuauuaguggguccagcgccgacuuaucucuggagaaagcggcugaggugagcugggaagaggaagccgagcauuccggagcaucacacaauauccucgucgaagugcaggaugacggccccaugaagaucaaagaugaggagcgagacgauacccugacuauucuucugaaggccacauugcuagcuguaaguggcguguauccacugagcauaccugcaacccucuucgucugguacuucuggcagaagaagaagcagcgcucugggguucugugggacacgcccuccccaccggaaguggagcgggccgugcuugaugacggaaucuauagaauuaugcagagggguuuacugggccguucacaggucggggugggaguuuuucaagaaaacguauuccauacuauguggcacgugacccgcggcgcgguccucauguaccaggguaaacgguuggagccuaguugggcuagcgugaagaaagaccugaucuccuacgggggaggcuggagacuccagggcucuuggaauacaggggaggaaguucaggugauugccgucgagcccggaaagaaccccaagaaugugcaaaccgcacccgguacauuuaagacuccugaaggcgagguaggggccaucgcucuggauuucaagccaggaaccucgggcagccccauagucaacagggaagguaaaaucguggggcuuuauggaaauggcguugugacgacaucaggcacuuacgucuccgccauugcacaggcuaaggccagucaggaggggccucugccggagaucgaagacgagguguuucgaaaacggaacuugaccauuauggaucuacacccaggaucugguaagacacgcagauaucugcccgcgaucguuagggaagccauaaaacggaagcuccgaaccuuaauucuggcaccuacuagaguggucgcuagcgagauggccgaagcucuuaagggcaugccaauccgcuaccaaaccacagcagugaaauccgagcauacggggaaggagaucguagaccugaugugccacgccacuuucaccaugaggcucuugucacccgugcguguuccuaauuauaacaugauuaucauggaugaagcccauuuuacagacccgucuagcauagcugcgcggggauacauuaguaccagagucggcaugggugaggcagccgcuaucuucaugacugccacacccccaggguccguggaagcauuuccucagagcaaugccgugauucaggaugaggaaagggacauccccgagcgcucuuggaacucaggauaugaguggauaaccgauuucccaggcaaaacggucugguuuguaccuuccauuaagaguggcaaugacaucgcuaacugucugagaaagaaugggaagagagugauccagcucagccggaagacuuucgauacagaauaccagaaaaccaagaacaacgacugggacuacguugugaccacugauauuucggagaugggagcgaauuucagggccgcacgcgucaucgacccccguagaugccugaaaccagugauucuuaaggaugguccggaacggguuauacuagcuggcccuaugcccgugacagucgccucugcagcccagaggcgcgggcgaaucggaagaaaccacaauaaagagggcgaccaguauauuuacaugggucagccacugaacaaugaugaggaccaugcucacuggaccgaagccaagauguuguuagauaacaucaauacacccgaggggaucauuccugcgcuguuugaaccagagcgggaaaaguccgcagccauagacggcgaguauaggcuccgcggagaggcuagaaaaacuuucguggaacugaugaggcggggcgaucuucccguauggcugagcuacaagguggccucagagggguuucaauauagugaccgucgcuggugcuucgauggagaacgaaacaaucagguucucgaggaaaacauggacgucgagaucuggacgaaagagggugaaagaaagaaauugaggccucgguggcuggaugcucgcaccuacucugacccgcuagcacugagagaguuuaaggaguucgccgcuggcaggcgguccgugagcggggaccucauucuugagaucggaaaacugccacagcacuuaacacagcgagcccaaaaugcauuggauaaccuggugaugcuccauaauucagaacagggcgguagagcguaucgccacgccauggaggagcugcccgacacuauugaaacccuuaugcugcucgcuuugaucgccguccugacagggggcguuaccuuauuuuuccuaaguggaaggggccuggggaagacuagcauaggacuccuuugugugauggcauccucuguacuguuguggauggcuagcguggagccucauuggaucgccgcauccauuauccuggaauuuuuccucaugguccugcuuauucccgagccagaucggcagcguacgccucaggacaaccaacucgccuacgugguuaucggucuguuguuuaugauacugaccguggcugcgaaugagaugggcuuacuagaaacaacuaagaaagaucuggggauuggacacgucgccguagagaaccaccaucacgcagcuaugcucgacguggaucuucaucccgccucagccuggacccuguacgcaguugcuacaaccaucauuacuccaaugaugagacacacaaucgaaaacacgaccgccaauauaucuuugacugcgaucgcuaaccaggccgcaauucugaugggccucgacaaggguuggccuaucaguaaaauggauauuggggugccgcugcuugccuuaggcugcuauucgcaggucaauccccugacacucaccgcugcaguguugaugcuggucgcccauuacgcgaucauaggaccaggccuacaagcuaaggccaccagggaggcacagaaacgcacagccgcugggauuaugaagaacccuacuguggacggaaucguugccaucgaucuggaccccgugguauaugaugcaaaguucgaaaaacagcucggccagauuaugcuucugaucuuguguacgagccaaauacugcucaugcggaccacaugggcucugugcgaguccauuacuuuagccaccgguccacuuacaacccugugggaggggucuccuggaaaguuuuggaauacuacgaucgcggugucaauggccaacauuuuccgaggcagcuaccucgcaggagcuggccuagccuucucccugaugaaaagucuaggggguggcagaagggggacaggagcacagggcgaaacccugggugagaaguggaaacgccagcucaaucagcuuucuaagagcgaauuuaacacuuauaagcggucagggaucauggaggucgacagauccgaagcuaaagagggacugaagcguggcgagaccacaaaacacgccguuaguagggguacugccaaguugcggugguucguggaacgcacccuggucaaacccgagggcaaggugauagaccucggguguggacgaggcggguggagcuacuauugcgcgggauuaaagaaaguaacagaagugaagggcuacacgaaaggugggccgggacacgaggaaccaaucccuauggcuaccuacggcuggaaucugguuaaacuucauucuggcaaagauguguuuuucauucccccagagaagugugacacucugcuaugcgauaucggggaguccucacccaacccuacaauugaagagggaagaacccucaggguccugaaaaugguggaaccgugguugcgggguaaucaauuuuguaucaagauucugaaccccuauaugccaagcgucguggagacucucgagcagaugcagcgcaagcacggcgggaugcuuguuagaaauccucugucgaggaacucuacacaugaaauguacuggguaaguugcggaaccggcaauaucguguccgcagucaacaugacgagccgaauguuacugaaucgguucaccauggcccaccguaaacccacauaugagagagacguggauuugggugcugggacucgccacguugccguggaaccugaggucgcaaaccucgacauaauuggacagaggaucgaaaacaucaagcaugagcacaaaucaaccuggcauuacgaugaggacaauccauauaagacaugggccuaccacggcuccuaugaaggcaaacccucugggagcgcuaguuccaugggaaacggugugguaaagcugcuaacuaagccuugggaugugauuccaaugguuacccaaauagcgaugacagacaccacucccuuuggccagcagcgggucuucaaagagaagguggauacgagaacaccgaaagccaagcgcgggaccgcacaaaucauggaagugacugcuaaauggcuuuggggauuucugagcaggaauaagaagccucgaauuuguacccgggaggaguucacaagaaaagucaggucuaacgccgcaaucggcgccguuuuuguggacgagaaucaguggaacucagcuaaggaggccguagaagacgagcgcuucugggaucucgugcaucgugaacgggagcugcacaaacaggguaagugcgcgacgugcgucuacaauaugauggggaaaagagaaaagaaguugggagaguuuggcaaagcaaagggcaguagggccauuugguacauguggcugggggcucgcuuccucgaguucgaagcccuuggauuuaugaacgaggaccacugguucucccgagaaaauagccugucugguguggagggcgagggguuacauaaacugggauauaucuugcgggauauaucgaagaucccaggcgguaacauguacgcagacgauaccgcugggugggacacuagaauuacagaagaugaccuccagaaugaggccaggaucaccgauauuauggaacccgagcacgcucugcuagccaaaucaaucuuuaaacuuacuuaucaaaacaaaguugugcgcguccagagaccugcaaagaauggaacagugauggacguaauaagccggagggaucagcguggcuccggccagguugggaccuacggacugaacacauucacuaauauggaagcgcaacucauucgacagauggagagugaggguaucuuuucuccaagcgaacuggagacccccaacuuggccgaacgcguguuagacuggcuggagaaguauggcgucgaaagacucaaacggauggcuaucuccggggaugacuguguggugaagccgauugacgauagguucgccacggcacuuaccgcucugaacgacaugggaaaaguccgcaaggauauaccucagugggagcccucaaaaggcuggaaugacuggcagcaaguuccauuuugcagucaucacuuccaccagcuaaucaugaaggaugguagagagauugugguaccuugucggaaccaggacgaacugguggggagggcccgagucucucagggagcaggcuggagccuccgugagacagccugcuugggcaaguccuacgcgcaaauguggcagcugauguauuuucauagacgcgaucuucggcuggcugccaaugcaaucuguucagccgugcccguugacuggauuccaacuagcaggaccacauggucuauccacgcucaucaccaguggaugacuaccgaagauaugcucuccguguggaacagagucuggauagaggaaaaucccuggauggaggacaaaacgcauaucaguagcuggggagaugugccuuacuuaggaaagcgcgaggaccaauggugcgguucgcugauuggcuugacagcccgggcaaccugggcuacuaacauccagguagccauuaaucagguuaggcgacugaucgggaacgaaaauuaccucgacuauaugacauccaugaaaagauucaagaacgagucugauccagaaggagcgcuuugguga

SEQ ID NO: 13907 - RNA, 9879 nt, Artificial Sequence
  derived and/or modified CDS sequence (opt3) from DENV-1__GU131730__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcgcgccgauucaggaugcgucaucaacuggaaaggcagagaacugaagugugguagugggaucuuuguuacaaaugaggugcacacuuggaccgaacaguauaaguuccaagcagacagcccgaaaaggcuuuccgccgcuauuggaaaggccugggaggagggcgugugcgguauacggucugcaacgcgcuuggaaaacaucauguggaaacagauuucgaacgagcugaaucauauccuccuggaaaacgacaugaaguuaacaguagucgugggcgauguugcugggauucuggcccagggaaaaaagaugaucagaccucagcccauggaguacaaauauagcuggaaguccuggggcaaggcgaaaauaaucggggccgacgugcaaaauaccacuuuuauuaucgauggaccaaacaccccugaaugucccgacgaucagagggcuuggaauauuugggaggucgaggacuacggcuucgguaucuuuacaacuaacauauggcuuaaguugcgugauucauauacccaggugugcgaccaccggcucaugagugcagccauuaaagauucuaaggcuguucacgccgacaugggguacuggaucgaaagcgagaaaaaugaaacauggaagcuggcacgagcguccuucauugaggugaagacguguaucuggccaaaaucacauacccuauggagcaacggaguacuggaaucugagaugauaauccccaagauuuauggcgguccuaucucccagcacaauuacagaccaggcuacuucacucaaacagccgggccguggcaucucggaaaacuggagcuugauuuugacuugugcgaaggcaccacugucgugguggaugagcacugcgggaacaggggacccagucugcgcacaaccacggucacuggcaagauuauccacgaaugguguugccggagcuguaccuuaccuccacucagauucaaaggugaggacgggugcugguauggaauggagauaaggcccguuaaggaaaaggaggaaaaucuggugaaaucuaugguauccgcuggcucaggugagguggacaguuuuagccuuggccuguuguguauuucgaucaugaucgaagaggucaugcgcucccgauggucucggaagaugcucaugacagggacccuggccguguucuuucuacugauuaugggacagcucacuuggaacgaucugauccgucuuugcauuaugguuggcgcaaaugcuagcgacagaauggggaugggaacaaccuacuuggcccugauggcaacauucaaaaugaggccuauguuugccgugggcuuacucuuccgccggcugacuucaagagagguccuucugcuaaccauaggucucagucugguggcuuccguugaauugccaaacucucuggaggaauuaggggauggacucgcgaugggcaucaugauucugaagcuucugacggacuuucagagccaucaauugugggccacacuccugucccuaaccuucaucaggacuaccuuuucacugcacuaugcauggaaaacaauggcuauggugcuuagcauugucagucucuucccccuguguuugucuacuaccucccagaagacgacauggcugccgguauuacucggcagccuggggugcaagccucuuaccauguuucugaucgccgagaauaaaauauggggacgaaagucguggccauugaacgaagguaucauggccgugggcauuguuucaauccuccugucuagucuacugaaaaacgaugugccccuugcugggccucucauugcaggaggcaugcugaucgccuguuacgucauauccgguagcucugcggacuugagcuuagagaaggcugccgugguauccugggaggaagaggcagaacauucaggggccagucacaauauucugguggagguccaggaugacggaacuaugaaaaucaaggaugaagagcgcgacgauacacucaccauccugcuuaaagcuacucuguuggcaguuagcggcguguauccccuaucuauuccagccacacuguucgugugguacuucuggcagaagaagaaacaacgguccggcguccucugggacaccccuucacccccagagguggaaagagcgguucuggaugacgggauauauaggaucaugcagcguggacuuuuaggucgcagucagguaggcgugggggucuuucaggagaacguguuccauacgauguggcacguuacucggggagcugugcugauguaccaaggcaagagacucgaaccgagcugggccuccgucaaaaaggacuugauuucuuacggugggggauggaggcugcagggcucguggaauaccggcgaggaggugcagguaaucgcagucgaaccugggaaaaaccccaagaaugugcagacagccccaggaaccuuuaagacaagcgagggugaaguuggcgcuauugcccucgauuucaaacccgggacuucaggauccccuaucgugaaccgagagggcaagauagucggucuguaugggaauggagugguuaccacgaguggcacauacgugucugcaaucgcucaagccaaagcgagccaggaaggcccacuucccgagauugaggacgaagucuuucggaagcgcaaccugacuaccauggauuugcacccuggguccggaaaaacaagaagguaucuaccggccaucgugcgggaggcaauuaagcgaaagcugagaacccucaucuuagcuccaacucgcguaguggccucagaaauggcugaggcacugaaagguaugcccauaagguaccagaccacagccguuaagucugaacauacgggcaaagagauugucgaccuuaugugccacgccacuuucaccaugcgucugcucagcccugugcgggugccaaauuauaacaugaucaucauggaugaggcucauuuuacagaccccaguuccauugcggcaagaggguacaucagcaccagggucggaaugggcgaagccgcugccauauucaugacugcaacaccuccggguucuguagaggccuuuccccaaucaaaugcugugauucaggaugaagagcgcgacaucccagaacgauccuggaacaguggguaugaguggauuaccgauuucccuggaaagacgguuugguuugugcccagcaucaaaucgggcaaugacauagcgaacuguuugagaaagaauggcaagcgggucauucagcugucuaggaaaacuuucgauacagaguaccagaagaccaaaaacaacgacugggacuacgugguuaccacugauaucuccgaaaugggggccaauuuccgcgcagaccgugugaucgauccaagacggugccucaagccugucauucugaaagacggacccgagagggugauccuugcugguccaaugccgguaacaguggccagcgcagcccaacgccgaggcagaauugggcggaacccuaauaaggaaggagaucaguauauauacaugggccagccccuaaacaaugacgaggaucacgcuccauggaccgaggccaagaugcuguuggacaacaucaauacacccgaagguauuaucccugcguuauuugagccagaaagggagaaaucagcagccaucgauggggaauaucgccugagaggcgaggcuaggaagacuuucguugagcucaugcggcguggagaccugcccgucuggcuuaguuacaaaguggccucugaaggcuuucaguauuccgaucgccgauggugcuucgacggggagagaaacaaucaagugcuggaagagaacauggaugucgaaauuuggacgaaggagggagagaggaaaaagcuccggccucgcugguuggacgcuagaaccuacagcgacccgcuggcacuaagggaauuuaaagaguucgccgcuggucggcgaucaguuaguggcgaucugauacucgaaaucgggaagcuuccacagcaucugacacagagagcccagaaugcauuagacaacuuggugaugcugcacaauagcgagcaaggaggccgcgcguauaggcacgccauggaagagcuccccgauacuauugagacccugaugcuucuggcucucaucgccguauugacagguggggugacccuguuuuucuuauccggccggggacuaggcaagacuucuauugggcugcucugugucauggcaagcuccgugcuucuguggauggcuucaguugaaccucauuggaucgccgcaucuauaaucuuggaguuuuuccugauggugcuccugauucccgaaccagaccgucagagaacgccucaggauaaccagcuugccuacgucguaaucggacuccuguuuaugauuuugaccguggcugcgaaugagaugggucuguuagagacaacuaaaaaggaccuaggcaucgggcacguugccguggaaaaccaucaccacgcagcuaugcuggaugucgaccuccaucccgccagugccuggacccuuuacgcaguggcuacaaccauaauuacuccaaugaugaggcacacaaucgagaacacgaccgccaauauuucgcugacugcgaucgcuaaccaagccgcaauauugaugggacuggauaaaggcuggccuaucagcaagauggacauuggugucccgcuccuggcccuugggugcuauucccaggugaaucccuuaacacugaccgcugcaguucucauguugguggcccauuacgcgaucauuggcccaggacugcaggcuaaagccacccgcgaagcacaaaagcggacagccgcuggcaucaugaagaacccuacuguagaugggauaguggccauugaccuagaucccgucguuuaugacgcaaaauucgagaagcagcugggacagaucaugcuccuuauccuguguacgucucagauuuugcugaugcgaaccacaugggcucucugcgaaucaaucacucuggccaccggcccauuaacaacccuuugggaggguagcccugggaaauuuuggaauacuacgauagcgguguccauggccaacauuuucagaggaaguuaccuggcaggcgcuggucucgccuucucucuaaugaagagccugggcgggggaaggcgcggcacaggggcacaaggagagaccuugggcgaaaaauggaagcggcagcugaaucagcucucaaaguccgaguuuaacacuuauaaaagaagugguaucauggaagucgaccguagcgaggcuaaggaagggcuuaaaaggggagagaccacaaagcacgccgugucucggggcacugccaaacugcgcugguucguagagcgaaauuuggugaagcccgaagguaagguuauugaucugggcugugggagaggaggcugguccuacuauugcgcggggcucaaaaaggugaccgaggucaaaggauacacaaagggcgguccggggcaugaagagccaaucccuauggcuacguacggauggaacuuagugaaacugcacucaggcaaggacgucuuuuucauacccccagaaaaaugugauacccuucugugcgacaucggcgagagcucgcccaauccuacuauugaggaagggaggacacuacgggugcucaagaugguugagccguggcugcgcggaaaccaguuuuguaucaagauuuugaaucccuauaugccaucuguaguggaaacccuggagcaaaugcagagaaaacacgguggcaugcucgucaggaacccucuuagucgaaauuccacucaugagauguacugggugagcugcgggacaggaaacaucguuucagcagugaauaugaccucccggaugcuguuaaaccguuucacgauggcccacagaaagcccaccuaugaacgcgaugucgaccugggcgcugguacaaggcauguggccguagagccugaaguggcaaacuuggauauuaucgggcagcggauagagaauauuaaacacgaacacaagucuacuuggcauuacgacgaggauaacccauauaaaaccugggccuaccacggaagcuaugagguuaagcccaguggcuccgcuagcucuauggucaauggcguggugaagcuccugacaaaaccuugggacgucaucccaaugguuacucagaucgcgaugaccgauacaacccccuuugggcaacagagaguguucaaggaaaaaguagacacucgcacgccgaaggccaaaaggggaacagcacagauuauggaggugaccgcuaaguggcuaugggguuuucuuucacgaaacaagaaaccucggauauguacuagagaagaguucaccaggaagguccgcaguaaugccgcaaucggcgccguguuuguugacgaaaaccaauggaauuccgcuaaagaggccguggaggaugaacguuucugggaccugguccaucgggagagagaacuccacaagcaggggaaaugcgcgacaugcguguacaacaugaugggaaagagggagaagaaacugggcgaauuugguaaggcaaaagggagccgcgccauuugguacaugugguugggagcucgauuccuggaguucgaggcccucggcuuuaugaaugaagaucauugguucucucgggagaacucgcuuucaggcguagaaggggagggacugcacaaguuagguuauauccugagagacauuagcaaaaucccaggcgggaauauguacgcagaugacacggcuggaugggauaccaggauaacugaggacgauuugcagaacgaagccaagaucacagacauuauggagcccgaacacgcucuccuggccaaauccaucuuuaagcuaaccuaucagaauaagguugugcgcguccaaagaccugcaaaaaacggcacugugauggaugugauuagucggagggaccagcgugguucugggcaggucggaacauacggccuuaauaccuucacaaacauggaggcgcagcugauccgacaaauggaaagcgagggcauauuuuccccaucagagcucgaaacucccaaccuggccgggcgcguuuuggauugguuagagaagcauggaguggaaagacugaaacggauggcuauuaguggugacgacuguguagugaagccgaucgaugacagguucgccaccgcacucacggcucuuaaugauaugggcaaaguccgcaaggacaucccucagugggagcccucuaagggguggaacgauuggcagcaggugccauuuugcagccaccauuuccaccaacugauuaugaaagacggaagagaaauaguugugccuugucggaaucaggaugagcuagucggcagggcccgagugucccagggugcaggguggucacugcgugagaccgccugccucggaaagagcuaugcgcagauguggcaauugauguacuuucacagacgcgaccugcggcuugcugccaacgcaaucuguucugccguacccguugauugggugccaacauccaggacuaccuggaguauucaugcucaccaucaguggaugacaacugaagacaugcugagcgucuggaauagaguguggaucgaggaaaaccccuggauggaggauaaaacccacauuucguccuggggcgacguuccuuaucucggcaagcgcgaagaccaguggugcgggucuuuaaucggacugacggcccgggcaacaugggcuaccaauauacaaguggccaucaaccaggucaggcgauugcuggguaaugagaacuaccucgauuacaugacuucaaugaaaagauucaagaaugagagcgacccagaaggcgcgcuuugguga

SEQ ID NO: 13908 - RNA, 9879 nt, Artificial Sequence
  derived and/or modified CDS sequence (opt3) from DENV-1__GU131731__SS-prME
agcgugaccaugcugcucaugcuuaugcccaccgcacuggcuuuccacuugacuacgagaggaggggaaccucauaugaucguaaccaagcaggaaaggggaaaauccuuacuguuuaagacaucugccgguguuaacaugugcacucuaauugccauggaccucggcgagcugugugaagauaccaugaccuacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgucagcuuguucccccuguguuuaaguaccacgucucagaagacaaccuggcucccggugcugcuuggcucccuggggugcaaaccuuugacuauguuucucauuacagagaauaagaucuggggaagaaaaagcuggccacugaacgaagguauaauggcuguuggcguggucucgauccuacugucaucucuucucaagaacgaugugccccuggccgggccuuugauugccggaggcauguuaaucgcuuguuauguaauuagugguuccagcgcagaccugucucucgagaaagccgcggaggugagcugggaagaggaagcugagcacuccggggccucacauaauauccuggucgaaguucaggaugacggaaccaugaagauaaaagaugaggagagggacgauacucuuacaauucuguugaaggcaacccuacuggccgugaguggcguguacccccucagcaucccagcuacgcuguucgucugguauuuuuggcaaaagaaaaagcagcgaucuggcgugcuuugggacacuccuucacccccagaaguugagcgcgcaguauuagaugacgggaucuaccggauuaugcagagaggacugcucgguaggagccaggugggcgucgggguguuccaagaaaacguuuuccacaccauguggcacgugacacguggagccgucuugauguaucagggcaaacgccuggagccgaguugggcgagcgugaagaaagaccucauauccuacggugggggauggcggcugcagggcucuuggaauaccggcgaggaaguacaggucaucgcuguggagccugggaagaaccccaagaauguucaaacagccccaggaacuuuuaaaacccccgaaggugaggugggcgcaauugcccuugauuucaagccugggacgucgggaagcccaaucgucaacagagaaggcaaaauugugggucuguacgggaauggaguugugacaacuucaggcaccuaugucuccgcuaucgcccaggcaaaggcuagucaggagggccccuugccugagauagaagacgagguguuuaggaaacgaaaccuaacaaucauggaucugcauccggggucuggaaagacccggcgcuaccucccagccauuguaagagaagcgaucaagaggaaauuacggacucugauucuugcccccacccgagugguugcaagcgagauggcugaagcccugaaggguaugccuaucagauaucaaacaacggcugucaaauccgagcacacuggcaaggagauaguggaccucaugugccaugcaaccuucacaaugcgcuugcugucaccagugaggguccccaauuacaacaugauuaucauggaugaagcccacuuuaccgacccuucuagcaucgccgcucguggguauauuaguacucggguaggaaugggcgaggcggcagccaucuucaugacagcuaccccgcccgguuccguggaagccuuuccacagagcaaugcaguuauacaggaugaggaaagagacauuccugagaggucuuggaacucaggguacgaguggaucacggauuuccccggaaaaacugugugguuugucccauccauuaagaguggcaaugacaucgccaacugucuccgcaagaauggcaaacgagugauacagcugagcagaaagacauucgauaccgaauaucagaaaaccaagaacaacgacugggacuacguugugacuacagauauuucggagaugggggcuaauuuucgggcggacagggucaucgauccucgccguugccuuaaacccgugauccuaaaggacggaccagaaagaguaauucuggccgguccgaugccugugaccguugcaucugcugcccagcggaggggccgcaucgggcgaacacauaacaaggagggagaucaguacauuuccaugggccagcccuugaauacugcagaggaccacgccccauggacggaagcuaaaauguuacuggauaacauaaauacccccgaggguaucauuccugcccucuucgaaccagagagagaaaagagcgcggcaaucgacggggaguaucggcugaggggcgaggcccgcaaaacauucgucgaacuuaugagaaggggagaucugcccguguggcucucauacaagguggcuagugagggcuuucaauauucugaccggcguuggugcuucgauggggaacgcaacaaucaggucuuggaggaaaacauggacguugagaucuggacuaaagagggagaacgaaagaaacugagaccuagguggcuagaugcccggaccuacuccgacccgcuggcucuccgcgaguuuaaggaguucgcagccgguagaaggagcgugucaggcgaccuuauucuggagauagggaaguuaccacagcacuugacacagcgggcucaaaaugcccuggauaaccucguaaugcugcauaauagugaacagggaggccgagcauauagacacgcgauggaggagcuucccgacaccaucgaaacucugaugcucuuggcccugauugcuguguuaacggguggggucacccuauuuuuccugagcggccgcggacucggcaaaacauccaucgggcuucugugugugauggccucuagcguuuugcuguggauggcauccguggagccucauuggauugcugccucaaucauacucgaauuuuuccugaugguccuucucauccccgagccagauaggcagcggacuccucaggacaaccaacuggcauacguagugauuggauugcuguuuaugaucuuaaccguugccgcuaaugagaugggucuacuggaaacaaccaagaaagaucucggcauugggcacguggcggucgagaaccaccaucacgccacuaugcuugacguggaucugcaucccgcaucugcuuggacauuguaugccgucgccacgaccaucauaacuccaaugaugcgucacacaauugaaaauaccaccgcaaacaucagucugacagcuauugccaaccaggcggcuauccucaugggacuggacaagggcuggccuauaucgaaaauggauaucggugugccgcuuuuagcccuggggugcuacagccagguuaauccccucacuuugacggcagccgugcugaugcuaguagcucauuacgcaauuaucggcccaggacugcaagccaaggcgaccagagaggcucagaagaggacagccgcaggcauuaugaaaaacccuacuguggacgggaucgucgccauagaucucgaccccguuguguaugaugcuaaguucgaaaaacagcuuggacagauuaugcuguugauccuguguaccucccaaauccuccugaugcgcacaaccugggccuuaugcgagucuauuacucuugcaacgggcccacugacaacccucugggaggguucaccugggaaguuuuggaauacuaccaucgcugucagcauggccaacauauuccggggauccuaccuagcgggcgccggucuggcauuuaguuugaugaaaucucugggcgggggacgaagaggcacaggggcucagggagaaacucucggcgagaaguggaagaggcagcuuaaucagcugagcaaaucagaguucaacauuuauaagcgcuccgguaucauggagguggaccggagugaagccaaagagggguugaagagaggagagaccacacgucacgcaguaagcaggggcacggcuaaacugcggugguucguggaacgcaaucucguuaagcccgaggguaaggugauugacuuaggcugugggcgaggaggcuggucuuacuauugcgccgggcugaaaaaggucaccgaagugaaaggauacacuaagggcgguccggggcacgaggauccaaucccuauggccacauauggauggaaccuugucaaacugcauuccggcaaggacguguuuuucacacccccagaaaaaugugauacucuacucugcgacauaggcgagucaagccccaauccuacaaucgaggaagggagaacccugaggguuuugaagaugguagagccguggcugcggggaaaccaauuuuguauuaagauccucaaucccuacaugccaucgguggucgaaacgcuugagcagaugcagcgcaaacacgguggcaugcuggugagaaacccuuuaucuaggaauaguacccaugagauguacuggguuuccugcgggacaggaaacauugugagcgcggucaauaugacuucacgaaugcuguugaaccgguucaccauggcucaccguaagcccacauaugaaagagauguggaccucggcgcagguacucgccacguagccguggagccugaaguugcuaaucuggauaucauugggcagaggaucgagaacauaaaacaugaacacaaguccaccuggcauuacgacgaggauaacccauauaaaacaugggccuaccacggaucuuaugaggucaagcccagcggcagugcauccagcauggugaauggcguggucaagcuacuuaccaaaccuugggacguuauuccaauggugacucaaaucgccaugacggauacaacccccuuugggcagcagcggguauucaaggaaaaaguggacacuagaaccccgaaggcuaaacgcggaacagcgcaaaucauggaggucacggccagguggcugugggguuuucucucucgaaacaagaagccucggauuuguaccagagaagaguucacuaggaaagugcgcucaaaugcagcuauaggcgccguuuuuguggacgaaaaccaguggaauagugcaaaggaggccgucgaggaugaacguuucugggaccuggugcagaaagagcgggaauugcauaagcaggggaaaugcgcuacaugcguauacaacaugaugggaaagagagagaagaaacugggcgaauuugguaaggccaaaggguccagggcgaucugguauauguggcucggagcacgcuuccuugaguuugaggcccugggcuucaugaaugaagaucacugguucagccgagagaacucuuuaucgggcguugaaggggagggacugcacaaguuggguuacauucuccgggacaucucaaaaauuccaggcgggaauauguacgcugaugacaccgccggaugggauacuagaaucacagaggacgaucugcaaaacgaagcaaagauaaccgacaucauggagcccgaacaugcucuacuugccacaagcauuuuuaaacugacuuaucagaauaagguggucagggugcagcgcccugcuaagaacggcaccgugauggaugucaucuccagacgggaccagagggguagugggcaaguuggaacguacggccucaauaccuucacaaacauggaggcccagcugauucgucagauggaaucugagggcaucuuuuugccaagcgaguuagaaacucccaaucuggcagagcgagugcucgauuggcuugaaaaauaugggguagagcgccugaagagaauggcgauauccggagacgacuguguggucaaaccgauugaugaccgguucgccaccgcucuaacagcccugaacgauauggguaaggugaggaaagacaucccucagugggaacccucaaagggcuggaacgauuggcaacagguuccauuuugcagucaccauuuccaccagcucaucaugaaggacgggcgcgagauuguggucccuuguagaaaucaggaugaguuggugggacgggcaaggguaucucaaggcgcugguuggagccugcgagaaacugccugccuugggaaauccuacgcacagauguggcagcugauguauuuucaccguagagaccuccgcuuagccgcgaacgcuauauguucagccguucccguggauugggucccaaccagccggacgacauggucuauccaugcacaccaucaauggaugaccacugaggacaugcuguccguguggaauaggguuuggauugaagagaaccccuggauggaagauaagacacacgugaguagcuggggagacgucccuuacuugggcaaaagagaggaccaguggugcggcucgcugaucgggcucaccgcccgcgcuacuugggccuccaauauucagguggcaaucaaccagguacggaggcuuauaggaaaugagaacuaucuggauuacaugaccucuaugaagcgauucaaaaaugaaggugacccagagggcgcucuaugguga

SEQ ID NO: 13909 - RNA, 9879 nt, Artificial Sequence
  derived and/or modified CDS sequence (opt3) from DENV-1__GU131733__SS-prME
agcgugaccauguuccugaugcucaugcccacagcccuugcuuuucaccugacuacgcggggaggggaaccucauaugaucgucuccaagcaggaaaggggaaaaucuuuguuauucaagaccucagccgguguuaauaugugcacacugauugccauggaccuaggcgaacucugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuggcaccccaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcugcccuggacuuccggcgccucaacaagccaagagaccuggaaucggcaggaccuucugguaacauuuaaaacugcacacgcuaagaagcaggaaguuguggucuuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugugauguguaccgggucguucaaacucgagaaggaacuggccgagacgcagcacgguacaguccuugugcagauaaaguacgagggcaccgacgcuccuugcaaaaucccauuuucgacucaagaugaaaaggggguuacacagaacggacgcuugauuaccgcgaaucccaucgugacugacaaagagaagccuguaaacauagaagcagagccacccuucggcgagucuuauauugucaucggugccggggaaaaagcucugaagcucuccugguuuaagaaaggcucaaguaucggaaagauguucgaggccaccgcaagaggcgccaggcggauggcuauucugggggauacagccugggacuuuggaagcaucgguggcguguucacguccguugggaaacuugugcaucagauuuuuggaaccgcauacggcguccuguucucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuuugucaccaaugagguucacacguggacagaacaauauaaguuccaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguuuacugugguagucggcgauguggcagggauucuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcuuaaguugagggauuccuauacgcaggucugcgaccaccgucucaugucagcugcaauuaaagauaguaaggccgugcacgcugacaugggguacuggaucgaaucugagaaaaaugaaaccuggaagcuggcccgggcauccuucauugagguuaagacuuguaucuggccaaaaucccauacacuauggucaaacggagugcuggaaagcgagaugauaauccccaagauuuauggcgguccuaucucucaacacaauuaccgaccaggcuacuuuacccagacugcggggccguggcaucucggaaaacuggagcuugauuucgacuugugcgaaggcacaaccguagucguggaugagcacugcgggaacagaggacccucccugaggacgacuaccgugacaggcaagauuauccacgaaugguguugccgcaguuguaccuuaccuccacuccgguuuagaggugaggacgggugcugguauggaauggagauaaggcccgucaaagaaaaggaggaaaaucugguuaagagcauggugucugccggcuccggugagguagacucauucagucuuggccuguuguguauuagcaucaugaucgaagaggugaugcgcucgcgauggucccggaaaaugcucaugacugggacacuggcugucuuuuuccuacugauuaugggacagcucaccuggaacgaucugauccgucuuugcauuauggugggcgccaaugcaucugacagaauggggaugggaacaacuuacuuggcucugauggccaccuuuaagaugaggccuauguucgcaguuggcuuacucuuucgccggcugacgagcagagaggugcuucugcuaacaauaggucucucacuggucgccaguguggaauugccaaacucccuggaggaauuaggggauggacucgcuaugggcaucaugauucugaaacuucugaccgacuuccaaucucaucaguugugggcgacucuccugagccuaaccuuuaucaagacaacuuucucccugcacuaugccuggaaaaccauggcaaugguucuuucaauugugagccucuuuccccuguguuugaguacgacaucucagaagaccacuuggcugccggucuuacucggcucccuggggugcaagccucuuacaauguuccugaucgcugagaauaaaauauggggaaggcgaagcuggccauugaacgaagguaucauggccguaggcauugugucgauccuccugucaucucuacugaagaacgauguuccccuugccgggccucucauugcuggaggcaugcugaucgcauguuacgugauaagugguuccagcgccgacuugucuuuagagaaagcggcugaggucagcugggaagaggaagccgagcauuccggggcaucacacaauauucugguggaaguacaggaugacggaaccaugaagaucaaagaugaggagcgcgacgauacucucacaauccugcuuaaggccacccuguuggcugugaguggcgucuauccccuaagcauuccagcaacgcuguucguuugguacuuuuggcagaaaaagaagcagcggucuggcgugcucugggacacuccuucacccccagaaguggagagagccguccuggaugacgggauauauaggaucaugcagcguggacuuuuaggucgcagccaggugggcguugggguauuccaagaaaacguguuucauaccauguggcacgucacacggggagcggugcugauguaccagggcaaaagacucgagccgaguugggcuagcguuaagaaagacuugauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucucgauuuuaagccugggacgucgggaagcccaaucgugaaccgagaaggcaaaauaguuggucuguaugggaauggaguggucacaacuucaggcaccuacguguccgccaucgcacaggcucgggccagucaggagggcccccuuccugagauugaagacgagguuuuccgcaagagaaaccugacaaucauggauuugcacccggggucuggaaaaaccaggcgguaucuaccagcgauugugcgagaagccaucaagagaaaacugcgcacucucauauuagcacccaccagggucguggcuagcgagauggccgaagcucugaaggguaugccuauucguuaccaaacaacggcaguaaaguccgagcauacuggcaaagagaucguggaccuuaugugccacgccaccuuuacaaugcggcugcucucaccaguuagaguccccaauuauaacaugaucauuauggaugaagcccauuucaccgacccuucuagcaucgcugcgaggggguacauaaguacucgcgugggaaugggcgaggcagccgcuauuuuuaugacagccaccccgcccgguuccguggaagcauucccacagagcaaugccgucauccaggaugaggaacgagacauuccugagagaucuuggaacucaggguaugaguggaucacggauuuucccggaaagacuguaugguucgugccauccauaaaaaguggcaaugacauugcuaacuguuugcggaagaauggcaaaaggguuauccagcugagccgcaagacauucgauaccgaauaccaaaagaccaaaaacaacgacugggacuacguggucacuacagauaucucggagaugggggcgaauuuucgugccgacagagugauugauccucggaggugccucaagcccguuauccugaaagacggaccagaacgcgugauucuugcagguccgaugccugucaccguggcuucugccgcacagcgaagaggccggauagggaggaaccacaauaaggagggagaucaguauaucuacaugggccagccccuaaacaaugacgaggaucaugcccacuggacagaagcuaaaaugcuguuggacaacauuaauacuccagaggguaucauccccgccuuauucgaaccugagcgcgaaaaguccgcggcaauugauggggaguauagacugaggggcgaggcccggaagacguuuguagaacucaugcgucgcggagaccugccaguguggcuuagcuacaaaguugcuucagagggcuuccaauauagugaucgaagauggugcuuugacggggaaaggaacaaucagguccuggaggaaaacauggauguggagauauggaccaaggagggagaacggaaaaagcuccgccccagaugguuggacgccaggacauacucugacccucuggcucuacgggaguucaaagaauuugcagccggucgaagauccgugagcggcgaucugauccucgagauugggaaacuuccgcagcaccugacucagcgcgcucaaaaugccuuagacaacuuggucaugcugcauaauucagaacagggaggcagggcauaucggcacgcgauggaggagcucccagauaccaucgaaacacugaugcuucuggcccucauugcuguuuugaccgguggggugacucuguucuuuuuaaguggccguggacuaggcaaaacgagcaucgggcugcucuguguaauggccuccucugugcuucuguggauggcaagcgucgagccccauuggauagcugccuccaucauuuuggaguucuuucugauggugcuccugaucccugagcccgacagacagaggaccccacaggauaaccaacuugcauacguugugauuggacuccuguucaugaucuugacagucgccgcuaaugagaugggucuguuagaaacuaccaagaaggaccuaggcauagggcacguagcgguggagaaccaccaucacgccgcaaugcuggauguugaccuccauccugcuucagccuggacacuuuacgccguggcaaccacuauuaucacacccaugaugcgccacacgauugaaaacaccacugcuaauaucucucugacagccauagcgaaccaggcugccaucuugaugggacuggauaaaggcuggccaauuaguaagauggacaucggugucccucuccuggcacuugggugcuauagccaggugaauccguuaacccugaccgccgcuguccucauguugguggcacauuacgccauuaucggccccggacugcaagcgaaagcuacacgggaggcccagaagcgaacugcagccggcauaaugaaaaacccaacgguugaugggauuguggcuaucgaccuagauccuguaguguaugacgccaaguuugaaaagcagcugggacagaucaugcuccuuauucuguguaccagccaaaucuugcugaugagaacaacuugggcacucugcgaguccauaacccuggcuacaggccccuuaaccacucuuugggaggguucuccagggaaauucuggaauacgacaauugccgucucaauggcgaacaucuucaggggaagcuaccuggccggcgcaggucucgcuuuuucccuaaugaagagucugggcgggggacgccggggcaccggggcccagggagaaacuuugggcgagaaauggaagagacagcugaaucagcucucuaaaagcgaguucaacaccuauaagcguucagguauuauggagguugacagguccgaagcaaaggaggggcuuaaacggggagagacaacuaagcacgcugugagucgcggcaccgccaaacugcgaugguuugucgaaagaaauuuggugaagccugaggguaaaguaaucgaucugggcugugggaggggaggcuggagcuacuauugcgccgggcucaagaaggugacagaaguuaaaggauacacgaagggcggucccgggcacgaggaaccgauaccaauggcgaccuacggauggaacuuagugaaacugcauucuggcaaggacgucuucuuuaucccucccgagaaaugugauacucuucugugcgacauuggcgaguccucaccaaaucccacaaucgaagaggggcggacccuacgcgugcucaagauggucgaaccuuggcugagaggaaaccaauucuguauuaaaaucuugaauccguauaugcccagcgugguugagacucuggagcagaugcagaggaagcacgguggcaugcucguacgaaacccacuuucgagaaauucuacacaugaaauguacugggugaguugcgggaccggaaacauugucuccgcugugaauaugacgagccguaugcuguuaaacagauuuaccauggcacaccgcaagccuacauaugagagggauguugaccugggcgccgguacucggcacguggcugucgaacccgagguggccaacaucgauauaauugggcagagaaucgaaaauaucaaacaugagcacaagucaaccuggcauuacgacgaggauaacccuuauaaaacaugggcauaccacggauccuaugaaguaaagccaucuggcagcgccaguuccauggugaauggcguugucaaauugcucacuaagcccugggacgugauuccuauggugacccaaauagcuaugacagauaccacuccauucgggcagcagcgcgucuuuaaggagaaaguugacacgaggacacccaaggcgaaacgaggaaccgcccaaaucauggaagugacugcaaaguggcugugggguuuccuaagccggaacaaaaagccgagaauuuguaccagggaggaauuuacacgcaagguacguucuaaugcugccaucggcgcaguguucgucgacgagaaccaguggaacucagccaaagaggcuguggaagaugagcgguuuugggaccuuguucauagagaaagggagcugcacaagcaggggaaaugcgccacgugcguguacaacaugaugggaaagcgcgagaaaaagcucggcgaguucgguaaggcgaaagggagucgagcaauuugguacauguggcugggagcccgguucuuggaguuugaagcucugggcuucaugaaugaggaucacugguuuuccagagaaaacagccucucuggcgucgagggggagggacuucauaagcuggguuauaucuuaagggacauaucgaaaaucccuggcgggaauauguacgccgaugacaccgcaggaugggauacucgcauuacagaagacgaucugcagaacgaggcuagaaucaccgacauuauggaaccagagcacgccuugcucgcuaagucaaucuucaaacugacuuaucaaaauaaggugguacggguucagaggcccgccaaaaacggcacagugauggaugucauaagccgucgagaccagcgcgguuccggacaggugggaaccuacggccuaaauacauuuacuaacauggaagcacaacuuauuagacagauggagagugagggcaucuucucuccuagcgaacuggagaccccaaaccucgcggaacgggugcuggauugguuggagaaguauggggucgaaagguuaaagcgcauggccaucuccggagacgacuguguugugaaacccauugaugacagauuugcuacggcccugaccgcacucaaugauauggguaagguacggaaagacauaccgcagugggagccuucaaagggcuggaacgauuggcagcaagugcccuucugcagucaucacuuucaccagcuuaucaugaaagacgggagggagauugucgugccaugucgaaaucaggaugaacugguuggacgugcuagagugucucagggcgccgguuggagccuacgcgagacagcaugccuggggaaguccuacgcccaaauguggcagcucauguauuuccaucggagggacuugagacuggcggcuaacgccaucuguucagcagucccuguggauuggauucccacuagccgcaccacauggucuauccacgcccaucaccaguggaugacuaccgaagacaugcuuuccguauggaaucggguuuggauagaggaaaacccauggauggaggauaagacgcauaucaguagcuggggagacgugcccuaccugggcaaaagggaggaccaauggugcggcucgcucauuggguuaacagcucgagccaccugggcaacuaauauccaggucgcuauuaaccaggugagacggcugaucggaaaugaaaacuacuuggauuauaugacauccaugaagagguuuaaaaaugagucugacccugaaggugcccugugguga

SEQ ID NO: 13910 - RNA, 9879 nt, Artificial Sequence
  derived and/or modified CDS sequence (opt3) from DENV-1__GU131734__SS-prME
uccgugaccaugcugcuaaugcuuaugcccaccgcccuggcuuuccacuugacuacgaggggcggggaaccucauaugaucgucuccaagcaggaaaggggaaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccgauccugccgugcucaggaaacugugcauugaagcuaagaucucuaacacgaccacagacagccgguguccaacucaaggagaggccacccuugucgaagaacaagaugcaaauuuuguuugccgccgaacauucguggacagaggcugggguaacggguguggacuguuuggcaaaggcuccuugaugacuugcgcuaaguucaagugcguaaccaaacucgaggggaagauagugcaguacgaaaaucugaaauauucagucauugugacaguucacaccggagaccagcaucaaguggguaacgagaguacugaacacggcacgacagccaccaucacuccccaggcgccuagcaccgagauucaguuaacagauuacggggcccugacccucgacuguucuccaaggacuggacuugauuuuaaugaaaugguccuguugacaaugaaggagaaauccuggcuagugcauaagcagugguuccuggaccucccgcugcccuggacgucaggcgcaagcaccagucaagagacuuggaaccggaaagaucuucugguaacauuuaagaccgcucacgccaagaaacaggaaguuguggucuuggguucucaggagggggcuaugcacacagcccucacuggcgcaaccgaaauccaaacguccggaaccacaacuaucuucgccggccaucugaagugccguuuaaaaauggacaagcugacccuaaaagggaugagcuaugugauguguacagauucguucaagcucgagaaggaagucgcugagacucagcacggaaccgugcugguucagauuaaauacgaggguacggacgcgccuugcaagauaccauuuucuacacaggaugaaaaaggcgugacccaaaaugggcgccuuaucacugcaaaccccauuguaacagacaaggagaaaccugucaauaucgaagccgagccacccuucggagaguccuauauagugauuggcgcuggugaaaaggccuugaagcugucaugguuuaaaaaggggaguagcaucggcaaaauguucgaggcaaccgccagaggagcuaggcggauggccauccucggcgauacugcaugggacuuuggguccauuggagguguuuucaccucugugggcaagcugguccaucagaucuuugggacagcguacggagugcuuuucagcggcguaucauggacgaugaaaauugguauaggggugcuguugaccuggcucggccugaacagucgauccacuagcuuaucuaugacauguaucgcuguuggacuggucacccuauaccucggcgugauggugcaggccgacucagggugcgucauuaauuggaagggacgcgaacugaaguguggcagugguaucuuuguuacaaacgaggugcacacuuggaccgaacaguauaaauuccaagcagauagcccgaagagacuuuccgccgcuaucgggaaagccugggaggagggagugugcggcauuaggucugcaacgcgguuggaaaauauaauguggaagcagaucucgaacgagcugaaccauauucuccuggaaaaugacaugaaauuuacaguagucgugggugauguugcuggcaucuuagcccaggggaagaaaaugauucgcccucagcccauggaguacaaguauagcuggaaguccuggggaaaagcgaagaucauaggcgccgacgugcaaaacaccacuuucaucauugaugggccaaauaccccugaaugucccgacgaucagagagcuuggaacaucugggaggucgaggacuacggauuuggcauuuucacaacuaauaucuggcugaaacuuagggauucauauacccaggugugcgaccaccguuugaugagugcagccauaaaggauucuaaagcuguucacgccgacauggguuacuggauugaaagcgagaagaacgaaacauggaagcucgcacgggcguccuucaucgaggugaaaacguguauuuggccaaagucacauacccuguggagcaaugggguacuagaaucugagaugaucauacccaaaaucuauggaggcccuauuucccagcacaacuaccgaccagguuacuuuacucaaacagccggcccguggcaucuggggaagcucgagcuggauuucgaccuuugcgaaggaaccacugucgugguggacgagcacugcggcaauagagggcccaguuugaggacaaccacggucacuggaaaaaucauucacgaaugguguugccgcagcuguacccugccuccauuacgguuuaagggcgaggaugguugcugguaugggauggagaucagacccguuaaggaaaaagaggaaaaccucgugaagucuaugguauccgcuggaucaggcgagguggacaguuucagccugggucuucuguguauaucgauuaugaucgaagaggucaugaggucccgcuggucucgaaaaauguugaugacaggcacccucgccguguuuuuccugcuaaucauggggcagcugacuuggaaugaucucauucggcugugcaucaugguuggagcaaacgcuagcgaccguaugggcauggggacaaccuaccuugccuugauggcaacauuuaagaugagaccuauguucgccgugggacuguuauuuaggcgccucacuucacgggagguccugcuucugaccauuggccuaagucucguggcuuccguugaacugccaaauucuuuggaggaacugggugauggguuagcgaugggaauaaugauccucaaacugcuuauugacuuccagagccaucaacugugggccacguugcucucccugacauuuaucaagaccacuuucucacuacacuaugcauggaagaccauggcuauggugcugagcauugucagucuuuuuccccucugucugucuacaacuucccagaaaaccacgugguugccgguacuguuaggcagccucggcugcaagccucugacaauguuccuuaucgccgagaacaaaauaugggggagaaagucguggccacugaaugaaggaaucauggccguggguauuguuucaaucuugcucucugcucugcucaagaaugaugugccccuggcaggcccucuuauugccgggggaaugcucaucgcguguuacgucauaaguggcuccagcgcugaccugucuuuggagaaggccgcagaggugagcugggaagaggaagccgagcauuccggugcuucacacaacauuuuaguagaagugcaggaugacgggaccaugaaaaucaaggaugaggagagggacgauacucugacaauccuccugaaggcaacccuucuggccgucaguggaguuuaucccuugagcauuccagcgacucuauucgugugguacuuuuggcagaaaaagaaacaacgaucuggcgugcugugggacacaccuucacccccagaagucgagcgcgcugugcucgacgauggcauauaucggaucaugcagagagggcugcuuggaaggagccagguugguguaggcguguuccaggaaaaugucuuucauaccauguggcacgugacgcguggggccguuuuaauguaccaaggaaagcgccuggagccgaguugggcaagcgugaaaaaggaccucauuuccuacggcgguggguggcgguugcagggaucuuggaacacuggcgaggaaguccaggugaucgccguagagccuggcaagaaucccaaaaacguccagaccgcuccagggacauucaagaccucggaaggagaggugggugccauugcacuggauuuuaaacccggcacaagcgggucaccuaucguuaauagagaaggaaagauagugggccucuaugguaacggggucgugacuaccuccggaacguacguuagugcuaucgcccaagcgaaagccucucaggagggcccacugcccgagauugaagacgagguguucaggaagcgaaaucuuacaaucauggaucugcacccuggcagcgggaagacucggcgcuauuugccggcaauugucagagaagcuaucaaaaggaagcuacggacccugauacucgccccaacacgagugguagcuuccgagauggcagaagccuuaaaaggaaugcccauuagauaccagaccacugccgugaagucagagcauaccgguaaagagaucguugaccugaugugccacgcuacauuuacgaugcgccuucugucuccugucagggugccaaacuauaauaugaucauuauggaugaagcgcauuucacugaccccagcaguaucgcagcccguggcuacauauccacccggguggggaugggagaggcugccgcaauuuuuaugacagccaccccuccgggcagcgucgaggcuuucccccaaucuaacgcgguaauccaggaugaggaaagagacauuccagagaggucauggaacuccgguuaugaguggaucacugauuuuccugggaagacagugugguucguucccaguauaaagagcggaaacgacauugccaauugucuccgcaaaaacggcaagcgagugauccaguugucgagaaaaaccuucgacacggaauaccagaagacuaaaaauaacgauugggacuacgucgugacaaccgauaucucugagaugggcgcaaacuuucgggcugacaggguuauugauccacgccguugccugaagccugugauccucaaggacgggcccgaaagagucauucuggccggaccaaugccggugaccguagcauccgccgcucaacggaggggucgcauaggccgaaaucacaacaaagagggggaucaguauaucuacaugggacagccucuuaauaacgacgaggaucaugcccacuggacugaagcgaagaugcuacuggacaauauuaacacacccgagggcaucaucccagcauuguucgaacccgagagagagaaaagcgccgcuauugauggugaguaucgguuaagaggggaagcccgcaagaccuuuguggaacugaugagaaggggcgaccucccuguuuggcugucauacaaagucgcuagugagggauuccaguauucugaucggcguuggugcuuugacggcgaacgcaauaaccaagugcuugaggaaaauauggacguggagauauggacaaaggagggggaaaggaaaaagcugagaccaagauggcucgaugcacggacuuacuccgaccccuuggcccugcgcgaguucaaggaauuugcugccggaagaaggagcgucucaggugaucuaauccuggagauuggcaaacucccucagcaccuuacgcagcgggcacagaacgcgcuggacaauuuaguuauguugcauaacagugaacaagggggacgagccuauagacacgcuauggaggagcugccggauaccaucgaaacacucaugcugcuugcccugauugcagugcucacuggcgguguaaccuuguucuuucugagcgggcgcggcuuaggaaagacauccaucggccuacugugugugauggcuucuagcguccuccuuuggauggccuccguggagccacauuggauagcagccucaaucauucuggaguucuuuuugaugguucugcucauccccgagccugacaggcagcggacaccccaggauaaucagcuggcuuacguggucauugggcuucucuucaugauccugacuguagcggccaacgagaugggauugcuggaaacgaccaaaaaggacuuagguauaggccacguggcaguugagaaucaccaucacgcugccaugcuagauguggaccugcauccagccucugcauggacacucuacgcugucgccacuaccauuaucacaccuaugaugcgucacaccauugaaaacacuacagcgaacaucagucuuacggcuauagccaaucaagcagccauccugaugggguuggauaaaggauggcccauuucgaagauggacaucggcgugccacugcucgcucuggguugcuauagccaggucaacccucuuaccuuaacugcagccgugcugaugcucguugcgcauuacgcuauuaucgggccgggcuugcaggccaaggcaacaagagaggcccagaaaaggaccgcugccggaauaaugaagaaucccaccguggauggcauuguagcaaucgaccuggacccaguggucuaugaugcuaaauuugaaaagcagcuagggcagaucaugcugcucauucuuuguacaucccagauccuguugaugcgcacuacgugggcccugugcgagucuauaacccucgcgacaggaccucugacuaccuuaugggagggcucacccgguaaauucuggaacacaaccauugccguuagcauggcaaauaucuuccggggguccuaccuugcuggagccggccuggcauuuagucucaugaagucucuagguggcgggcgaagaggaacuggcgcucaaggggaaacgcugggagagaaguggaaaaggcaguugaaccagcugagcaagucagaguucaauacauauaaacgcuccggcauuauggagguggaccggagugaagccaaggagggucucaaaagaggggagaccacuaagcacgccgucagccguggaaccgcgaaacuuaggugguuuguggaacggaaccugguaaaaccagagggcaaggugaucgauuuggguuguggccgcgggggauggucuuacuauugcgcuggccugaaaaagguuacagaagugaaaggguacacuaagggaggcccuggucacgaggaacccauaccgauggcaaccuacggguggaaucucgucaaauuacauuccggaaaggacguguucuuuaucccaccugagaagugugauacacugcuuugcgacauuggcgagucaagccccaacccaacgaucgaagagggccgaacccugagaguccuaaaaaugguggaacccuggcucagggggaaucaguucuguauuaagauccugaacccuuauaugccgucgguuguagagacuuuggagcaaaugcagcggaaacacggagguaugcuggugcgcaauccccucucuagaaacaguacacaugaaauguacugggucuccugcggcaccgggaauauugugagcgccguuaacaugacuucaaggaugcuucugaaucgauuuacaauggcucaccggaagccaaccuaugagcgugauguggacuuaggagccggcacgagacacgucgcaguggaaccugagguagccaaccuggauaucauaggucagcgcauugaaaacaucaaacaugagcacaaguccaccuggcauuacgacgaggauaaucccuauaagacaugggcuuaccacgggucuuaugaagugaaaccuagcggaagugcguccagcaugguuaacggcgucgugaaguugcucacuaaaccaugggacgugauccccauggucacccagauugccaugacagacacuaccccuuucggccaacagaggguuuuuaaggagaaaguggauacacggaccccaaaggcaaagagagggacugcucagauaauggaaguaacggccaaauggcuguggggauuccuaucucgcaauaagaaacccaggaucuguacacgagaggaauuuacccggaaggugagaucaaacgcagccauuggugcugucuucguggacgagaaucaauggaacagugccaaagaggcgguugaagaugagagguuuugggaccuugugcaucgcgaacgugagcugcacaagcagggcaagugcgcaacuugcgucuacaauaugauggggaaacgggaaaagaaacucggagaguucggcaaggccaaagguuccagagcuaucugguacauguggcugggggccagguucuuggaguuugaagcacugggauucaugaacgaggaucacugguuuagccgcgaaaauucucucucgggcguggagggcgaggggcuucauaagcugggauauauuuuacgagacaucucaaaaauaccggguggcaacauguacgcugaugacaccgccgggugggauacacggaucacggaagacgaucugcagaaugaggcuaagauuaccgacaucauggaaccugagcacgccuugcucgcaaagagcauuuucaaacugacuuaucagaacaagguaguuagagugcaaaggccagcgaaaaauggaacagucauggaugugaucucccgcagagaccagcggggcaguggucagguggggaccuacggacuaaacacuuuuacaaauauggaagcccagcuuauaaggcaaauggagucugagggcauuuucagccccuccgaacuggagaccccuaaccucgcuggccguguccuggacugguuggaaaagcaugggguugagcgauuaaaacgcauggccaucucaggagaugacugugugguaaagccaaucgaugacagauuugcagcugcccugacagcacucaacgauauggguaaggugcggaaagacauuccccagugggaaccgaguaagggcuggaaugauuggcagcaggucccuuucugcucucaccacuuucaucaacuuauaaugaaagacgggagggagaucgugguucccugucgcaaccaggaugagcuggugggacgagcacgggucagccagggcgcggguuggucccuaagggaaacugcuugccuggggaagucauaugcccagauguggcaacucauguacuuccaccgacgugacuugagacuggcagccaaugcuauuuguagcgccgugccaguagauuggguuccuaccucucgcacgaccugguccauccaugcacaccaucaguggaugacaacugaggacaugcuuaguguguggaaccgggucuggauugaagagaaucccuggauggaagacaaaacccacaucagcucguggggagaugugccauaucugggcaagagggaggaccaguggugcggcucccucauaggguuaacagcuagagccacuugggcgaccaacauccaaguugcuauuaaucaggugcgccggcugaucggaaacgagaauuacuuggauuacaugacgucuaugaagagguuuaaaaacgaaucagaccccgagggugcccugugguga

SEQ ID NO: 13911 - RNA, 9879 nt, Artificial Sequence
  derived and/or modified CDS sequence (opt3) from DENV-1__GU131738__SS-prME
agcgugaccaugcugcucaugcuuaugcccaccgcccuggcuuuccacuugacuacgaggggcggggagccucauaugaucguaaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagggauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuauucagaacggacgcuugaucacugcaaaucccauagugacagacaaagagaagccuguaaacauugaagccgagccacccuuuggcgagucuuauaucgucaucggugcuggggaaaaagcccugaagcucuccugguucaagaaaggcucaaguauuggaaagauguuugaggcaaccgccagaggcgcuaggcggauggccauccugggggauacugcaugggacuucggaagcguggguggcguuuuuaccuccguggggaaacuuguccaucagauuuucggaacagcguacggcgugcuguuuucugguguaagcuggacgaugaagauagggaucggcguguugcucaccuggcugggauuaaauucacgaaguacuucccugagcaugacauguauugcuguuggccuagucacccucuaccugggggugauggugcaggccgauucuggaugcgucaucaacuggaaaggccgcgaacuuaagugugguucagggaucuucguuacaaaugaggugcacacuuggaccgaacaauauaaguuucaggcagacaguccgaaaagauugagcgccgcuauuggaaaggccugggaggagggcgugugcgguauaagguccgcaacgcggcuggaaaacaucauguggaaacagauuucuaacgagcucaaucauauccuguuagaaaacgacaugaaguucacaguagucgugggcgauguuguggggauucuggcucagggcaaaaagaugauccgcccucaacccauggagcacaaauacucguggaaaagcuggggcaaggccaagauaaucggggcggacguccagaauaccacuuuuauuaucgauggaccaaacaccccugaaugucccgacgaucagagagccuggaauauuugggagguggaggacuauggcuucgguaucuuuacaacuaacauauggcuuaaguugagggauuccuacacccagguuugcgaccaccgucucaugucagcugcaauuaaagauaguaaggccgugcaugcugacaugggguauuggaucgaaucugagaaaaaugaaacauggaagcuggcccgggcauccuucauugagguaaagacguguaucuggccaaaaucccacacccuauggucaaacggaguccuggaaagcgagaugauaauccccaagauuuacggcgguccuaucucucaacauaauuaucgaccaggcuacuucacucagacagcggggccguggcaccucggaaaacuggagcuugauuuugacuugugcgaaggcaccacugugguggucgaugagcacugcgggaacagaggacccucccugaggacaaccacgguuacuggcaagauuauccaugaaugguguugccgcaguuguaccuuaccuccacuccgguucaaaggugaggacgggugcugguacggaauggagauaagacccgugaaggaaaaggaggaaaaucugguaaaaagcauggugucugccggcuccggugaggucgacucauuuagucuuggccuguuguguauuagcaucaugaucgaagaggugaugaggucgcgcuggucccgaaagaugcucaugacagggacccuggcuguuuuccuacugcucauuaugggacagcugacuuggaacgaucuuauccgguugugcauuauggugggcgccaaugcaucugaccguauggggaugggaacaaccuaucuggcuuuaauggccacauuuaaaaugagaccuauguucgcagucggccuccuguuuaggcgccuuacuagccgggaggugcugcuacucaccauaggucugucauugguugccaguguggaacugccaaacuccuuagaggaacucggggauggacuggcuaugggcaucaugauucuuaagcuguugacggacuuccaaucucaccagcucugggcgacacugcuaagccugaccuuuaucaaaacuacccuuucccuccauuacgccuggaagacaauggcaaugguccugucaauugucagcuuguucccccuguguuuaaguacuaccucucagaagacgacauggcucccggugcugcuuggcucccuggggugcaaaccuuugaccauguuucucaucacugagaauaagauauggggaagaaaaagcuggccacugaacgaagguaucauggcuguuggcguggucucgauucuacugucaucucuucucaagaacgaugugccccuggccgggccuuugaucgccggaggcauguuaauugcuuguuauguaaucagugguuccagcgcagaccugucucucgagaaagccgcggaggugagcugggaagaggaagcugagcacuccggggccucacauaauauacuggucgaaguucaggaugacggaacaaugaagauuaaagaugaggagagggacgauacccuuacuauccuguugaaggcaacacuacuggccgugaguggcguguacccccucagcaucccagcuacccuguucgucugguauuuuuggcaaaagaaaaagcagcgaucuggcgugcuuugggacacgccuucacccccagaaguugagcgcgcaguauuagaugacgggauuuaccggauaaugcagagaggacugcucgguaggagccaggugggcgucgggguguuccaagaaaacguuuuccacacuauguggcacgugacccguggagccgucuugauguaucagggcaaacgccuggagccgaguugggcgagcgugaagaaagaccucaucuccuacggugggggauggcggcugcagggcucuuggaauacaggcgaggaaguacaggucauugcuguggagccugggaagaaccccaagaauguucaaaccgccccaggaacauuuaaaacucccgaaggugaggugggcgcaaucgcccuugauuucaagccugggaccucgggaagcccaauugucaacagagaaggcaaaaucgugggucuguacgggaauggaguugugacgacaucaggcacuuaugucuccgcuauagcccaggcaaaggcuagucaggagggccccuugccugagaucgaagacgagguguuuaggaaacgaaaccuaaccauuauggaucugcauccggggucuggaaagacacggcgcuaccucccagccaucguaagagaagcgauuaagaggaaauuacggacccugauccuugcccccacucgagugguugcaagcgagauggcugaagcccugaaggguaugccuauaagauaucaaaccacagcugucaaauccgagcacacgggcaaggagauuguggaccucaugugccaugcaacuuucaccaugcgcuugcugucaccagugaggguccccaauuacaacaugaucaucauggaugaagcccacuuuacagacccuucuagcauugccgcucguggguauaucaguacccggguaggaaugggcgaggcggcagccauauucaugacugcuacaccgcccgguuccguggaagccuuuccacagagcaaugcaguuauucaggaugaggaaagagacaucccugggaggucuuggaacucaggauacgaguggauuaccgauuuccccggcaaaacggugugguuuggcccaacuaucaaguccgggaaugacauagccaacugucuccgcaagaauggaaaacgagucauucagcugaguagaaagacauucgauaccgaguaucagaaaaccaagaacaacgacugggacuacguggguacuacagauaucagcgaaaugggcgcuaauuuucgggcggacaggguuaucgauccucgccguugccuuaaacccgugauucuaaaggacgggccagagagagucauccuggccggaccgaugccugugaccguagcaucggcugcccagcggaggggccgcauuggucgaaaccauaauaaggaaggggaucaguacauauauaugggccagcccuugaacaaugacgaggaucacgcacacuggacagaggccaaaauguuacuggacaacaucaauacuccagaaggaauuauccccgcucucuucgagccugaaagagagaagucugccgcgaucgauggcgaauaccggcugagaggggaagcacgcaaaacguucguggagcuuaugagaaggggagaccugccaguuuggcucuccuauaaggucgccagcgaagguuuucaauacucagaucggcguuggugcuucgacggcgagcgcaacaaucagguguuggaagagaacauggauguggaaauuuggaccaaagagggggagcgaaagaaacugagacccagguggcuagacgcucggacauauagugacccucuggcccuccgcgaauuuaaggaguucgcugcaggaagaaggucugucuccggcgaucuuauacuggaaaucgguaaguuaccgcagcauuugacucagcgggcccaaaaugcucuggacaaccucguuaugcugcacaauagcgagcagggaggacgagccuacagacaugcaauggaggagcuuccagauaccauugagacacugaugcucuuggcgcugaucgccguguuaaccggaggcguaacucuauuuuuccugucagggcgcggacucgguaaaacgaguauuggccuucugugugugauggcuagcuccgucuugcuguggauggccucuguggaaccccacuggaucgcagcuagcauaauccucgaguuuuuccugaugguucuucucauuccugaacccgacaggcagcggaccccacaggauaaccaacuggccuauguggucaucggguugcuguuuaugauuuuaacaguagcagccaaugagaugggacuacuggagacuaccaagaaagaccucggcaucggucacguggcuguugaaaaccaucaccaugcgacaaugcuugauguggaccugcacccugccuccgcauggaccuuguacgcugucgccacuacaauaauuacgcccaugaugcgucauaccaucgagaacacuacagccaauauuucacugaccgcaaucgcuaaccaggccgcgauacucauggggcuggauaagggcuggccaaucucuaaaauggacauuggagugccucuuuuagcucugggcugcuacagucaggucaauccgcucaccuugacagccgcagugcugaugcuaguugcccacuaugcuaucauugggcccggacugcaagcaaaggccacuagagaagcgcagaagaggacggcugccggcaucaugaaaaacccaaccguggaugguauaguagcaauugaccucgauccuguggucuacgacgccaaguucgagaaacagcuugggcagaucaugcuguugauccuguguacaucgcaaauucuccugaugcgcacuaccugggcuuuaugcgaaagcaucacacuugccaccggaccccugacuacgcucugggagggcuccccagguaaguuuuggaauacaaccauagcaguuucuauggcuaacauuuuccggggcucauaucuagccggggcgggacuggccuuuagcuugaugaaaucccugggcgggggacgaagaggcacuggugcacagggggagacccucggagaaaaguggaagaggcagcuuaaucagcugaguaaaucugaguucaacaucuacaagcgcagcggcauuauggaaguggaccggucagaggcuaaagaagguuugaagagaggcgagacaacucgucacgccgucuccagggggaccgcaaaacugcggugguucguggagcgcaaucucguaaagccugaaggaaaggugaucgauuuaggcugugggcgaggaggcuggaguuauuacugcgcuggucugaaaaagguuacagaggugaaaggguauacgaagggaggccccggccaugaggagccgauaccaauggccaccuacggguggaaccuugucaaacugcacagcggaaaggacguguuuuucacuccucccgaaaaaugugauacacuacucugcgacaucggugagucuuccccaaaucccaccauugaggaaggcagaacucugagggucuugaagaugguggagccuuggcugcgggggaaccaauuuuguaucaagauucucaauccguacaugcccucaguuguagaaacacuugagcagaugcagcgcaaacauggaggcaugcuggugagaaacccauuaagcagaaauucgacccacgagauguauugggucucuugcgguacggggaacaucgugagugccguuaauaugaccucccgaaugcuguugaaccgguucacaauggcgcaccguaagccuacuuacgaaagagauguggaccucggagcuggcacccgccaugucgcaguggagcccgaaguagccaaccuggauauuaucggccagaggauagagaauauuaaacacgaacauaagagcacauggcacuaugacgaggauaacccuuacaaaacuugggcuuaucaugggucauacgaggugaagccauccggaucugccagcaguaugguuaauggugucgugaagcuacuuaccaaacccugggacgugaucccuauggucacacaaaucgcaaugaccgauacuacgccauuuggccagcagcggguuuucaaggaaaaaguggacacaagaacccccaaggccaaacgcgggacugcucaaauuauggagguaaccgcgagguggcuguggggauuucucucccgaaacaagaagccgcggauauguacaagagaagaguucacgaggaaagugcgcagcaaugccgcaaucggcgcugucuuuguggacgaaaaccaguggaacucugccaaggaggcaguugaggaugaacguuucugggaccugggucagaaagagcgggaauugcacaagcaggggaaaugcgcaaccugcguguauaacaugaugggaaagagagagaagaaacugggcgaauuuggcaaggcuaaagggucaagggccauuugguacauguggcucggagcgcgcuuccuugaguuugaggcacuggguuucaugaaugaagaucacugguucagucgagagaacuccuuaagcggcgucgaaggggagggacugcauaaguugggcuacauccuccgggacauuucuaaaaucccuggugggaauauguaugccgaugacacugcuggaugggauacaagaauaaccgaggacgaucugcaaaacgaagccaagaucacugacauuauggagccagaacacgcacuacuugcuacaucgaucuuuaaacugaccuaccagaauaaggugguaaggguucagcgccccgccaagaacggcacagugauggaugucauuucaagacgggaccagaggggcagcgggcaagugggaacuuauggucucaauaccuucacgaacauggaggcucagcugauccgucagauggaauccgagggcauauuuuugccuagugaguuagaaaccccaaaccuggccgagcgagugcucgauuggcuugaaaaauacggggucgagcgccugaagagaauggcaauuucuggagacgacuguguugugaaacccaucgaugaccgguucgcgacagcccuaacugcucugaaugauaugggcaagguaaggaaagacaucccgcagugggaaccuagcaaggguuggaacgauuggcaacaggugcccuuuugcucccaucacuuccaccagcucauuaugaaggacgggcgcgagauagucgugccauguagaaaucaggaugaguugguuggacgggccagggugucacaaggcgcaggcuggagucugcgagaaaccgcuugccuugggaaaucuuaugcccagauguggcagcugauguacuuucaucguagagaccuccgcuuagcagccaacgcgaucuguagcgcugucccuguggauuggguacccacaucccggacuaccuggucaauucacgcccaucaccaauggaugacgacagaggacaugcugagcguuuggaauaggguguggaucgaagagaacccauggauggaagauaagacccaugucucuuccuggggagacgugcccuauuuggguaaaagagaggaccaguggugcggcagucugauugggcucacugcacgcgccacaugggcuagcaauauccagguugccauaaaccaggugcggaggcuuaucggaaaugagaacuaccuggauuacaugaccucgaugaagcgauucaaaaaugaaggcgacccugagggugcacuaugguga

SEQ ID NO: 13912 - RNA, 9879 nt, Artificial Sequence
  derived and/or modified CDS sequence (opt3) from DENV-1__JF937604__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgaacugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagaccuucggaacugcauacggcgugcuguuuucugguguaagcuggacaaugaagauugggauaggcguguugcucaccuggcugggauuaaauucacgaaguacaucccugagcaugacuuguaucgcgguuggccuagucacccucuaccugggggugauggugcaggcugauucuggaugcgucauuaacuggaaaggccgcgaacuuaagugugguucagggaucuucguuacgaaugaggugcacacauggaccgaacaauauaaguuucaggccgacaguccgaaaagauugagcgcagccaucggaaaggcuugggaggagggcgugugcgguauuagguccgccacucggcuggaaaacauaauguggaaacagaucucuaacgagcucaaucauauucuguuagaaaacgacaugaaguucaccguagucgugggcgauguugcagggauccuggcucagggcaaaaagaugauucgcccucaacccauggaguacaaauauucguggaaaagcuggggcaaggccaagaucauaggggcggacgugcagaauacaacuuuuaucauugauggaccaaacaccccugaaugucccgacgaucagagagccuggaauaucugggaggucgaggacuacggcuucgguauuuuuacaacgaacaucuggcuuaaguugagggauuccuauacccaggugugcgaccaccgucucaugucagcugcaauaaaagauaguaaggccguucacgcugacaugggguacuggauugaaucugagaaaaaugaaacuuggaagcuggcccgggcauccuucaucgaggugaagacauguauuuggccaaaaucccauacccuauggucaaacggaguacuggaaagcgagaugaucauacccaagaucuauggcgguccuauuucucaacacaauuaccgaccaggcuacuucacucagacagcggggccguggcaucucggaaaacuggagcuugauuuugacuugugcgaaggcaccacggucgugguggaugagcacugcgggaacagaggacccucccugaggacuaccacagucaccggcaagaucauucacgaaugguguugccgcaguuguacuuuaccuccacuccgguucagaggugaggacgggugcugguauggaauggagaucaggcccguuaaagaaaaggaggaaaaucugguaaagagcaugguaucugccggcuccggugagguggacucauuuagucuuggccuguuguguauaagcauuaugaucgaagaggucaugcgcucgcgauggucccggaaaaugcucaugacagggacccuggcuguguucuuucuacugaucaugggacagcucacauggaacgaucugauucgucuuugcaucaugguuggcgccaaugcaucugacagaauggggaugggaacuaccuacuuggcucugauggccacguucaagaugaggccuauguuugcagugggcuuacucuuccgccggcugacaagcagagagguccuucugcuaaccauuggucucucacugguggccaguguugaauugccaaacucccuggaggaauuaggggauggacucgcuaugggcauaaugauccugaaacuucugacugacuuucaaucuuaucaguugugggcgacccuccugagccuaacauucauuaagacuaccuuuucccugcauuacgccuggaaaacgauggcaauggugcuuucaaucgucagccucuucccccuguguuugaguacaaccucucagaagacuacauggcugccgguauuacucggcucccuggggugcaagccucuuaccauguuucugauugcugagaauaaaaucuggggaaggcgaagcuggccauugaacgaagguauaauggccgugggcaucguuucgauucuccugucaucucuacugaagaacgaugugccccuugccgggccucucaucgcuggaggcaugcugauugcauguuaugucaucagugguuccagcgccgacuugucuuuagagaaagcggcugaggugagcugggaagaggaagccgagcacuccggggcaucacauaauauacugguagaagugcaggaugacggaacuaugaagauuaaagaugaggagcgcgacgauacacucaccauccugcuuaaggccacgcuguuggcugucaguggcguuuacccccuaagcaucccagcaacucuguucgugugguauuucuggcagaaaaagaagcagcggucuggcgugcucugggacaccccuucacccccagaagucgagagagccgugcuggaugacgggauuuacaggauaaugcagcguggacuuuuaggucgcagccagguuggcguagggguguuucaagaaaacgucuuccacacaauguggcaugugacccggggagcgguucugauguaccagggcaaaagacucgagccgaguugggcuagcgugaagaaagacuugaucuccuauggugggggauggaggcugcagggcuuuuggaauacaggcgaggaaguccaggugauugccguagagccugggaagaaccccaaaaauguccaaacugcaccaggaaccuucaagacgcccgaaggugaggugggcgccaucgcucucgauuuuaagccugggacaucuggaucgccaauuguuaaccgagaaggcaaaaucgugggucuguacgggaauggagucgugacuaccagcggcacauauguuucagccauagcacaggcuaaggccucccaggagggcccccuuccugagaucgaagacgagguguuccggaaacgcaaccugaccauuauggauuugcacccggggaguggaaagacuagaagguaccuaccagcgaucguccgggaagccauuaaacgaaagcugagaacccucaucuuagcacccacacgcgugguagcuucugagauggccgaagcucugaaggguaugccuauaagguaucaaacgacugcagugaaaagcgagcacaccggcaaggagauuguugaccuuaugugccaugccacauuuaccaugcgucugcucuccccaguccgggugcccaauuacaacaugaucaucauggaugaagcccacuucacugacccuucaucuauugcugcgagaggguauaucagcacaagggugggaaugggcgaggcagccgcuauauuuaugaccgccacgccgcccgguagugucgaagcauucccacaguccaaugccguaauucaggaugaggaacgcgacaucccugagcgaagcuggaacucuggguacgaguggauuacugauuuucccggaaaaacagugugguucguuccaucaaucaaguccggcaaugacauagcuaacuguuugaggaaaaauggcaagcgggugauucagcugaguaggaagaccuucgauaccgaauaccagaaaacuaagaacaacgacugggacuaugucgugacaaccgauaucagcgagaugggggcgaauuuucgcgccgaccguguuaucgauccuagacggugccucaaacccgugauucugaaggacggaccagaaagggucauccuugcagguccgaugccugugacaguagcuucggccgcacagcgccgaggcagaauugggcggaaccauaauaaagagggagaucaguacauauauaugggccagccccuaaacaaugacgaggaucacgcccauuggacugaagcuaagaugcuguuggacaacaucaauacgccagaggguauuauccccgccuuauucgaaccugagagggaaaagucugcggcaaucgauggggaguaccgccugagaggcgaggccaggaaaaccuuuguggaacucaugcggcguggagaccugccaguuuggcuuuccuauaaggucgcuagcgagggcuuccaauacucagaucgccgauggugcuuugacggggaaagaaacaaucaggugcuggaggaaaacauggauguggagauuuggacaaaagagggagaaaggaagaaacuccggccccgcugguuggacgccagaacuuaugcugacccucuggcacuaagggaguucaaggaauuugccgcuggucggcgaagugucucuggcgaucugauacucgagaucgggaaacuuccgcagcaccugacccagagagcccaaaaugcauuagacaacuugguuaugcugcacaauuccgaacagggaggccgcgcguacaggcaugccauggaggagcucccagauacaauugaaacccugaugcuucuggcucucaucgccguguugacuggugggguaacgcuguucuuuuuaagcggccggggacuaggcaagaccucaauugggcugcucugugugauggcaaguagcguccuucuguggauggcuuccguggagccccacuggaucgccgcaucuauaaucuuggaguucuuucugaugguucuccugauuccugagcccgaccgucagagaacaccacaggauaaccaacuugccuacguggucaucggacuccuguucaugauuuugacuguagcugcgaaugagaugggucuguuagaaaccacaaagaaagaccuaggcaucgggcauguggccguugagaaccaccaccaugcagcuaugcuggauguggaccuccacccugccagcgccuggacccuuuaugcagucgcuacuacaauaauuacgcccaugaugaggcauaccaucgaaaacacuacagccaauauuucccugaccgcgaucgcuaaccaggccgcaauauugaugggacuggauaagggcuggccaaucucaaaaauggacauuggugugccucuccuggcccuugggugcuacucucaggucaauccguuaacccugacagcugcagugcucauguugguugcccacuaugcgaucauuggccccggacugcaagcuaaggccacucgcgaggcacagaaacggacggccgcuggcaucaugaagaacccaaccguggaugggauaguagccauugaccuagauccuguggucuacgacgcaaaguuugaaaaacagcugggacagaucaugcuccuuauccuguguacaagucaaauuuugcugaugcgaacuaccugggcucucugcgagucgaucacacuggccaccggccccuuaacuacgcuuugggaggguagcccagggaaguucuggaauacaaccauagcgguuuccauggccaacauuuucagaggaucuuaucuggcaggcgcuggucucgccuuuucacuaaugaaaagccugggcgggggaaggcgcggcacuggggcacagggagaaaccuugggcgagaaguggaaacggcagcugaaucagcucuccaagagugaguucaacacauacaagaaaucugguaucauggagguggacagaagcgaagcuaaggaggggcuuaaacguggagagacuaccaagcaugccgucucaaggggcacagccaaacugcggugguuuguggaacgcaauuugguaaagccugaggguaaggugauugaucugggcugugggcgaggaggcugguccuauuacugcgcggggcucaaaaagguuacggaagugaaaggauacaccaagggcggucccgggcacgaggaaccgaucccaauggcuacuuauggauggaacuuagucaaacugcacaguggcaaggacguguucuuuauaccucccgagaaaugugauacacuucugugcgacaucggcgagagcucuccaaaucccaccauugaagaggggagaacucuaaggguccucaagaugguggaaccuuggcugcggggaaaccaauucuguaucaagauuuugaauccguacaugcccuccguuguagagacacuggagcagaugcagcgcaaacaugguggcaugcucgugagaaacccacuuucaaggaauagcacccacgaaauguauugggucucgugcgggacgggaaacaucgugucugcaguuaauaugaccagucgaaugcuguuaaaccgguuuacaauggcccaucguaagccuacuuacgagagagauguggaccugggcgcugguacccgccacgucgccguggaacccgagguagcaaacuuggauauuaucgggcagaggauagaaaauauuaaacacgagcauaaguccacauggcacuaugacgaggauaacccuuacaaaacuugggccuaucauggaagcuacgaagugaagccaucaggcuccgcuucuagcaugguuaauggcgucgugaagcuccugaccaaacccugggacgugaucccuauggucacacaaaucgcgaugaccgauacuacgccauucgggcagcagcggguuuuuaaggagaaaguggacacaagaacccccaaggccaaacaaggaacugcacagauuauggaaguaaccgcuaaguggcuaugggguuuccuuagucgcaacaagaaaccgaggauauguacacgagaggaauuuacgcggaaggugagauccaaugccgcaaucggcgccgucuucguggacgagaaccaguggaauagcgcuaaagaggccguugaagaugagagguuuugggaccuggugcaccgcgaacgugagcuccauaagcaggggaaaugcgcgaccugcgucuacaacaugaugggaaagcgggaaaagaaacugggcgaguucgguaaggcaaaagggucuagagccauuugguauaugugguugggagcuagguuccuggaguuugaagcccucggcuucaugaaugaggaucacugguuuucacgcgaaaacagucuuuccggcguggagggggagggacugcacaaguuagguuacauccugcgagacauuagccaaaucccuggcgggaauauguaugcagaugacacugcuggaugggauacacggauaaccgaagacgauuugcagaacgaggccagaaucacugacauuauggaaccagagcaugcucuccuggccaaaucuaucuucaagcuaacauaccagaauaaaguaguuagggugcagcgccccgcaaagaacggcaccgucauggaugugauuucgagacgggaccaaagggguucaggacaggugggaacauauggccuuaauacuuuuaccaacauggaagcgcagcugauccgucagauggagagcgagggcauauucuccccuagugaacucgagacgccaaaccuggccgaacgagucuuggauugguuagagaaguacgggguugaacgccugaaaagaauggcuauuucuggagacgacugugugguaaagcccaucgaugaccgguuugccaccgcacucacagcucuuaaugauauggguaaagugaggaaggacaucccgcaaugggagccuagcaaaggcuggaacgauuggcagcagguccccuucugcucccaccauuuucaccagcugauuaugaaggacgggcgcgagauagugguuccauguagaaaucaagaugagcuagugggacgggccagggucucacagggcgcagguuggagucugcgagagacugccugccucgggaagucuuaugcgcagauguggcaauugauguacuuccaccguagagaccugcgccuugcugccaacgcaaucuguagcgccgugccuguagauuggauucccaccucccggacaacuuggucaauccaugcucaccaucaguggaugaccacggaagacaugcugagcguuuggaauaggguguggauugaggaaaacccauggauggaggauaaaacacacaucucuuccuggggagacguccccuaccucggcaagagagaggaccaguggugcggcaguuuaauagggcugaccgcccgcgcaacuugggcuacaaauauccagguggccauuaaccaaguucggagguugaucggaaaugaaaacuaucuggauuacaugaccagcaugaaacgauuuaagaaugagucggacccugaaggugcgcucugguga

SEQ ID NO: 13913 - RNA, 9879 nt, Artificial Sequence
  derived and/or modified CDS sequence (opt3) from DENV-1__JF937605__SS-prME
agcgugaccaugcugcucaugcuuaugcccacggcccuggcuuuccacuugacuacgagaggaggggagccucauaugaucgucuccaagcaggaaagggggaaaucuuuacuguuuaagaccucagccgguguuaacaugugcacacuaauugccauggaccucggcgagcugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacacugcaagagaccuggaaucggcaggacuugcucguaacauucaaaacugcacacgcuaagaagcaggaaguugugguccuggguagccaagagggggccaugcacaccgcuuuaacgggcgccaccgaaauccagacaaguggaacuaccacaauuuuugcaggccaucugaaaugccgucuaaagauggauaaacucacucugaaggggaugucuuaugugauguguaccggauccuucaaacuugagaaggaagucgccgagacgcagcacgguacaguguugguucagauaaaguacgagggcaccgacgcuccuugcaaaaucccauucagcacucaagaugaaaagggggugacacagaacggacgccugauuaccgcgaaucccaucguaacugacaaagagaagccugucaacauagaagcagagccacccuuuggcgagucguauauugugaucggugccggggaaaaagcucucaagcugucuugguucaagaaaggcuccucaaucggaaagauguuugaggccaccgcaagaggcgccaggcggauggcuauucuuggggauacagccugggacuucggaaguaucgguggcguuuuuacgagcguggggaaacugguccaucagauuuucggaaccgcauacggcguguuguuuuccgguguaucuuggacuaugaagauagggaucggcgugcuccugacaugguuaggacugaauagccgaucaaccagucuauccaugacauguauugcgguuggccucgucacucuguaccuuggggugauggugcaggcugauagcggaugcgucaucaacuggaaaggccgcgaauugaagugugguucugggaucuucguuaccaaugaggugcacacguggacagaacaauauaaguuucaggccgacucaccgaaaagacugagugcagccauuggaaaggcuugggaggagggcgugugcgguauaaggagcgccacccggcucgaaaacaucauguggaaacagauuuccaacgagcugaaucauaucuuacuggaaaacgacaugaaguucacuguagucgugggcgauguugcagggauucuugcucagggcaagaaaaugauccgcccucaacccauggaguacaaauauucuuggaagucguggggcaaggccaaaauaaucggggcggacgugcagaauaccacauuuauuaucgauggaccaaacacuccugaaugucccgacgaucagagagccuggaauauuugggaggucgaggacuacggcuucgguaucuuuaccacaaacauaugguugaagcucagggauagcuauacacaggugugcgaccaccgucugauguccgcugcaauuaaagauucaaaggccguucacgcugacaugggguacuggaucgaaagugagaaaaaugaaaccuggaagcuagcccgggcaucuuucauugaggugaagacuuguaucuggccaaaaagccauacacugugguccaacggaguacucgaaucagagaugauaauccccaagauuuauggcgguccuaucagccaacacaauuaccgaccaggcuacuucacccaggcggccgggccguggcaucugggaaaacuugaguuggauuuugaccugugcgaaggcacuacagucgugguggaugagcacugcgggaacagaggacccucuuuaaggaccacgacugucaccggcaagauuauccacgaaugguguugccgcuccuguacacucccuccacugcgguucagaggugaggacgggugcugguauggaauggagauaaggcccguuaaagaaaaggaggaaaaucuugugaagaguaugguaagcgcuggcucuggugagguggacuccuuuucacugggcuugcucuguauuaguaucaugaucgaagaggucaugcgcagccgauggucgcggcguaugcugaugaccgggacucuagccguguucuuucugcucauuaugggacagcugacauggaacgaucuuaucagauugugcauuaugguuggcgcaaaugcuuccgacaggauggggaugggaaccacauaccuggccuuaauggcaacuuucaaaaugcgcccuauguuugccgugggccuccuguuccggagacuuaccucuagggagguccugcuacucacgauaggucugagcuugguggcuucaguugaacugccaaacaguuuagaggaacucggggauggacuggcgaugggcaucaugauucuuaagcuguugacagacuuucaaucccaucagcucugggccacccugcuaucucugacuuucaucaaaaccacauuuagccuucacuaugcauggaagacuauggcuauggugcucuccauugucucacuguuccccuugugucugagcaccacgagucagaaaacaaccugguuaccgguacuccugggcucucuugggugcaagccucugacuauguuuuugaucgccgagaauaagauauggggacgacgcuccuggccacucaacgaagguaucauggccgugggcauuguuagcauccugcuaucgucacugcuuaaaaacgaugugccccucgcugggccucugauugcaggaggcauguugaucgccuguuacgucauaucugguaguuccgcggacuuaagccuggagaaggcugccaaagugucuugggaggaagaggcagaacauagcggggccucccacaauauucucguagaggugcaggaugacggaacaaugaagaucaaagaugaggaacgggacgauacccugacuauccuucugaaggcuacauugcuagcagucucaggcguuuauccccugaguauuccagccacccucuucgugugguacuucuggcagaagaagaagcagagaagcggcgugcugugggacacgccuucucccccagaggucgaaagggcggugcuugaugacgggauauaucguaucaugcagcgcggauuacugggucggucccagguuggcguagggguguuucaagagaacgucuuccauacuauguggcacgugaccagaggagcuguucucauguaccagggcaaaagguuggaaccgucaugggccaaugugaagaaagaccugauuaguuacggugggggauggcgacuccagggcagcuggaacacaggcgaggagguccaggugaucgcaguagaaccugggaagaaucccaaaaacguccaaaccgccccaggaacauuuaagacucccgagggugaagugggcgcuauugcccuggauuucaagccugggaccuccggaucuccaaucguuaaucgggagggcaaaauagugggucuuuaugggaacggagucgugacgacaucgggcacuuacguuagcgcaaucgcucaggccaaggcgucacaggaaggcccccugccugagauugaggacgaaguguuucgcaaaagaaauuugaccaucauggaucuacacccgggguccggaaagacaaggcgguaucugccagccauuguccgagaggcaaucaaaagaaagcuccgcaccuuaauacuggcucccacuagggugguagccagugaaauggcugaggcacuuaaggguaugccuauucguuaccaaaccacagccgugaaaucugaacauacgggcaaggagaucguugaccugaugugccacgccacuuucaccaugcggcucuugagcccagucagagugcccaacuauaauaugaucauuauggaugaggcucauuuuacagacccuuccucaaucgcggcaaggggguacauaucuacccgcgugggaaugggcgaagccgcugccauuuucaugacugcaacaccgcccgguagcgucgaggccuuuccacagaguaacgcuguaauccaggaugaggaacgagacauuccugaaagauccuggaauagcggguaugaguggaucaccgauuuccccggaaaaacggugugguuuguuccaucuauaaagucaggcaacgacauugcgaauugucugcggaaaaacggcaagagggugauccagcucucccgcaagacuuucgauacagaguaccagaaaaccaagaacaaugacugggacuacgucgugaccacugauaucagugaaaugggggccaacuuccgugcagacagaguuauugauccucggaggugccugaaacccgugauccuuaaggacggaccagagcgcgucauucuagcugguccgaugccugugacaguagccagcgcagcccagcgaagaggccggauagggaggaaucacaacaaagaaggagaucaguauaucuacaugggccagccccugaauaacgacgaggaucaugcucacuggaccgaggccaagauguuguuagacaauauuaacacaccagaagguaucauccccgcgcuguuugagccugaacgcgagaagucggcagccauugauggggaauauagacucaggggcgaggcucggaaaacuuucguggagcugaugcgucgcggagaccuuccaguuuggcugucuuacaaggucgccuccgaaggcuuucaauauagcgaucgaagauggugcuucgacggggagaggaauaaccaggugcucgaagagaauauggauguggaaauauggacgaaagagggagagcggaagaaauugcgccccagauggcuggacgcuaggaccuacucagacccucuagcacugcgggaauuuaaggaguucgccgcuggucgaagaagugucucuggcgaucucauccuugaaauugggaaacugccgcagcacuuaacacagcgcgcccaaaacgcauuggacaaucugguuaugcuccauaacuccgagcagggaggcagggcguaucggcacgccauggaggaacugccagauacuaucgagacccuuaugcugcucgcuuugauugccgugcugacaggugggguaaccuuauuuuuccuaagcggccguggacugggcaagacuucaaucgggcuccuuugugugauggcaaguagcguccuguuguggauggcuuccguggaaccccauuggauagccgcaucuaucauucuggaguuuuuccucaugguucugcuuaucccugaacccgacagacagaggacgccacaggauaaucaacucgccuacguggucauuggacuguuguuuaugauccugaccguagcugcgaacgagauggguuuacuagagacaacuaagaaagaccugggcauagggcacguggccguugaaaaccaccaucacgcagcuaugcucgauguggaccuucauccugccagcgccuggacccuguacgcagucgcuacaaccauuaucacucccaugaugcgccacacaauugagaauacgaccgccaacaucuccuugacugcgauagcuaaucaggccgcaauccugaugggacucgauaagggcuggccaauuucaaaaauggacaucggugugccucugcuugccuuagggugcuauucucaggucaacccgcugacacucaccgcugcaguguugaugcugguugcccauuacgcgauuaucggccccggacuacaagcuaaggccacccgggaagcacagaaacgaacagccgcuggcauaaugaagaauccaacuguggaugggauuguagccaucgaccuggauccuguggucuaugacgcaaaguucgagaaacagcucggacagaucaugcuucugauuuuguguacgagucaaauccugcucaugagaaccacaugggcucugugcgaaucgauaacuuuagccaccggcccccuuacaacccugugggaggguagcccagggaaguuuuggaacacuacgauugcgguuuccauggccaauaucuucaggggaucuuaccucgcaggcgcuggucuagccuucucacugaugaaguccuugggcgggggacgccggggcacaggggcacagggagagacccugggcgaaaaguggaaaagacagcucaaccagcuuagcaagagugaguuuaauacuuauaagcguucugguauuauggaaguggacaggagcgaggcuaaagaagggcugaagcggggagagaccacaaaacacgccgucucacgcggcacugccaaguugcgaugguucguggagagaaaccugguaaaaccugaagguaaggugaucgaucucggcugugggaggggaggcugguccuacuauugcgcgggguuaaagaaaguuaccgaggugaagggauacacaaaaggcggucccgggcacgaggagccgauaccaauggcuacguacggauggaaucuggucaaacuucauaguggcaaagacguguuuuucaucccucccgaaaagugugauacccugcuaugcgacauuggcgagagcucuccaaaccccacuaucgaggaagggcggacacuccgcguccugaaaaugguggagccuugguugagaggaaaucaauuuuguauuaagauccugaacccguauaugcccuccguuguagaaacccucgagcagaugcagaggaagcacgguggcaugcuugugcgaaauccacugucacggaacagcacucaugagauguacugggucucgugcgggacaggaaauauugugucugcaguuaacaugaccagucguauguuacugaacagauucacgauggcccaccgcaaaccuaccuaugaaagggauguggacuugggcgcugguacacggcacgucgccguggagcccgaaguagcaaaucucgauaucauagggcagagaauugagaacaucaagcaugaacacaaauccacuuggcauuacgacgaggauaauccuuauaagaccugggccuaccacggaagcuaugaggugaaaccaucaggcuccgcuucuagcaugguuaacggcgucgugaagcugcuaacaaagcccugggacgugaucccuauggucacucaaauugcgaugaccgauacaaccccauuugggcagcagcgcguuuucaaagaaaagguggacacuaggacgcccaaagccaagcgaggaacagcacaaauaauggagguaaccgcuaaauggcuuugggguuuucugagucggaauaagaagccgagaaucuguacuagggaagaguucacccgcaaagugcguuccaacgccgcaauuggcgccgucuuuguggacgaaaaucaguggaacagcgcuaaggaggccguugaggaugaacgguucugggaccucgugcauagagagagggaacugcacaaacaggggaagugcgcgacaugcgucuacaauaugaugggaaaacgcgagaagaaguugggcgaauuugguaaagcaaaggggucucgagccaucugguacauguggcugggagcucgguuccucgaguucgaggcccuuggcuuuaugaacgaagaucacugguucucaagagagaauagucuguccggcguggaaggggagggauuacauaaacuggguuauauuuugagggacaucagcaagauaccuggcgggaacauguacgcagaugacacggcuggaugggauacccgcaucacugaggacgaucuccagaaugaagccagaauuacagacaucauggagccagaacacgcucugcuagccaaaucuauuuuuaaacuuaccuaucaaaacaaaguaguucgggugcagaggcccgcaaagaauggcacugucauggaugugaucucgcgucgagaccagcgcgguucaggacaggugggaacauacggccugaacaccuucacaaacauggaggcgcaacucauaagacagauggaaagcgagggcauauuuuccccuagugagcuggaaacuccaaauuuggccgagcgggucuuagauuggcuggaaaaguaugggguugagaggcucaaacgcauggcuaucucuggagacgacugugugguaaagcccaucgaugacagauucgccaccgcacuuacggcucugaacgauauggguaaagugcggaaggacauuccgcagugggaaccuagcaaaggcuggaaugauuggcagcaaguccccuuuugcucccaucacuuccaccagcuaauaaugaaggacgggagggagaucgugguuccaugucgaaaccaggaugagcuggugggacgugccagagucucacagggcgcagguuggagucuccgcgaaaccgccugcuuggggaagucuuacgcgcaaauguggcagcugauguauuuucaucggagggaccuuagacuggcugccaaugcaauuuguagcgccgugccuguagauuggauccccacaucccgcacuaccuggucaauucacgcucaucaccaguggaugacaacugaggacaugcucagcguuuggaaccggguguggaucgaagagaauccauggauggaagauaaaacccauauaucuuccuggggagacguccccuacuuaggcaagagggaggaccaauggugcggcagucugaucggguugacggcccgagcaacaugggcuaccaacauucagguggccaucaaucagguuagacggcugauuggaaacgagaauuaccucgauuauaugacuagcaugaaaagguucaagaacgaaucggacccugagggugcgcuuugguga

SEQ ID NO: 13914 - RNA, 9879 nt, Artificial Sequence
  derived and/or modified CDS sequence (opt3) from DENV-1__JF937608__SS-prME
agcgugaccaugcugcucaugcuuaugcccacagcacuggcuuuccacuugacuacgaggggcggggagccucauaugaucgucuccaagcaggaaaggggaaaaucuuuacuguuuaagaccucagccgguguuaauaugugcacauuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaagguggaaaccugggcccucaggcacccuggauucacaguuauugcucuguuucuggcacaugccaucggcaccucgauuacgcagaagggcaucauauucauccucuuaaugcuggugacuccaucaauggcuaugcggugcgucgggauuggaagccgcgauuuuguggagggucuuaguggcgccacauggguagacguuguguuggagcacggguccugugucaccacuauggcgaaagauaagcccacacuggacaucgaauugcucaaaaccgaggugacgaacccugcaauucugagaaaacuuugcaucgaagccaaaauaucuaauaccacaacugauucgagauguccaacccaaggagaggcuacacugguggaagaacaggacgccaacuucgucugccggcgcacuuuuguugaucgaggcugggguaauggguguggauuguucggcaagggcucccucauuaccugcgcaaaguuuaaaugcgugacaaagcuggaggggaaaaucguacaguacgaaaacuuaaaguauucagugauugucaccgugcacacuggagaccagcaucaaguugguaaugagaguacggaacacggcacaaccgcuacuaucacaccccaggccccuacaaccgagauccagcugacugacuacggggcgcucacacuugauuguagcccaagaacgggacuggacuucaacgaaaugguguugcuaaccaugaaagagaagucuuggcugguccauaaacagugguuucucgaucugccgcuucccuggacuuccggcgccucaacaagccaagagaccuggaauaggcaggaccuguuggugacauucaagacugcacacgcuaagaaacaggaaguaguugugcucgguagucaagagggggccaugcacaccgcucugacgggcgccaccgaaauucagacaucuggaacuaccacaauauuugcaggccauuuaaagugccggcugaaaauggauaagcuaacucucaaagggauguccuaugucauguguaccggauccuucaagcuggagaaggaaguggccgagacgcagcacgguacaguccuugugcagaucaaauacgagggcaccgacgcuccuugcaagauuccauucucgacucaagaugaaaaagggguuacacagaacggacguuugaucaccgcgaaucccauagugacugacaaggagaaaccuguaaacauugaagcagagccacccuuuggcgagucuuauaucgucaucggugccggggaaaaggcucugaagcucuccugguucaaaaagggcucaaguauuggaaaaauguuugaggccaccgcacgcggcgccagaaggauggcuauccugggggauacagccugggacuucggaagcauugguggcguguuuacguccguugggaaacuugugcaucagauauucggaaccgcauacggcguccuguuuucuggugugagcuggacuaugaaaaucgggauuggcguauugcucacauggcugggauuaaauucacggaguaccucccugagcaugacauguaucgcggugggccuaguuacucucuaccugggggucauggugcaggcugauucuggaugcgugaucaacuggaagggccgagaacuuaagugugguucagggauuuucgucaccaaugagguucacacguggacagaacaauauaaauuucaggccgacaguccgaagcgcuugagcgcagccauaggaaaggcuugggaggagggcgugugcgguaucagauccgccaccaggcuggaaaacauuauguggaagcagaucucuaacgagcucaaucauauucuguuagaaaacgacaugaaauucacugugguagucggcgauguggcagggauccuggcucagggaaagaaaaugauacggccucaacccauggaguacaaguauucguggaaaagcuggggcaaagccaagaucauuggggcggacguucagaauaccacauuuaucauugauggaccaaacacuccugaaugucccgacgaucagcgcgccuggaauaucugggagguggaggacuacggcuucgguauauuuaccacaaacauuuggcuuaaauugagagauuccuauacgcaggucugcgaccacaggcucaugucagcugcaaucaaggauaguaaagccgugcacgcugacaugggguacuggauugaaucugagaagaaugaaaccuggaagcuggcccgugccagcuucaucgagguuaaaacuuguauauggccaaagucccauacacuauggucaaacggagugcuggaaagcgagaugaucauucccaaaaucuauggcgguccuauuucucaacacaauuaccggccaggcuacuucacccagacugcggggccguggcaucucggaaagcuggagcuugauuuugacuugugcgaaggcacaaccguagucguggaugagcacugcgggaaccgaggacccucccugagaacgacuaccgugacaggcaaaaucauacacgaaugguguugcaggaguuguaccuuaccuccacuccgcuuccggggugaggacgggugcugguauggaauggagauuagacccgucaaggaaaaggaggaaaaucugguuaaaagcauggugucugccggcuccggugagguagacucauuuagucuuggccuguuguguaucagcaucaugauugaagaggugaugaggucgcgcuggucccgaaagaugcucaugacugggacacuggcugucuuccuacugcucaucaugggacagcugaccuggaacgaucuuauucgguugugcauaauggugggcgccaaugcaucugaccguauggggaugggaacaacuuaccuggcuuuaauggccaccuuuaaaaugagaccuauguucgcaguuggccuccuguuuaggcgccuuacgagccgggaggugcugcuacucacaaucggucugucauuggucgccaguguggaacugccaaacuccuuagaggaacucggggauggacuggcuaugggcauuaugauccuuaagcuguugaccgacuuccaaucucaucagcucugggcgacucugcuaagccugaccuuuauuaaaacaacuuucucccuucacuaugccuggaagaccauggcaaugguucucucaaucgugagccuguuucccuugugucugaguacgacaucucagaagaccacuugguuaccgguccuccugggcucccuugggugcaaaccucugacaauguucuugauagcugagaauaagaucuggggaagaaggagcuggccacucaacgaagguauuauggccguaggcaucgugucgauucugcuaucaucucugcuuaaaaacgauguuccccucgccgggccucugaucgcuggaggcauguugauagcauguuacgugauuagugguuccagcgccgacuuaucucuggagaaggcggcugaggucagcugggaagaggaagccgagcauuccggggcaucacacaauauccucguggaaguacaggaugacggaaccaugaaaaucaaggaugaggagcgagacgauacucugacaauucuucugaaagccaccuugcuagcugugaguggcgucuauccccugagcauaccagcaacgcucuuuguuugguacuucuggcaaaagaagaaacagcgcucuggcgugcugugggacacuccuucacccccagaaguggagcgggccguccuugaugacgggaucuauagaauuaugcagaggggauuacugggucguagccaggugggcguugggguauuccaagaaaacguguuucauaccauguggcacgucacacgcggagcggugcucauguaccagggcaagcgguuggagccgaguugggcuagcguuaaaaaggaccugaucuccuacggugggggauggagacuccagggcucuuggaauaccggcgaggaagugcaggucauugccguggagccugggaaaaaccccaagaauguacaaacaacuccaggaaccuucaagacgcccgaaggugaggucggcgcaaucgcccuggauuuuaaaccugggacaucgggaagcccaauagugaacagggaaggcaagaucguuggucuuuaugggaauggaguggucacuaccucaggcacauacguguccgcuauugcccaggcaaaagcuagucaggagggcccccugccugagaucgaagacgagguuuuccgaaagcggaacuugaccauuauggaucuacacccggggucuggaaaaacucgcagauaucugccagccaucgugagggaagcgauaaagcggaagcuccgaaccuuaauucuggcccccacaagagucguggcaagcgagauggcugaagcccuuaaagguaugccuauccgcuaccaaacgacugcuguaaaguccgagcauaccggcaaagagaucguggaccugaugugccacgcaacauuuaccaugaggcucuugucaccaguucguguccccaauuauaacaugauuaucauggaugaagcccauuucacugacccuucuagcauagccgcucggggguacauuaguacaagagugggaaugggcgaggcggcagccaucuuuaugaccgcuacgccgcccgguuccguggaagccuucccacagagcaaugcagucauucaggaugaggaaagggacaucccugagcgcucuuggaacucaggguaugaguggauaacugauuuucccggaaagacaguaugguucgugccauccauuaaaaguggcaaugacaucgccaacugucugcgaaagaauggcaagagaguuauccagcucagccggaaaaccuuugauaccgaauaccaaaagacuaaaaacaacgacugggacuacguggucacaaccgauauuucggagaugggggcuaauuucagggcggaccgcgugaucgauccucguagaugccugaagcccguuauucuuaaagacggaccagaacgggugauacuagccgguccgaugccugucacaguggcaucugcugcccagaggcgcggccgaaucgggagaaaccacaauaaggagggagaucaguauauuuacaugggccagccccugaacaaugacgaggaucaugcacacuggacugaagccaagauguuguuagacaacaucaauacgccagaggguaucauucccgcucuguucgaaccugagcgggaaaaauccgccgcgauagauggggaguauaggcuccgcggcgaggcaagaaagaccuuuguagaacugaugaggcggggagaccuuccaguguggcugagcuacaaaguugccucagagggcuuccaauauagugaucgucgcuggugcuuugacggggaacgaaacaaucagguccucgaggaaaacauggauguggagaucuggacaaaggagggagaaaggaagaaguugaggccccgguggcuggacgcucgcacuuacucugacccucuagcccugagagaguucaaagaauuugcugcagguaggcgguccgugagcggcgaucucauucuugagaucgggaagcugccgcagcacuuaacccagcgagcccaaaaugcuuuggacaaccuggucaugcuccauaauucagaacagggaggcagagccuaucgccacgcaauggaggagcugccagauacaauugaaacccuuaugcugcucgcguugaucgccguucugacugguggggugacguuauucuuucuaaguggcaggggacugggcaagaccagcauagggcuccuuuguguaauggcuuccucugugcuguuguggauggccagcgucgagccccauuggaucgcagcuuccauuauccuggaguucuuucucauggugcugcuuauuccugagcccgaccggcagcguacaccacaggauaaccaacucgccuacguugugaucggacuguuguucaugauacugacugucgcagccaaugagauggguuuacuagaaaccaccaaaaaggaccugggcauugggcacguagcugugggaaaccaccaucacgcggccaugcucgauguugaccuucauccugcaucagcuuggacccuguacgccguggccacuacaaucauuacgcccaugaugagacacaccaucgagaacacuacagcaaauauaucuuugaccgcuaucgccaaccaggcggcuauucugaugggccucgauaaagguuggccaaucaguaagauggacauuggggucccucugcuugccuuaggcugcuauagccaggugaauccgcugacccucacagcagccgucuugaugcugguggcucauuacgcaaucauaggacccggccuacaagccaaagcgacuagggaagcucagaagcgcacggccgcagggauuaugaagaacccaaccguugauggaaucguggccaucgaccuggauccuguaguguaugacgcuaaauuugagaagcagcucggccagauuaugcuucugaucuuguguacaagccaaauacugcucaugcggacuaccugggcccugugcgaauccauuacauuagcaaccgguccccuuacuacgcugugggaggggucuccaggaaaauucuggaauacaaccaucgcugucucaauggccaacauuuuucgaggcagcuaccucgcgggugccggccuagcauucucccugaugaagagucuagggggaggcagaagggggacuggagcucagggcgagacccugggugaaaaauggaagcgccagcucaaucagcuuucuaagagcgaguucaacacauauaaacggucagggaucauggaaguugacagauccgaggccaaggaaggacugaaacguggcgagacuaccaagcacgcagugaguagggguacagcuaaauugcggugguuugucgagcgcaaucuggugaagccugaaggcaagguaauagaucucggguguggacgaggcggguggagcuacuauugcgccggacuaaagaaggugacggagguuaaaggcuacaccaagggugggcccggacacgaagaaccgaucccaauggccacuuacggcuggaaccuggugaaacuucauucuggcaaggacgucuucuuuauuccucccgaaaaaugugauacacugcuaugcgacaucggggaguccucaccaaaucccaccauugaggaaggaagaacucucagggugcugaagauggucgagccuugguugcgggguaaccaauucuguaucaagauucugaauccguauaugcccagcgugguugaaacacucgagcagaugcagcgcaaacacggcgggaugcuuguaagaaacccacugucgagaaauucuacccaugagauguacugggugaguugcggaacgggcaacaucgucuccgcggugaauaugaccagccgaauguuacugaaccgguuuacaauggcucaccguaagccuacuuaugaaagagauguugacuugggugcagggacccgccacguggccgucgagcccgaaguggcuaaccucgauauaauuggacagaggaucgagaauaucaaacaugaacacaagucaacauggcauuacgacgaggauaacccuuauaaaacuugggccuaccacggcuccuaugagguaaagccaucuggcagcgcaaguuccauggugaaugggguugucaagcugcuaaccaaacccugggacgugauuccuauggugacacaaauagccaugaccgauacuacgccauucggacagcagcgggucuuuaaggaaaaaguugacacaagaacccccaaggcuaaacgcgguacugcgcaaaucauggaggugaccgccaaguggcuuuggggcuuccugagcaggaacaagaaaccgcgaauuuguacacgggaagaguuuacgagaaagguaaggucuaaugcagcuaucggggccguguucgucgacgaaaaccaguggaacucagcaaaagaggccguggaggaugaacgcuuuugggaccucguucaucgugagcgggaacugcacaagcagggaaaaugcgcuaccugcguguacaacaugaugggcaagagagagaagaaauugggugaguucgggaaggccaaaggaaguagggcgauuugguacauguggcugggcgcacgcuuucucgaguucgaggcccuuggcuucaugaaugaagaucacugguuuucccgagagaacagccugucuggggucgaaggagaggguuuacauaagcugggcuauaucuugcgggacauaucgaaaaucccugggggaaauauguacgcugaugacacugccggcugggauacaagaauuaccgaggacgaucuccagaacgaagcaaggaucacugacauuauggagccagaacacgcucugcuagccaagucaaucuucaaacuuacauaucaaaauaaggugguacgcguucagagacccgcuaagaacgguaccgugauggaugucauaagccggagggaccagcguggguccggacaggugggcacauacggccugaauacuuuuaccaacauggaggcccaacucauucgacagauggaaagugaggggaucuucucuccuagcgagcuggaaacgccaaacuuggcagagcgcguguuagauuggcuggaaaaauauggagucgagagacucaagcggauggcgaucuccggugacgacuguguugugaaacccauugaugacagguuugccaccgcucuuacagcccugaaugauaugggcaagguacgcaaagacauaccgcagugggaaccuucaaagggguggaacgauuggcagcaagugcccuucugcagucaucacuuucaccagcuaaucaugaaggacggaagagagauugucgugccaugucggaaucaggaugagcugguuggcagggcacgagugucucagggugcuggguggagccuccgugaaacugccugcuugggaaaauccuacgcacaaauguggcagcugauguauuuccauagacgcgaccuucggcuggccgcgaacgcuaucuguucagccgucccuguggauuggauucccaccagcaggacaacuuggucuauccacgcacaucaccaguggaugaccacggaggacaugcucuccguauggaauagaguuuggauagaagagaacccauggauggaagauaagacacauaucaguagcuggggcgacgugcccuacuuaggcaaacgcgaggaccaauggugcgggucgcugauuggauugaccgcccgggcuacuugggccacaaauauccaggucgcaauuaaccaggugaggcgacugaucgguaaugagaacuaccucgauuauaugaccuccaugaagagauuuaaaaaugaaucugacccugagggcgcucuuugguga

SEQ ID NO: 13915 - RNA, 9879 nt, Artificial Sequence
  derived and/or modified CDS sequence (opt3) from DENV-1__GU131739__SS-prME
agcgugaccaugcugcucaugcuuaugcccacagcacuggcuuuccacuugacuacgagaggaggggaaccucauaugaucgucuccaagcaggaaagagggaaaucuuuacuguuuaagaccucagccgguguuaauaugugcacccuaauugccauggaccucggagaacugugugaagauacuaugaccuacaaaugcccacggaucacagagaccgaaccggacgauguggacuguuggugcaaugcgacugauacauggguaaccuaugggacguguagucaaacuggagagcaccgccgagacaagcguagcguggcucuugcaccacaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauuuucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaaaaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggccagcuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugguucucucaauugugagccuguuccccuugugucugaguacgacaucucagaagaccacuugguuaccgguccuccugggcucccuugggugcaagccucugacaauguuuuugaucgcugagaauaaaauauggggaaggcgaagcuggccacucaacgaagguaucauggccguaggcauugugucgauccugcuaucaucucugcuuaagaacgauguuccccucgccgggccucugauugcuggaggcauguugaucgcauguuacgugauaagugguuccagcgccgacuuaucucuggagaaagcggcugaggucagcugggaagaggaagccgagcauuccggggcaucacacaauauucucguggaaguacaggaugacggaaccaugaagaucaaagaugaggagcgcgacgauacucccacaauccugcuuaaggccacccuguuggcugugaguggcgucuauccacuaagcauuccugcaacgcuguucguuugguacuucuggcagaaaaagaagcagcggucuggcgugcucugggacacucccuccccaccggaaguggagagagccguccuggaugacgggauauauaggaucaugcagcguggacuuuuaggucgcucacaggugggcguugggguauuucaagaaaacguguuccauaccauguggcacgucacacggggagcggugcugauguaccagggcaaaagacucgagccuaguugggcuagcguuaagaaagacuugauuuccuacggugggggauggaggcugcagggcucuuggaauaccggcgaggaagugcaggucaucgccguggagcccgggaagaaccccaaaaauguacaaacagcacccggaacuuuuaagaccccugaaggugaggucggcgccauugcucucgauuucaagccagggacgucgggaagccccaucgugaaccgagaaggcaaaauaguuggucuguaugggaauggaguggucacaacuucaggcaccuacguguccgccaucgcacaggcuaaggccagucaggagggcccucuuccggagauugaagacgagguuuuucggaaacgcaaccugacaaucauggauuugcacccagggucuggaaagaccagaagguaucuacccgcgauugugcgggaagccaucaaacgaaagcugagaacucucauauuagcaccuacccgcgucguggcuagcgagauggccgaagcucugaaggguaugccaauuagguaccaaacaacggcaguaaaauccgagcauacuggcaaggagaucguggaccuuaugugccacgccaccuucacaaugcgucugcucucacccguucgggucccuaauuauaacaugaucauuauggaugaagcccauuuuaccgacccgucuagcaucgcugcgagaggguacauaaguacuagggugggaaugggcgaggcagccgcuauuuucaugacagccacacccccagguuccguggaagcauuuccucagagcaaugccgucauccaggaugaggaacgcgacauucccgagcgaucuuggaacucaggguaugaguggaucacggauuucccaggaaaaacuguaugguuugugccuuccauaaagaguggcaaugacauugcuaacuguuugaggaaaaauggcaagcggguuauccagcugagcaggaagacauucgauaccgaauaccagaaaaccaagaacaacgacugggacuacguggucacuacagauaucucggagaugggggcgaauuuccgcgccgaccgugugauugaucccagacggugccucaaaccaguuauccugaaggacggaccggaaagggugauucuugcagguccuaugcccgucaccguggcuucugccgcacagcgccgaggcagaauagggcggaaccacaauaaagagggagaucaguauaucuacaugggccagccacuaaacaaugacgaggaucaugcccacuggacagaagcuaagaugcuguuggacaacauuaauacucccgaggguaucaucccugccuuauuugaaccagagagggaaaaguccgcggcaauugauggggaguaucgccugagaggcgaggccaggaaaacguucguagaacucaugcggcguggagaccugcccguguggcuuagcuacaagguugcuucagagggcuuucaauauagugaucgccgauggugcuucgacggggaaagaaacaaucagguccuggaggaaaacauggauguggagauauggaccaaagagggagaaaggaagaaacuccggccucgcugguuggacgccagaacauacucugacccgcuggcucuaagggaguuuaaggaguucgcagccggucggcgauccgugagcggcgaucugauccucgagauugggaaacuuccacagcaccugacucagagagcucaaaaugccuuagacaacuuggucaugcugcauaauucagaacagggaggccgcgcauauaggcacgcgauggaggagcuccccgauaccaucgaaacacugaugcuucuggcccucauugcuguuuugaccgguggggugacucuguuuuucuuaaguggccggggacuaggcaagacgagcaucgggcugcucuguguaauggccuccucugugcuucuguggauggcaagcgucgagccucauuggauagcugccuccaucauuuuggaauuuuuccugauggugcuccugauccccgagccagaccgucagagaaccccucaggauaaccaacuugcauacguugugauuggacuccuguuuaugaucuugacagucgccgcuaaugagaugggucuguuagaaacuaccaagaaagaccuaggcauagggcacguagcgguggagaaccaccaucacgccgcaaugcuggauguugaccuccaucccgcuucagccuggacacuuuacgccguggcaaccacuauuaucacaccaaugaugaggcacacgauugaaaacaccacugcuaauaucucucugacagccauagcgaaccaggcugccaucuugaugggacuggauaagggcuggccuauuaguaaaauggacaucggugucccgcuccuggcacuugggugcuauagccaggugaaucccuuaacccugaccgccgcuguccucauguugguggcacauuacgccauuaucggcccaggacugcaagcgaaggcuacacgcgaggcccagaaacggacugcagccggcauaaugaagaacccuacgguugaugggauuguggcuaucgaccuagaucccguaguguaugacgccaaguucgaaaaacagcugggacagaucaugcuccuuauucuguguaccagccaaaucuugcugaugcgaacaacuugggcacucugcgaguccauaacccuggcuacaggcccauuaaccacucuuugggaggguucuccugggaaguuuuggaauacgacaauugccgucucaauggcgaacaucuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguauuauggagguugaccguuccgaagcaaaagaggggcuuaagaggggagagacaacuaaacacgcugugagucggggcaccgccaagcugcgcugguucgucgaacgaaauuuggugaaacccgaggguaagguaaucgaucugggcugugggagaggaggcuggagcuacuauugcgccgggcucaagaaagugacagaaguuaagggauacacgaaaggcgguccggggcacgaggaaccaauaccuauggcgaccuacggauggaacuuagugaagcugcauucuggcaaagacgucuuuuucauacccccagagaagugugauacucuucugugcgacauuggcgaguccucacccaauccuacaaucgaagaggggaggacccuacgggugcucaaaauggucgaaccguggcugcgcggaaaccaauuuuguauuaagaucuugaaucccuauaugccaagcgugguugagacucuggagcagaugcagagaaagcacgguggcaugcucguaaggaacccucuuucgcgaaauucuacacaugaaauguacugggugaguugcgggaccggaaacauugucuccgcugugaauaugacgagccggaugcuguuaaaccguuucaccauggcacacagaaaacccacauaugagcgcgauguugaccugggcgccgguacuaggcacguggcugucgaaccugagguggccaacuuggauaucauagggcagcggauugaaaauaucaagcaugagcacaaaucaaccuggcauuacgacgaggauaacccauauaagacaugggcauaccacggauccuaugaaguaaaacccucuggcagcgccaguuccauggugaauggcguugucaagcuccugacuaagccuugggacgugaucccaauggugacccaaauugcuaugacagauaccacucccuuugggcagcagagagucuucaaagagaagguugacacgcgcacaccgaaagcgaagaggggaaccgcccaaauaauggaagugacugcaaaauggcuaugggguuuucuuagccgaaacaagaagccucggaucuguaccagagaggaguucacaaggaaaguacgcucuaaugcugccauuggcgcaguguuugucgacgagaaccaguggaacucagccaaggaggcuguggaagaugagcguuucugggaccugguucaucgggaaagagagcuccacaaacaggggaagugcgccacgugcguguacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcgucgagggggagggacugcauaaauuagguuauauucugagagacaucucgaagauaccaggcgggaauauguacgccgaugacaccgcaggaugggauacuaggaucacagaagacgauuugcagaacgaggcucgcauuaccgacaucauggaacccgagcacgcccuccuggcuaaaucaauuuuuaagcuaacuuaucaaaauaaagugguaagaguucagcggccugccaagaacggcacagugauggaugucaucagcaggcgugaccagcgagguuccggacaggugggaaccuacggccuuaauacauucacuaacauggaagcacaacugauacgccagauggagagugagggcauauuuucuccaagcgaacucgagacccccaaccuggcggaaagaguguuggauugguuagagaaguauggggucgaacggcugaaaaggauggccaucuccggagacgacuguguugugaagccgaucgaugaccgcuucgcuacggcccucaccgcacuuaaugauauggguaaaguaagaaaggacauuccucagugggagcccucaaaaggcuggaacgauuggcagcaagugccauuuugcagucaucacuuccaccagcugauaaugaaggacgggcgggagaucgucgugccuuguaggaaucaggaugagcugguuggacgagcucgugugucucagggcgccgguuggagccugagagagacagcaugccucgggaaguccuacgcccaaauguggcaguugauguauuuucaucgccgggaccugaggcuugcggcuaacgccauuuguucagcaguccccguggauuggaucccaacuagcagaaccacauggucuauucacgcccaucaccaguggaugacuaccgaagacaugcuguccguauggaaucgcguuuggaucgaggaaaaccccuggauggaggauaaaacgcauauaaguagcuggggagacgugccuuaccucggcaagcgggaggaccaauggugcggcucguuaaucgggcugacagcuagggccaccugggcaacuaauauucaggucgcuaucaaccaggugcgaagauugauuggaaaugaaaacuaccuggauuauaugacauccaugaaacgguucaagaaugagucugacccagaaggugcccucugguga

SEQ ID NO: 13916 - RNA, 9879 nt, Artificial Sequence
  derived and/or modified CDS sequence (opt3) from DENV-1__GU131740__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgugccuugcaagauaccauuuucuacccaggaugaaaaagggguaacucaaaacggacgccuuaucacagcgaaucccauugucaccgacaaggagaaaccugugaacaucgaagcagagccacccuucggcgaguccuauauaguuauuggugccggggaaaaggcuuugaagcugucaugguuuaaaaagggcaguagcaucggaaaaauguucgaggccacugcaagaggcgccaggcggauggcuauccucggggauaccgccugggacuuuggauccauugguggcguguucacaucugucgggaagcuggugcaucagaucuuuggaacggcauacggcguacuuuucagcggugugucauggaccaugaaaauugggauaggcguucuguugacuuggcucggacugaauagucgauccacuagcuuaucuaugaccuguaucgcggucggccuggugacacuauaccucggggugaugguccaggcugauucaggaugcguuauuaacuggaagggccgcgaacugaagugugguagugggaucuuugugacuaaugaggugcacaccuggacggaacaguauaaauuccaagccgacagcccgaagagacuuuccgcagccaucggaaaggcuugggaggagggcguaugcgguauuaggucugccacacgguuggaaaacauaauguggaagcagaucucgaacgagcugaaucauauucuccuggaaaacgacaugaaauuuaccgucgugguuggcgauguggcagggaucuuagcucagggaaagaaaaugauucgcccucagcccauggaguacaaguauagcuggaaguccuggggcaaagccaagaucauaggggcggacguccaaaauacuaccuucaucauugauggaccaaacacaccugaaugucccgacgaucagagagccuggaauaucugggagguggaggacuacggcuuugguauuuucacuaccaacaucuggcugaaacuuagggauucauauacacagguuugcgaccaccguuugaugagugcugcaauaaaggauucuaaagccgugcacgcugacaugggguacuggauugaaagcgagaagaaugaaacguggaagcucgcccgggcauccuucaucgagguaaaaaccuguauuuggccaaagucacauacucuguggagcaacggaguccuagaaucugagaugaucauacccaaaaucuauggcgguccuauuucccagcacaauuaccgaccaggcuacuuuacacaaaccgcggggccguggcaucugggaaagcucgagcuggauuucgaccuuugcgaaggcacuacagugguggucgaugagcacugcgggaacagaggacccaguuugaggaccacgacuguuaccggcaaaaucauucacgaaugguguugccgcagcuguacacugccuccauuacgguuuaagggugaggacgggugcugguauggaauggagaucagacccgugaaggaaaaagaggaaaaucucguaaagucuaugguguccgccggcucaggugaggucgacaguuucagccugggccuucuguguauaucgauuaugaucgaagaggugaugaggucccgcuggucucgaaaaauguugaugaccgggacucucgcuguauuuuuccugcuaaucaugggacagcugacauggaacgaucucauucggcugugcaucauggugggcgccaaugcaagcgaccguauggggaugggaaccacauaccuugcuuugauggccacuuuuaagaugagaccuauguucgcagucggccuguuauuuaggcgccucaccucacgggaggugcugcuucugacgauuggucuaagucucguugccuccguggaacugccaaacucuuuggaggaacugggggauggauuagcuaugggcauaaugauccucaaacugcuuacagacuuccagagccaucaacugugggcgaccuugcucuccuuuacuuucauuaagaccacauuuucacugcacuaugccuggaagacuauggcaaugguccuaagcaucguaagucuguucccccuuugucucucuaccacgucccagaaaacaaccuggcugccgguguugcugggcagcuuagggugcaagccucucacuauguuccugauugcugagaauaaaguuuggggaagaaagucguggccacuuaacgaagguaucauggccgugggcauagucucaauccuguugucuagucuccugaaaaacgaugugccccuagccgggccucugauugcuggaggcaugcuuaucgcauguuacguaauuuccgguagcucugccgaccucagccuggagaaggcggcugagguguccugggaagaggaagccgagcauucaggggcaagucacaauaucuuggucgaaguucaggaugacggaacaaugaaaauaaaggaugaggagagggacgauaccuuaacuauucugcucaaggccacacugcuugcugugagcggcguguauccccugucuaucccagcaaccuuguuugucugguacuucuggcagaaaaagaaacaacgauccggcgugcuaugggacacgccuucacccccagaaguugagcgcgccguacuggaugacgggaucuaucggauuaugcagagaggacuccuggguaggagucaggugggcgucgggguguuucaggaaaacguuuuccauacuauguggcacgugacccguggagcgguccuuauguaccaaggcaagcgcuuagagccgagcugggcuuccgugaaaaaggaccugauaucuuacggugggggauggcggcuccagggcucguggaauacaggcgaggaaguacaggucaucgccguggagccugggaagaaccccaaaaauguucagaccgcaccaggaacauuuaagacuagcgaaggugaggugggcgccauugcuuuggauuucaaacccgggaccucaggauccccuaucgucaacagagaaggcaagauugugggucuguaugggaauggaguugugacgacaaguggcacuuacgucucugccaucgcacaagcuaaagccagccaggagggcccacuccccgagauagaagacgagguguuuaggaagcgaaaccugaccaucauggaucuucacccuggguccggaaagacacggcgcuaucugccggcgauuguaagagaagccaucaaaaggaaguugcggacccuaauucuggcaccaacucgagugguugcuucagagauggccgaagcucucaaagguaugcccaucagauaccagaccacagcagucaagucugagcauacgggcaaagagauaguggacuuaaugugccacgccacuuucaccaugcgccugcuuagcccugugagggucccaaauuauaacaugauuaucauggaugaagcccauuuuacagaccccaguuccaucgcugcgcguggguacauuagcacccggguaggaaugggcgaggcagccgcuaucuucaugacugccacaccuccggguucuauggaagcauuuccccaaucaaaugccgugauacaggaugaggaaagagacauuccagagagguccuggaacaguggguaugaguggaucaccgauuucccuggaaagacgguuugguucgugcccagcauuaagucgggcaaugacaucgcuaacugucugcgcaaaaauggcaagcgagucauacagcucucuagaaaaacuuuugauacagaauaccagaagaccaaaaacaacgacugggacuacgugguuaccacugauauuuccgagaugggggcgaauuuccgggccgacagggugaucgauccacgccguugcuugaagccugucauccugaaggacggacccgaaagagugauucucgcagguccaaugccgguaacaguggcuagcgccgcacaacggaggggccgcaucgggcgaaaccacaauaaagagggagaucaguauauuuacaugggccagccucugaacaaugacgaggaucaugcccacuggaccgaagcuaagaugcuucuagacaacauaaauacacccgaggguaucauuccagcccuguuugaacccgagagagaaaaaucagcggcaaucgauggggaguaucgguugaggggcgaggcccgcaagacuuucguugaauuaaugagaaggggagaccugccugucuggcucaguuacaaaguggcuucugagggcuuucaguauuccgaucggcguuggugcuucgacggggaacgcaacaaucaagugcuggaggaaaacauggaugucgagaucuggacgaaggagggagaacgaaagaaacuuagaccaagguggcuggacgcccggaccuacagcgacccccucgcuuugcgcgaguuuaaagaguucgcagccgguagaaggucaguuaguggcgaucugauucuagagauagggaaacugccucagcaccucacacagcgggcucagaaugcccuugacaaccuggugauguuacauaauagcgaacaaggaggccgagcauauagacacgcgauggaggaguugccggauacuaucgaaacccugaugcuccuggcccuuauugcuguacugacagguggggugacccucuuuuucuuguccggccgcggacugggcaagacuucuaucggguuacuaugugucauggccagcuccgugcugcucuggauggcaucaguugagccacauuggauugcugccucuaucauacuugaauuuuuccugaugguguugcugauccccgagccugacaggcagcggacgccccaggauaaccagcucgcauacgucguaauuggacugcuuuuuaugauccucaccguggccgcuaaugagaugggucuguuggaaacaacuaaaaaggaccugggcauugggcacgcggccguugagaaccaccaucacgcagcuauguuagauguggaccuacauccagccagugccuggacccuguacgcagucgcuacaaccaucauaacuccuaugaugcgucacacaauugaaaacacgaccgccaauaucucgcucacugcgauugcuaaccaagccgcaauccuuaugggacuggauaaaggcuggcccauaagcaagauggacaucggugugccauugcuggcccucgggugcuauucccaggucaauccucugacacuuaccgcugcaguguuaaugcugguugcccauuacgcgauuaucggcccgggacuccaggcuaaggccaccagagaggcacagaagaggacagccgcuggcauuaugaagaaccccacuguggaugggaucguagccauagacuuggauccaguggucuaugacgcaaaauucgaaaagcagcugggacagauuaugcuacugauccucuguacgucucagauccuucugaugcgcaccacaugggcuuugugcgagucaauuacucuggccaccggcccucucacaacccugugggaggguagccccgggaaauucuggaauacuacgaucgcgguuuccauggccaacauauuucggggaaguuacuuagcaggcgcuggucuugccuucucucugaugaaaagccucggcgggggacgaagaggcacaggggcacaaggagaaacccuaggcgagaaguggaaaaggcagcugaaucaguugucaaaguccgaauuuaacacuuauaaacgcagugguauuauggagguggaccggagcgaagcuaaggaggggcugaaaagaggagagaccacaaagcacgccgucucucguggcacugccaagcucaggugguucguggaacggaaucuuguaaaaccagaggguaaggugaucgaucugggcugugggcgcggaggcugguccuacuauugcgcgggguugaaaaagguuaccgaagugaaaggauacacaaagggcgguccugggcacgaggaacccauuccgauggcuacguacggauggaaccuggucaaacuccauucaggcaaggacguguuuuucaucccaccugagaagugugauaccuuacugugcgacauaggcgagagcucgcccaauccaacuaucgaagaggggcgaacacuuagaguccugaaaaugguggaacccuggcuaaggggaaaccaguuuuguauuaagauccucaauccuuauaugccgucuguuguagagacccuggagcaaaugcagcggaaacacgguggcauguuggugcgcaacccccugaguagaaauuccacucaugaaauguacugggucagcugcgggacaggaaacauugugucagcaguuaauaugaccuccaggaugcuccuuaaccgauucacgauggcccaccggaagccaaccuaugagcgugauguggaccugggcgcugguacaagacacgucgccguggaaccugagguagcaaacuuagauaucauugggcagcgcaucgaaaauauaaaacaugagcacaagucuacuuggcauuacgacgaggauaaccccuauaagaccugggccuaccacggaagcuaugaagugaaaccuaguggcuccgcuagcucuaugguuaauggcgucgugaagcuguugacaaaaccaugggacgugauucccauggucacucagaucgcgaugaccgauacaaccccuuuugggcaacagaggguuuucaaggagaaaguggacacucggacgccaaaggccaagagaggaacagcacagaucauggaaguaaccgcuaaauggcucugggguuuucugucacgcaacaagaaacccaggauuuguacucgagaggaguucacccggaaggugagaaguaaugccgcaauaggcgccgucuuuguggacgagaaccaauggaacuccgcuaaagaggccguugaagaugagagguucugggaccuagugcaucgcgaacgugagcuucacaagcaggggaagugcgcgacaugcgucuacaacaugaugggaaaacgggaaaagaaacugggcgaguucgguaaggcaaaagggagcagagccaucugguacauguggcucggagcuagguuucuggaguucgaagccuugggcuuuaugaaugaggaucacugguucucucgcgaaaacucgcugucaggcguggagggggagggacuccauaaacuugguuauauucugcgagacaucagcaaaauuccgggcgggaauauguacgcagaugacacggcuggaugggauacccggaucacugaagacgauuuacagaacgaggccaagauaacagacaucauggaaccugagcacgcucuguuggccaaguccauuuuuaaacucaccuaucagaauaagguaguuagagugcaaaggccagccaagaauggcacugucauggaugugaucagucgcagagaccagcgggguucuggacaggugggaacauacggccugaauaccuucacaaacauggaagcgcagcuaauuaggcaaauggagagcgagggcaucuuuucccccucagaacuugagacuccuaaccuggccgggcguguccucgauuggcuggaaaagcauggaguugagcgauugaaacgcauggcuauaaguggugacgacugugugguaaagccaauugaugacagauucgccaccgcauuaacggcucugaaugauaugggcaaggugcggaaagacaucccccagugggaaccgucuaagggguggaacgauuggcagcaggucccuuuuugcagccaccacuuccaucaacucaucaugaaagacggaagggagauugugguucccugucgcaaucaggaugagcuugugggcagagcccgggucucccagggugcaggguggucacugagggaaaccgccugccuaggaaagagcuaugcgcagauguggcaacugauguacuuucaccgacgugaccucagauuggcugccaacgcaauauguucugccgugccaguagauuggguuccuacaucccgcacuaccuggaguauccaugcucaccaucaguggaugacaacugaggacaugcugagcguguggaaucgggucuggauugaagagaaccccuggauggaagauaaaacccacaucucguccuggggcgacgugccauaucuuggcaagagggaggaccaguggugcgggucucugauuggacucacggccagagcaacaugggcuaccaauauccaaguugccauaaaccaggugcgccgguuaaucgguaaugagaacuaccuggauuacaugacuucaaugaagagguucaaaaaugaaagcgaccccgagggcgcguugugguga

SEQ ID NO: 13917 - RNA, 9879 nt, Artificial Sequence
  derived and/or modified CDS sequence (opt3) from DENV-1__GU131741__SS-prME
agcgugacaaugcugcuaaugcuuaugcccacagcccuggcuuuccacuugacuacgcgaggcggggaaccucauaugaucgucuccaagcaggaaaggggaaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcguaagcaccagucaagagacuuggaaucggaaagaccuucugguuacauuuaagaccgcacacgcuaagaaacaggaaguggucguguuggguucucaggagggggccaugcacacagcucucacuggcgccaccgaaauccaaacguccggaaccacaacuauuuucgcaggccaucugaagugccguuuaaaaauggauaagcugacccuaaaagggaugagcuaugucauguguacaggaucguucaagcucgagaaggaaguggccgagacucagcacgguaccguucuggugcagauaaaauacgagggcacggacgcuccuugcaagaucccauuuucuacacaggaugaaaaagggguaacccaaaacggacgccuuauuacugcgaaucccaucgucacagacaaggagaaaccugugaacauagaagcagagccacccuucggcgaguccuauauuguuaucggugccggggaaaaggcuuugaagcugucaugguuuaaaaagggcaguagcaucggaaaaauguucgaggccaccgcaagaggcgccaggcggauggcuauucucggggauacugccugggacuuuggauccaucgguggcguguucaccucugucgggaagcuggugcaucagauuuuuggaacagcauacggcguacuuuucagcggugugucauggacgaugaaaauagggaucggcguucuguugaccuggcucggacugaauagucgauccacuagcuuaucuaugacauguauugcggucggccuggugacccuauaccucggggugaugguccaggcugauucaggaugcguuaucaacuggaagggccgcgaacugaagugugguagugggaucuuugugacaaaugaggugcacacuuggaccgaacaguauaaauuccaagccgacagcccgaagagacuuuccgcagccauuggaaaggcuugggaggagggcguaugcgguauaaggucugccacgcgguuggaaaacaucauguggaagcagauuucgaacgagcugaaucauauccuccuggaaaacgacaugaaauuuacagucgugguuggcgauguggcagggauuuuagcucagggaaagaaaaugauccgcccucagcccauggaguacaaguauagcuggaaguccuggggcaaagccaagauaaucggggcggacguccaaaauaccacuuucauuaucgauggaccaaacaccccugaaugucccgacgaucagagagccuggaauauuugggagguggaggacuacggcuuugguaucuucacaacuaacauauggcugaaacuuagggauucauauacccagguuugcgaccaccguuugaugagugcugcaauuaaggauucuaaagccgugcacgcugacaugggguacuggaucgaaagcgagaagaaugaaacauggaagcucgcccgggcauccuucauugagguaaaaacguguaucuggccaaagucacauacccuguggagcaacggaguccuagaaucugagaugauaauccccaaaauuuauggcgguccuaucucccagcacaauuaccgaccaggcuacuuuacucaaacagcggggccguggcaucugggaaagcucgagcuggauuucgaccuuugcgaaggcaccacugugguggucgaugagcacugcgggaacagaggacccaguuugaggacaaccacgguuacuggcaaaauuauccacgaaugguguugccgcagcuguacccugccuccauuacgguuuaagggugaggacgggugcugguauggaauggagauaagacccgugaaggaaaaagaggaaaaucucguaaagucuaugguguccgccggcucaggugaggucgacaguuucagccugggccuucuguguauuucgaucaugaucgaagaggugaugaggucccgcuggucucgaaaaauguugaugacagggacccucgcuguauuuuuccugcuaauuaugggacagcugacuuggaacgaucucauccggcugugcauuauggugggcgccaaugcaagcgaccguauggggaugggaacaaccuaccuugcuuugauggccacauuuaagaugagaccuauguucgcagucggccuguuauuuaggcgccucacuucacgggaggugcugcuucugaccauaggucuaagucucguugccuccguggaacugccaaacucuuuggaggaacugggggauggauuagcuaugggcaucaugauucucaaacugcuuacggacuuccagagccaucaacugugggcgacauugcucucccugaccuuuaucaagacuaccuucucacuacacuaugccuggaagacaauggcaaugguccugagcauuguaagucuuuuuccccucugucugucuacuaccucccagaaaacgacaugguugccggugcuguuaggcagccucgggugcaagccucugaccauguuccuuaucgcugagaauaaaauauggggaagaaagucguggccacugaacgaagguaucauggccguuggcauugugucaaucuugcucucuagucugcucaagaaugaugucccccuggccgggccucuuauugcuggaggcaugcucaucgcauguuacgugauauccgguagcucugccgaccugagcuuggagaaggcggcugagguauccugggaagaggaagccgagcauucaggggcaagucacaauauuuuaguggaaguccaggaugacggaacuaugaaaaucaaggaugaggagagggacgauacacugaccauccuccugaaggccacucuucuggcuguuagcggcguguaucccuugucuauuccagcaacacuauucgugugguacuuuuggcagaaaaagaaacaacgauccggcguccugugggacaccccuucacccccagaaguggagcgcgccguucucgaugacgggauauaucggaucaugcagagaggacugcuugguaggagucagguaggcgugggggucuuccaggaaaacguguuucauacgauguggcacguuacucguggagcgguguuaauguaccaaggcaagcgccuggagccgagcugggcuuccgucaaaaaggaccucauuucuuacggugggggauggcgguugcagggcucguggaauaccggcgaggaagugcagguaaucgccgucgagccugggaagaaccccaaaaaugugcagacagcaccaggaaccuucaagacaagcgaaggugagguuggcgccauugcucuggauuuuaaacccgggacuucaggauccccuaucgugaacagagaaggcaagauagucggucucuaugggaauggagugguuaccacgaguggcacauacgugucugccaucgcacaagcuaaagccagccaggagggcccacugcccgagauugaagacgaggucuucaggaagcgaaaccuuacuaucauggaucugcacccuggguccggaaagacccggcgcuauuugccggcgauugugagagaagccaucaaaaggaagcuacggacacugauacucgcaccaacccgaguaguggcuucagagauggccgaggcuuuaaaagguaugcccauuagauaccagacuaccgcaguuaagucugagcauacaggcaaagagaucgucgaccugaugugccacgccacguuuacuaugcgccuucugagcccugugagggugccaaauuauaacaugaucauuauggaugaagcccauuucaccgaccccaguuccaucgcugcgcguggguacauaagcacacgggucggaaugggcgaggcagccgcuauuuuuaugaccgccacuccuccggguucuguagaagcauucccccaaucaaaugccgugauccaggaugaggaaagagacauuccagagagguccuggaacaguggguaugaguggaucacagauuuuccuggaaagaccguuugguucgugcccagcauaaagucgggcaaugacauugcuaacugucuccgcaaaaauggcaagcgagucauccaguugucuagaaaaacguucgauacugaauaccagaagaccaagaacaacgacugggacuacgugguuaccaccgauaucuccgagaugggggcgaauuuucgggccgacagggugauugauccacgccguugccugaagccugucauccucaaggacggacccgaaagagugauucuggcagguccaaugccgguaacuguggcuagcgccgcacaacggaggggccgcauagggcgaaaccacaauaaagagggagaucaguauaucuacaugggccagccucuuaacaaugacgaggaucaugcccacuggacagaagcuaagaugcuacuggacaacauuaauacccccgaggguaucaucccagccuuguucgaacccgagagagaaaaaucagcggcaauugauggggaguaucgguuaaggggcgaggcccgcaagacauuuguugaacugaugagaaggggagaccucccugucuggcugaguuacaaaguggcuucugagggcuuccaguauuccgaucggcguuggugcuuugacggggaacgcaacaaucaagugcuugaggaaaacauggaugucgagauauggacuaaggagggagaaagaaagaaacugagaccaagguggcucgacgcccggacguacagcgaccccuuggcucugcgcgaguucaaagaauuugcagccgguagaaggucaguuaguggcgaucuaauccuggagauugggaaacucccucagcaccuuacccagcgggcucagaaugcccuggacaacuuagugauguugcauaauagcgaacaaggaggccgagcauauagacacgcgauggaggagcugccggauacaaucgaaacucucaugcugcuugcccugauugcuguacucaccgguggggugacauuguucuuucuguccggccgcggauuaggcaagaccucuaucgggcuacugugugucauggccagcuccgugcuccuuuggauggcaucaguugagccacauuggauagcugccucuaucauucuggaguucuuuuugauggugcugcucauccccgagccugacaggcagcggacuccccaggauaaccagcuggcauacgucguaauuggacuucucuucaugauccugacgguggccgcuaaugagauggguuugcuggaaaccaccaaaaaggacuuaggcauagggcacguugcgguggagaaccaccaucacgccgcaaugcuagaugucgaccugcauccagcuagugccuggacucucuacgccguggcaaccacaauuaucaccccuaugaugcgucacacuauugaaaacacaacggcuaauaucucgcuuaccgccauagcgaaccaagcugccauccugaugggauuggauaaaggcuggcccauuagcaagauggacaucggugucccacugcucgcacuggggugcuauucccaggugaauccucuuacuuuaacagccgcuguucugaugcucguggcacauuacgccauuaucggcccgggauugcaggcgaaggcuaccagagaggcccagaaaaggaccgcagccggcauaaugaagaaccccacaguagaugggauuguggcuaucgaccuggauccagucguuuaugacgccaaauuugaaaagcagcuaggacagaucaugcugcucauucuuuguacuucucagauccuguugaugcgcacgaccugggcacugugcgagucaauaacacucgcuacuggcccucugaccacauuaugggaggguagccccgggaaauucuggaauaccacuauugccguguccauggcgaacaucuuccggggaaguuaccuugccggcgcaggucuggcuuuuucucucaugaaaagccuaggcgggggacgaagaggcacgggggcccaaggagaaacacugggcgagaaguggaaaaggcaguugaaucagcugucaaaguccgaguucaacaccuauaaacgcagugguauuauggaggucgaccggagcgaagcaaaggaggggcucaaaagaggagagacuaccaagcacgcugugucucguggcacagccaaacuuaggugguuuguagaacggaaucuggugaaaccagaggguaagguuaucgauuugggcugugggcgcggaggcugguccuacuauugcgccgggcugaaaaaggugacugaagucaaaggauacaccaagggcgguccugggcacgaggaacccauaccgauggcgacauacggauggaaccucgugaaauuacauucaggcaaggacgucuucuuuaucccaccugagaagugugauacgcugcuuugcgacauuggcgagagcucgcccaauccaaccaucgaagaggggcgaacucugagagugcuaaaaaugguugaacccuggcucaggggaaaccaguucuguauuaagauccugaauccuuauaugccgucuguaguggagacauuggagcaaaugcagcggaaacacgguggcaugcugguccgcaacccccucaguagaaauuccacccaugaaauguacugggugagcugcgggacuggaaacauuguuucagcugugaauaugacauccaggaugcuucugaaccgauuuaccauggcacaccggaagccaacguaugagcgugaugucgacuuaggcgccgguaccagacacguggcuguagaaccugagguggccaaccuggauaucauagggcagcgcauugaaaauaucaaacaugagcacaagucuacauggcauuacgacgaggauaaccccuauaagacuugggcauaccacggaagcuaugaaguuaaaccuaguggcuccgccagcucuauggucaauggcguggugaaguugcucaccaaaccaugggacgucauccccaugguuacacagauugcuaugacugauaccacaccuuucgggcaacagaggguguuuaaggagaaaguagacacccggacuccaaaggcgaagagaggaacggcccagauaauggaagugacagcaaaauggcugugggguuuccuaucacgcaacaagaaacccaggaucuguacccgagaggaauuuacucggaaggucagaaguaaugcugccauuggcgcaguguucguugacgagaaccaauggaacuccgccaaagaggcuguggaagaugagagguuuugggaccuuguccaucgcgaacgugagcugcacaagcaggggaagugcgcaacaugcguguacaacaugaugggaaaacgggaaaagaaacucggcgaguucgguaaggcgaaagggagcagagcaaucugguacauguggcugggagccagguucuuggaguuugaagcucugggcuucaugaaugaggaucacugguuuucucgcgaaaacucgcucucaggcguagagggggagggacuucauaagcuggguuauauuuuacgagacaucagcaaaauaccgggcgggaauauguacgccgaugacacagcaggaugggauacgcggaucaccgaagacgaucugcagaacgaggcuaagauuacugacaucauggaaccugagcacgccuugcucgcuaaguccauuuucaaacugacauaucagaauaagguugugagaguccaaaggccagccaaaaacggcaccgugauggaugugaucagucgcagagaccagcgggguucugggcaggucggaacuuacggccuaaauacauuuaccaacauggaagcacagcuuauaaggcaaauggagagcgagggcauuuucucccccucagaacuggagacaccuaaccucgcggggcguguucuggauugguuggaaaagcauggaguggagcgauuaaaacgcauggccaucaguggugacgacuguguagugaagccaaucgaugacagauuugcuacugcccugaccgcacucaaugauaugggcaagguccggaaagacauuccccagugggaaccgucuaagggguggaacgauuggcaacaggugccuuucugcagccaccacuuucaucaacuuauaaugaaagacggaagggagaucguugugcccugucgcaaucaggaugagcuggucggcagagcucgggugucccagggugccggguggucacuaagggaaacggcaugccugggaaagagcuaugcccagauguggcaacucauguacuuccaccgacgugacuugagacuggcggcuaacgccauuuguucugcaguaccaguugauugggugccuaccucccgcacaacuuggaguauccaugcccaccaucaguggaugaccacagaggacaugcuuagcgucuggaaucggguguggauugaagagaaccccuggauggaagauaaaacucacaucucguccuggggcgacguuccauaucugggcaagagggaggaccaguggugcgggucucucauaggauuaaccgcuagagccacgugggcaacaaauauccaaguggcuauuaaccagguccgccggcugaucgguaaugagaacuacuuggauuacaugaccucaaugaagagguuuaaaaaugaaagcgaccccgagggcgcccugugguga

SEQ ID NO: 13918 - RNA, 9879 nt, Artificial Sequence
  derived and/or modified CDS sequence (opt3) from DENV-1__GU131743__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccguguugacaggugggguaacccuguuuuucuuaaguggccguggacuaggcaaaacuagcaucgggcugcucugugugauggcauccucuguccuucuguggauggcuagcguggagccccauuggauagccgcauccaucauuuuggaauuuuuccugaugguucuccugaucccugagcccgacagacagaggacgccacaggauaaccaacuugccuacguggucauuggacuccuguuuaugaucuugaccguagcugcgaaugagaugggucuguuagaaacaacuaagaaggaccuaggcauagggcacguggccguugagaaccaccaucacgcagcuaugcuggauguggaccuccauccugccucagccuggacccuuuacgcagucgcuacaaccauuaucacucccaugaugcgccacacaauugaaaacacgaccgccaauaucucucugacugcgauagcuaaccaggccgcaaucuugaugggacuggauaaaggcuggccaauuaguaagauggacaucggugugccucuccuggcccuugggugcuauucgcaggucaauccguuaacacugaccgcugcagugcucauguugguugcccauuacgcgauuaucggccccggacugcaagcuaaagccacccgggaggcacagaagcgaacagccgcuggcauaaugaaaaacccaacuguggaugggauuguagccaucgaccuagauccuguggucuaugacgcaaaguucgaaaagcagcugggacagaucaugcuccuuauucuguguacgagccaaaucuugcugaugagaaccacaugggcucucugcgaguccauaacucuggccaccggccccuuaacaacccuuugggaggguucuccagggaaauuuuggaauacuacgauugcgguuucaauggccaacaucuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguauuauggagguggacagguccgaagcuaaggaggggcuuaaacggggagagaccacaaagcacgccgucagucgcggcacugccaaacugcgaugguucguggaaagaaauuugguaaagccugaggguaaagugaucgaucugggcugugggaggggaggcuggagcuacuauugcgcggggcucaagaagguuaccgaagugaaaggauacacaaagggcggucccgggcacgaggaaccgauaccaauggcuacguacggauggaacuuagucaaacugcauucuggcaaggacguguuuuucaucccucccgagaaaugugauacccuucugugcgacauuggcgaguccucaccaaaucccacuaucgaagaggggcggacacuacgcguccucaagaugguggaaccuuggcugagaggaaaccaauuuuguauuaaaaucuugaauccguauaugcccagcguuguagagacccuggagcagaugcagaggaagcacgguggcaugcucgugcgaaacccacuuucgagaaauucuacucaugaaauguacugggucaguugcgggacaggaaacauuguguccgcaguuaauaugaccagccguaugcuguuaaacagauucacgauggcccaccgcaagccuaccuaugagagggauguggaccugggcgcugguacacggcacgucgccguggaacccgagguagcaaacuuggaugugaucgggcagagaauagaaaauauuaaacaugagcacaagucaacuuggcauuacgacgaggauaacccuuauaaaaccugggccuaccacggauccuaugaaguuaagccaucuggcagcgcuaguuccauggucaauggcguggugaaacuccugacaaagcccugggacgucaucccuaugguuacucaaaucgcgaugaccgauacaaccccauuugggcagcagcgcguguucaaggagaaaguagacacuaggacgcccaaggccaaacgaggaacagcacaaauuauggaagugaccgcuaaguggcuaugggguuuucuuagccggaacaaaaagccgagaauauguacuagggaggaguucacccgcaagguccguucuaaugccgcaaucggcgccguguuuguugacgagaaccaguggaacucagcuaaagaggccguggaagaugagcgguucugggaccugguccauagagaaagggagcuccacaagcaggggaaaugcgcgacaugcguguacaacaugaugggaaagcgcgagaagaagcugggcgaguuugguaaggcaaaagggagucgagccauuugguacaugugguugggagcucgguuccuggaguucgaagcccucggcuuuaugaaugaggaucacugguucuccagagaaaacagccuuucuggcguagagggggagggacugcauaaguuagguuauauccugagggacauuucgaaaaucccuggcgggaauauguacgcagaugacacggcuggaugggauacccgcauaacugaagacgauuugcagaacgaggccagaaucacagacauuauggaaccagagcacgcucuccuggccaagucaaucuuuaaacuaaccuaucaaaauaagguugugcggguccagaggcccgccaaaaauggcacugugauggaugugauuagccgucgagaccagcgcgguuccgggcaggucggaacauacggccuuaauaccuucacaaacauggaagcgcaacugaucagacagauggagagugagggcauauuuucuccuagcgaacucgagacuccaaaccuggccgaacggguuuuggauugguuagggaaguauggaguggagaggcugaagcgcauggcuauuuccggugacgacuguguagugaaacccaucgaugacagauucgccaccgcacucacggcucuuaaugauaugggcaagguccggaaagacaucccgcagugggaaccuucaaagggguggaacgauuggcagcaagugcccuuuugcagucaucacuuccaccagcugauuaugaaagacggaagggagauaguugugccaugucgaaaucaggaugagcuagucggccgugccagagugucucagggugcaggguggagccugcgcgaaaccgccugccucggaaaguccuacgcgcaaauguggcaguugauguauuuucaucggagggaccugagacuugcugccaacgcaaucuguucagccguaccuguugauuggauucccacaagccgcacuaccuggucuauccacgcucaucaccaguggaugacaacugaggacaugcuguccguguggaaucgggucuggauugaagagaacccauggauggaagauaagacccauaucaguagcuggggcgacgugcccuaccucggcaaaagggaggaccaauggugcgggucguuaauaggacugacggcccgagcaacaugggcuaccaauauccagguugccauuaaccaggugagacgguugaucgguaaugagaacuaccuggauuauaugacuuccaugaagagguucaaaaaugaaucugacccugagggcgcgcucugguga

SEQ ID NO: 13919 - RNA, 9879 nt, Artificial Sequence
  derived and/or modified CDS sequence (opt3) from DENV-1__JN093516__SS-prME
agcgugaccaugcugcucaugcuuaugcccacugcccuggcuuuccacuugacuacgagaggaggggaaccucauaugaucgucuccaagcaggaaagggggaaaucuuuacuguuuaagaccucagccgguguuaauaugugcacucuaauugccauggaccucggcgaguucugugaagauacuaugaccuacaaaugcccacggauaaccgaagcggaaccggacgauguggacuguuggugcaaugcuaccgauacuuggguaaccuaugggaccuguagucagacgggagaacaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacgucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauaguagguguccaacucaaggagaggccacccuugucgaagaacaggacgcaaacuuuguuugccggcgcacauucguggaucgaggcugggguaauggguguggacuguuuggcaagggcuccuugauaacuugcgcuaaguucaaaugcguaaccaagcucgaggggaaaacagugcagcacgaaaaccugaaguacucagucauugugaccguucauacuggagaccagcaccaaguggguaaugagaguacggaacauggcacaaccgccacuaucacaccccaggcgccuagcacagagauucaguuaaccgacuauggggcccugacucucgauuguucuccaagaacaggacuugacuuuaacgaaaugguccuguugacgaugaaagagaaguccuggcuagugcacaaacagugguuccuggaucucccgcugcccuggaccucaggcgcaagcacaagccaagagacauggaauaggaaggaccuucugguaaccuuuaagacagcucacgccaaaaagcaggaaguuguggucuuggguucucaggagggggcuaugcauacugcccucaccggcgcaacggaaauccaaaccuccggaacaacuaccaucuucgccggccaccugaaaugccgguuaaagauggauaaacugacacuaaaggggaugagcuacgugauguguacuggaucguucaagcucgagaaagaagucgcugagacccagcaugguacggugcugguucagauuaaguaugagggcacagacgcgccuugcaaaauaccauuuucuacccaggaugaaaagggggugacucaaaacggacgucuuaucacagcaaaucccauuguaaccgacaaagagaagccugucaacaucgaagccgagccacccuucggcgaguccuacauagugauuggugcuggggaaaaggccuugaaacugucaugguuuaagaaaggcaguagcaucggaaagauguucgaggcaacuacccgcggcgccagaaggauggcuauccucggggauacagccugggacuuuggauccauugguggcguuuucacgucuguggggaaacugguccaccagaucuuuggaaccgcauauggcgugcuuuucagcgguguaucauggacuaugaagauugggauaggcgugcuguugacauggcucggacugaauagucgguccaccagcuuaucuaugacauguaucgcgguuggccuggucacucuauaccucggggugauggugcaggcugauucaggaugcgucauuaacuggaagggccgagaacugaaaugugguagugggaucuuuguuaccaaugaggugcauacguggacagaacaguacaaguuccaagccgacagcccgaaacgccuuuccgcagccaucggaaaggcuugggaggagggcgugugcgguauuagaucugccaccagguuggaaaacauaauguggaaacagaucucgaacgagcugaaucacauucuccuggaaaacgacaugaaguuuacuguagucgugggcgauguugcagggaucuuagcucagggcaagaagaugauucggccucagcccauggaguauaaguacagcuggaaauccuggggcaaggccaaaaucauaggggcggacgugcaaaauaccacauucaucauugauggaccaaacacuccugaaugucccgacgaucagcgcgccuggaauaucugggaggucgaggacuauggcuuugguauuuucaccacaaacaucuggcugaaacuuagagauucauacacacaggugugcgaccacagguugaugagugcugcaauaaaagauucuaaggccguucaugcugacaugggguauuggauugaaagcgagaagaaugaaaccuggaaacucgcccgugcauccuucaucgaggugaagacuuguauuuggccaaaaucacacacacuguggagcaacggaguacuagaaucugagaugaucauacccaagaucuacggcgguccuauuucccagcauaauuaucggccaggcuacuuuacccaaacugcggggccguggcaccugggaaaacucgagcuggauuucgaccuuugcgaaggcacaaccgucgugguggaugagcacugcgggaaccgaggacccaguuugagaacgacuaccgucacaggcaagaucauucaugaaugguguugcaggagcuguacccugccuccauuacgcuuuaagggugaggacgggugcugguacggaauggagauccggcccguuaaagaaaaggaggaaaaucucgugaaaucuaugguauccgccggcucaggugagguggacaguuucagccugggccuucuguguauaucgauuaugaucgaagaggucaugagauccagguggucucgcaagauguugaugacugggacacucgcuguguuuuuccugcuaaucaugggacagcugaccuggaacgaucucauucgacugugcaucaugguuggcgccaaugcaagcgaccggauggggaugggaacaacuuaucuugcuuugauggccaccuuuaaaaugcguccuauguucgcagugggccuguuauuuagaaggcucacgucacgcgagguccugcuucugacaauuggucuaagucucguggccuccguugaacugccaaacucuuuggaggaacugggggauggauuagcuaugggcauaaugauccucaagcugcuuaccgacuuccagagccaccaacugugggcgacuuugcucucccugaccuuuauuaagacaacuuucucacuacauuacgccuggaaaaccauggcaauggugcugagcaucgucagucuuuuuccccucugucugucuacgacaucccagaagaccacuugguugccgguacuguuaggcagccucgggugcaaaccucugacaauguuccuuauugcugagaauaagaucuggggacggaaaucguggccacugaacgaagguauaauggccgugggcaucguuucaauuuugcucucuagucugcuaaagaacgaugugccccuggccgggccucuuaucgcuggaggcaugcucauugcauguuaugucaucuccgguagcucugccgaccugagcuuggagaaagcggcugagguguccugggaagaggaagccgagcacucaggggcaagucauaauauauuaguagaagugcaggaugacggaaccaugaagauuaaggaugaggagagagacgauacucugacaauccuccugaaagccacccuucuggcugucagcggcguuuaccccuugucuaucccagcaacgcuauucgugugguauuuuuggcagaagaaaaagcaaagguccggcgugcugugggacacuccuucacccccagaagucgagcgagccgugcucgaugacgggauuuaccgcauaaugcagcggggacugcuugguagaagucagguuggcguagggguguuccaggaaaacgucuuucacaccauguggcacgugacaaggggagcgguuuuaauguaucaaggcaaacgucuggagccgagcugggcuuccgugaagaaggaccucaucucuuacggugggggauggcgcuugcagggcucguggaauaccggcgaggaaguccaggugauugccguagagccugggaaaaaccccaagaauguccagacagcaccaggaacuuucaaaaccagcgaaggugaggugggcgccaucgcucuggauuuuaagcccgggacgucaggauccccuauuguuaaccgggaaggcaaaaucgugggucucuacgggaauggagucgugacaacaaguggcaccuauguuucugccauagcacaagcuaaggccagccaggagggcccacugcccgagaucgaagacgagguguucagaaagaggaaccuuacaauuauggaucugcauccuggguccggaaaaacccgacgguacuugccggcgaucguccgcgaagccauuaagagaaaacuaaggacucugauccucgcaccaacccgggugguagcuucagagauggccgaggcuuuaaaggguaugcccauacgauaucagacaacggcagugaaaucugagcacacuggcaaggagauuguugaccugaugugccaugccaccuuuacaaugagacuucugagcccuguccgcgugccaaauuacaacaugaucaucauggaugaagcccacuucaccgaccccaguuccauugcugcgaggggguauaucagcacucgugugggaaugggcgaggcagccgcuauauuuaugacagccaccccuccggguucugucgaagcauucccccaaucaaaugccguaauucaggaugaggaacgggacaucccagagagauccuggaacaguggguacgaguggauuacggauuuuccuggaaagacugugugguucguucccagcaucaaaucgggcaaugacauagcuaacugucucaggaagaauggcaaacgcgugauucaguugucucgaaagacauucgauaccgaauaucagaaaaccaagaacaacgacugggacuacgucgugacuacagauaucuccgagaugggggcgaauuuuagagccgaccggguuaucgauccaaggcgcugccugaagccugugauucucaaagacggacccgaacgugucauccuggcagguccaaugccggugaccguagcuagcgccgcacaaagacggggcaggauugggcgcaaccauaauaaggagggagaucaguacauauauaugggccagccucuuaacaaugacgaggaucacgcccacuggacagaagcuaaaaugcuacuggacaacaucaauacucccgaggguauuaucccagccuuguucgaacccgagcgagaaaagucagcggcaaucgauggggaguacagauuacggggcgaggccaggaaaacguuuguggaacugaugcgcagaggagaccucccuguuuggcugaguuauaaggucgcuucugagggcuuccaguacuccgauaggcgguggugcuuugacggggaacguaacaaucaagugcuugaggaaaacauggauguggagauuuggaccaaagagggagaacgcaagaagcugcgaccaagauggcucgacgccaggacauauagcgaccccuuggcucugcgggaguucaaagaauuugcagccggucgcagaucagucaguggcgaucuaauacuggagaucgggaagcucccucagcaucuuacucagagggcucagaaugcccuggacaacuuaguuauguugcacaauagcgaacaaggaggccgggcauaccgacaugcgauggaggagcugccggauaccauugaaacacucaugcugcuugcccugaucgcugugcucaccggugggguaacuuuguucuuucuguccggcagaggauuaggcaaaacgucuauugggcuacugugugugauggccagcuccgcacuccuuuggauggcuucagucgagccacacuggaucgccgcaucuauaauccuggaguucuuuuugauggugcugcucauucccgagccugaccgccagaggacaccccaggauaaccagcuggccuauguugugaucggacuucucuucaugauucugacagucgcugcgaaugagauggguuugcuggaaacuaccaagaaagacuuaggcaucgggcacguagccguggagaaccaucaccaugcaacaaugcuagauguugaccugcacccagcuagugccuggacccucuacgccguggcaacuacaauaauuacgccuaugaugcggcauaccaucgaaaacacuacagcuaauauuucgcuuaccgccaucgcgaaccaagcugccauacugaugggauuggauaagggcuggcccaucagcaagauggacauuggugucccacugcucgcacuggggugcuacucccaggugaauccucuuaccuuaacagccgcuguccugaugcucguggcacacuaugccaucauuggcccgggauugcaggcgaaagcuacucgugaggcccaaaagagaacggcagccggcaucaugaaaaaccccaccguugaugggauaguggcuauugaccuggauccaguaguguacgacgccaaguuugaaaaacagcuaggacagaucaugcugcucauccuuuguacaucucagauucuguugaugaggacuaccugggcacugugcgagucaaucacacucgcuaccggcccucugacuacguuaugggaggguagccccgggaaguucuggaauacaaccauagccgucuccauggcgaacauuuuccgcggaaguuaucuugccggcgcaggucuggcuuuuucucucaugaaaagccuaggcgggggacggcgaggcacuggggcccaaggagaaacccugggcgagaaauggaagagacaguugaaucagcugucaaaauccgaguucaacacauacaagaggagugguaucauggagguugaccgcagcgaagcaaaagaggggcucaagcggggagagacuaccaagcacgcugugucuagaggcacagccaaacuucguugguuugucgaaaggaaucuggugaagccagaggguaaaguaauugauuugggcugugggcggggaggcugguccuauuacugcgccgggcugaagaaagugacggaaguuaagggauauaccaaaggcgguccugggcaugaggaacccaucccgauggcgacuuacggauggaaccucgugaaguuacacucaggcaaggacgucuucuuuauaccaccugagaaaugugauacacugcuuugcgacaucggcgagagcucgcccaauccaaccauugaagaggggcgcacucugcgagugcuaaagauggucgaacccuggcucagaggaaaccaguucuguaucaaaauucugaauccuuacaugccgucugugguugagacauuggagcaaaugcagaggaagcaugguggcaugcugguacggaacccccucagucgcaauuccacccacgaaauguauugggugagcugcgggacgggaaacaucgucucagcugugaauaugaccuccagaaugcuucugaacagguuuacaauggcacaccgaaaaccaacuuacgagcgggauguugacuuaggcgccgguacccgucauguggcugucgaaccugagguggccaaccuggauauuaucgggcagagaauagaaaauauuaagcacgagcauaagucuacauggcacuaugacgaggauaaccccuacaaaacuugggcauaucauggaagcuacgaaguaaagccuaguggcuccgccagcucuauggugaauggcguugucaaauugcucaccaagccaugggacgugauccccauggugacacagaucgcuaugaccgauacuacgccuuucgggcaacagcgcgucuuuaaagagaagguugacacaaggaccccaaaggcgaaacggggaacugcccagauuauggaagugaccgcaaaguggcugugggguuuccuaucaagaaacaaaaagccccgcauauguacaagggaggaauuuacgcgaaaaguacggaguaaugcugccaucggcgcaguguucgucgacgagaaccaauggaacuccgccaaggaggcuguggaagaugagagauuuugggaccuuguucacagggaacgcgagcugcacaagcaggggaaaugcgcaaccugcguguauaacaugaugggaaagcgugagaagaagcucggcgaguucgguaaagcgaaggggagccgggcaauuugguacauguggcugggagccagauucuuggaguuugaagcucugggcuucaugaaugaggaucauugguuuucuagggaaaacucgcucucaggcgucgagggggagggacuucacaaacuggguuacaucuuacgcgacauuagcaagaucccgggcgggaauauguaugccgaugacacugcaggaugggauacacgaauaaccgaagacgaucugcagaacgaggcuaagaucacugacauuauggaaccugagcaugccuugcucgcuaaauccaucuucaagcugacauaccagaauaaagugguacggguucaaagaccagccaagaacggcaccgugauggaugucauuaguaggcgcgaccagagagguucuggacaggugggaacauauggccuaaauacuuuuaccaacauggaagcacagcuuauccggcaaauggagagcgagggcauauucucccccucagaacuggagacgccuaaccucgcggggagggugcuggauugguuggaaaaacacggagucgagcguuuaaagcgaauggccauuaguggugacgacuguguugugaagccaaucgaugaccgcuuugcuaccgcccugacagcacucaaugauaugggcaaaguaagaaaggacaucccccagugggaaccgucuaaaggguggaacgauuggcaacaggugccuuucugcagccaccauuuucaccaacuuauuaugaaggacggacgggagauagucgugcccuguaggaaucaggaugagcugguuggccgcgcuagagugucccagggugccggguggucacuacgggaaacugcaugccugggaaaaagcuacgcccagauguggcaacucauguauuuccauaggcgagacuugcgucuggcggcuaacgccaucuguucugcagucccaguggaguggguaccuaccuccagaacaacuuggaguauucacgcccaucaccaguggaugaccacggaagauaugcuuagcguuuggaaucgcguguggaucgaggaaaaccccuggauggaggacaagacacacauuucguccuggggcgaugucccauaccugggcaagcgggaggaccaguggugcgggucucucaucggauuaaccgcuagggccacuugggcaacaaauauacaaguggcuaucaaccagguuagacgccugauugguaaugaaaacuauuuggacuacaugaccucaaugaaacgguuuaagaaugagagcgaucccgaaggcgcccugugguga

SEQ ID NO: 13920 - RNA, 9879 nt, Artificial Sequence
  derived and/or modified CDS sequence (opt3) from DENV-1__GU131746__SS-prME
agcgugaccaugcugcucaugcuuaugcccacggcccuggcuuuccacuugacuacgagaggaggggaaccucauaugaucgucuccaagcaggaaaggggaaaaucuuuacuguuuaagaccucagccgguguuaauaugugcacauuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaaaaagaugauccgcccucaacccauggaguacaaauauucguggaaaagcuggggcaaggccaaaauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugauucucucaaucguuagccuguuccccuugugucugaguacgacaucucagaagaccacuugguuaccggugcuccugggcucccuugggugcaagccucugacaauguuuuugauagcugagaauaaaaucuggggaaggcgaagcuggccacucaacgaagguauuauggccgucggcaucguaucgauucugcuaucaucucugcuuaagaacgaugugccccucgccgggccucugaucgcuggaggcauguugauagcauguuacguuauuagugguuccagcgccgacuuaucucuggagaaagcggcugaggugagcugggaagaggaagccgagcauuccggggcaucacacaauauccucgucgaagugcaggaugacggaaccaugaagaucaaagaugaggagcgcgacgauacucugacaauucuucugaaggccaccuugcuagcuguaaguggcguguauccccugagcauaccagcaacacucuucgucugguacuucuggcagaaaaagaagcagcggucuggcguucugugggacacuccuucacccccagaaguggagagagccgugcuugaugacgggaucuauaggauuaugcagcguggauuacugggucgcagccaggucggcguggggguuuuucaagaaaacguauuccauaccauguggcacgugacacggggagcgguccucauguaccagggcaaaagauuggagccgaguugggcuagcgugaagaaagaccugaucuccuacggugggggauggaggcuccagggcucuuggaauaccggcgaggaaguucaggugauugccgucgagccugggaagaaccccaaaaaugugcaaacagcaccaggaacuuuuaagacccccgaaggugagguaggcgccaucgcucuggauuucaagccugggacgucgggaagcccaauagucaaccgagaaggcaaaaucgugggucuuuaugggaauggaguugugacaacuucaggcaccuacgucuccgccauugcacaggcuaaggccagucaggagggcccccugccugagaucgaagacgagguguuucggaaacgcaacuugacaauuauggaucuacacccggggucuggaaagaccagaagguaucugccagcgaucguucgggaagccauaaaacgaaagcucagaacuuuaauucuggcacccacccgcguggucgcuagcgagauggccgaagcucuuaaggguaugccuaucagguaccaaacaacggcagugaaauccgagcauacuggcaaggagaucguagaccugaugugccacgccaccuucacaaugcgucucuugucaccagugcggguucccaauuauaacaugauuaucauggaugaagcccauuuuaccgacccuucuagcauagcugcgagaggguacauuaguacuagggucggaaugggcgaggcagccgcuaucuucaugacagccaccccgcccgguuccguggaagcauuuccacagagcaaugccgugauucaggaugaggaacgcgacaucccugagcgaucuuggaacucaggguaugaguggauaacggauuuccccggaaaaacugucugguuuguaccauccauuaagaguggcaaugacaucgcuaacugucugaggaaaaauggcaagcgggugauccagcucagcaggaagacauucgauaccgaauaccagaaaaccaagaacaacgacugggacuacguugugacuacagauauuucggagaugggggcgaauuuccgcgccgaccgugucaucgauccuagacggugccugaaacccgugauucuuaaggacggaccagaaaggguuauacuagcagguccgaugccugugaccgucgcuucugccgcacagcgccgaggcagaaucgggcggaaccacaauaaagagggagaucaguauauuuacaugggccagccccugaacaaugacgaggaucaugcccacuggacagaagcuaagauguuguuagacaacaucaauacuccagaggguaucauucccgcccuguuugaaccugagagggaaaaguccgcggcaauagauggggaguaucgccucagaggcgaggccaggaaaacguucguggaacugaugcggcguggagaccuuccaguauggcugagcuacaagguggcuucagagggcuuucaauauagugaucgccgauggugcuucgacggggaaagaaacaaucagguucucgaggaaaacauggaugucgagaucuggaccaaagagggagaaaggaagaaauugcggccccgcuggcuggacgccagaacauacucugacccucuagcucugagggaguuuaaggaguucgcagccggucggcgauccgugagcggcgaucucauucuugagaucgggaaacugccgcagcacuuaacucagaaggcucaaaaugccuuggacaaccuggugaugcuccauaauucagaacagggaggcagagcauaucgccacgcgauggaggagcugccagauaccauugaaacacuuaugcugcucgccuugaucgcuguccugaccggugggguuacuuuauuuuuccuaaguggcaggggacugggcaagacgagcauagggcuccuuugugugauggccuccucuguacuguuguggauggcaagcguggagccccauuggaucgcugccuccauuauccuggaauuuuuccucaugguccugcuuauuccugagcccgaccggcagcguaccccacaggauaaccaacucgcauacgugguuaucggacuguuguuuaugauacugacaguggccgcuaaugagauggguuuacuagaaacuaccaaaaaggaccugggcauugggcacgucgcgguagagaaccaccaucacgccgcaaugcucgauguggaccuucauccugcuucagccuggacacuguacgccguugcaaccacuaucauuacacccaugaugagacacacgaucgaaaacaccacugcuaauauaucuuugacagccaucgcgaaccaggcugccauucugaugggacucgauaaaggcuggccaaucaguaagauggacauuggugugccucugcuugcauuagggugcuauucgcaggucaauccgcugacccucaccgccgcuguguugaugcuggucgcacauuacgccaucauaggccccggacuacaagcgaaagcuacaagggaggcccagaagcgcacugcagccggcauuaugaagaacccaacgguggaugggaucguugcuaucgaccuggauccugugguauaugacgccaaauucgaaaagcagcucggacagauuaugcuucugaucuuguguaccagccaaauacugcucaugcggacaacuugggcacugugcgaguccauuaccuuagcuacaggcccccuuaccacucugugggaggguucuccagggaaauuuuggaauacgacaaucgccgugucaauggcgaacauuuuccgaggaagcuaccucgccggcgcaggucuagcuuucucccugaugaagaguuugggcgggggaagaaggggcaccggggcccagggagaaacucugggcgagaaauggaagcgccagcucaaucagcuuucuaagagcgaauuuaacaccuauaaacggucagguaucauggaggucgacagauccgaagcaaaggaggggcugaaacguggagagacaacuaagcacgcuguuaguaggggcaccgccaaauugcggugguucguggaacgcaaucuggucaagccugaggguaaggugauagaucucggcugugggcgaggaggcuggagcuacuauugcgccgggcuaaagaagguaacagaagugaaaggauacacgaagggcggucccgggcacgaggaaccgaucccaauggcgaccuacggauggaaccugguuaaacuucauucuggcaaggacguguuuuucauuccucccgagaaaugugauacucugcuaugcgacaucggcgaguccucaccaaaucccacaauugaagaggggagaacccucaggguccugaagaugguggaaccuugguugcggggaaaccaauuuuguaucaagauucugaauccguauaugcccagcgucguggagacucucgagcagaugcagcgcaaacacgguggcaugcuuguuagaaacccacugucgagaaauucuacacaugaaauguacuggguaaguugcgggaccggaaacaucguguccgcugucaauaugacgagccgaauguuacugaaccgguucaccauggcacaccguaagccuacauaugagagagauguggacuugggcgccgguacucgccacguugcuguggaacccgaggucgccaaccucgauauaauugggcagaggaucgaaaauaucaaacaugagcacaagucaaccuggcauuacgacgaggauaacccuuauaaaacaugggcauaccacggauccuaugaagugaagccaucuggcagcgccaguuccaugguaaauggcgugguuaagcugcuaacuaaacccugggacgucauuccuauggugacccaaauagcuaugacagauaccacuccauuugggcagcagcggguguucaaggagaaagucgacacgagaacacccaaggcgaaacgcggaaccgcccaaaucauggaaguuacugcaaaguggcuuugggguuuucugagcaggaacaagaaaccgcgaauuuguacccgggaggaguucacaagaaaggugaggucuaaugcugccaucggcgcaguauuuguggacgagaaccaguggaacucagccaaagaggcugucgaagaugagcgcuucugggaccucgugcaucgugaacgggagcugcacaagcaggggaaaugcgccacgugcguuuacaacaugaugggaaagagagaaaagaaauugggcgaguuugguaaggcgaaagggaguagggcaauuugguacauguggcugggagcccgcuuccucgaguucgaagcucuuggcuuuaugaaugaggaucacugguucucccgagaaaacagccugucuggcguggagggggagggauuacauaagcuggguuauaucuugcgggacauaucgaaaaucccuggcgggaauauguacgccgaugacaccgcaggaugggauacuagaauuacagaagacgaucuccagaacgaggcuaggaucaccgacauuauggaaccagagcacgcccugcuagcuaagucaaucuuuaaacuuacuuaucaaaauaaggucgugcgcguacagagacccgccaagaacggcacaguuauggaugugauaagccggagggaccagcgugguuccgggcaggucggaaccuacggccugaauacauucacuaacauggaagcacaacucauucgacagauggagagugagggcaucuuuucuccuagcgaacuggagaccccaaacuuggcggaacgcguguuagauuggcuggagaaauaugggguggaaagacucaagcggauggccaucuccggagacgacugugucguuaaacccauugaugacagguucgcuacggcccuuaccgcacugaaugauauggguaaggugcgcaaagacauaccgcagugggagccuucaaagggcuggaacgauuggcagcaaguacccuuuugcagucaucacuuccaccagcuaaucaugaaggacgggagagagauuguggucccaugucggaaucaggaugaacuggugggaagggcucgaguuucucagggcgccgguuggagccuccgugagacagcaugcuuggggaaauccuacgcccaaauguggcagcugauguauuuucauagacgcgaccuucggcuggcggcuaacgccaucuguucagcagugccugucgauuggauucccacuagcaggaccacauggucuauccacgcccaucaccaguggaugacuaccgaagacaugcucuccguguggaauagaguauggauagaggaaaacccauggauggaggauaagacgcauaucaguagcuggggagacguucccuacuuaggcaaacgcgaggaccaauggugcggcucgcugauuggguugacagcucgggccaccugggcaacuaauauccagguggcuauuaaccaggucaggcgacugaucggaaaugaaaacuaccucgauuauaugacauccaugaagagauucaaaaaugagucugacccugaaggugcccuuugguga

SEQ ID NO: 13921 - RNA, 9879 nt, Artificial Sequence
  derived and/or modified CDS sequence (opt3) from DENV-1__JF937609__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcugugaguggcgucuauccccugagcauaccagcaacgcucuuuguuugguacuucuggcagaaaaagaagcagcggucuggcgugcugugggacacuccuucacccccagaaguggagagagccguccuugaugacgggaucuauaggauuaugcagcguggauuacugggucgcagccaggugggcguugggguauuccaagaaaacguguuucauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacaacuccaggaaccuucaagacgcccgaaggugaggucggcgcaaucgcccuggauuuuaagccugggacaucgggaagcccaauagugaaccgagaaggcaaaaucguuggucuuuaugggaauggaguggucacuaccucaggcacauacguguccgcuauugcccaggcaaaggcuagucaggagggcccccugccugagaucgaagacgagguuuuccggaaacgcaacuugaccauuauggaucuacacccggggucuggaaagacuagaagguaucugccagccaucgugcgggaagcgauaaaacgaaagcucagaaccuuaauucuggcccccacacgcgucguggcaagcgagauggcugaagcccuuaaggguaugccuaucagguaccaaacgacugcuguaaaauccgagcauaccggcaaggagaucguggaccugaugugccacgcaacauuuaccaugcgucucuugucaccaguucggguccccaauuauaacaugauuaucauggaugaagcccauuucacugacccuucuagcauagccgcuagaggguacauuaguacaagggugggaaugggcgaggcggcagccaucuuuaugaccgcuacgccgcccgguuccguggaagccuucccacagagcaaugcagucauucaggaugaggaacgcgacaucccugagcgaucuuggaacucaggguaugaguggauaacugauuuucccggaaaaacaguaugguucgugccauccauuaagaguggcaaugacaucgccaacugucugaggaaaaauggcaagcggguuauccagcucagcaggaagaccuuugauaccgaauaccagaaaacuaagaacaacgacugggacuacguggucacaaccgauauuucggagaugggggcuaauuuccgcgcggaccgugugaucgauccuagacggugccugaaacccguuauucuuaaggacggaccagaaagggugauacuagccgguccgaugccugucacaguggcaucugcugcccagcgccgaggcagaaucgggcggaaccacaauaaagagggagaucaguauauuuacaugggccagccccugaacaaugacgaggaucaugcacacuggacugaagccaagauguuguuagacaacaucaauacgccagaggguaucauucccgcucuguucgaaccugagagggaaaaguccgccgcgauagauggggaguaucgccucagaggcgaggcaaggaaaaccuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacaaaagagggagaaaggaagaaauugcggccccgcuggcuggacgcuagaacuuacucugacccucuagcccugagggaguucaaggaauuugcugcaggucggcgauccgugagcggcgaucucauucuugagaucgggaaacugccgcagcacuuaacccagagagcccaaaaugcuuuggacaaccuggucaugcuccauaauucagaacagggaggccgcgccuauaggcacgcaauggaggagcugccagauacaauugaaacccuuaugcugcucgcguugaucgccguucugacugguggggugacguuauucuuucuaaguggccggggacugggcaagaccagcauagggcuccuuuguguaauggcuuccucugugcuguuguggauggccagcgucgagccccauuggaucgcagcuuccauuauccuggaguucuuucucauggugcugcuuauuccugagcccgaccgucagagaacaccacaggauaaccaacucgccuacguugugaucggacuguuguucaugauacugacugucgcagccaaugagauggguuuacuagaaaccacaaagaaagaccugggcauugggcacguagcugugggaaaccaccaucacgcggccaugcucgauguugaccuucauccugcaucagcuuggacccuguacgccguggccacuacaaucauuacgcccaugaugaggcacaccaucgagaacacuacagcaaauauaucuuugaccgcuaucgccaaccaggcggcuauucugaugggccucgauaaggguuggccaaucaguaaaauggacauuggggucccucugcuugccuuaggcugcuauagccaggugaauccgcugacccucacagcagccgucuugaugcugguggcucauuacgcaaucauaggacccggccuacaagccaaggcgacucgcgaagcucagaaacggacggccgcagggauuaugaagaacccaaccguugauggaaucguggccaucgaccuggauccuguaguguaugacgcuaaguuugagaaacagcucggccagauuaugcuucugaucuuguguacaagccaaauacugcucaugcgaacuaccugggcccugugcgaauccauuacauuagcaaccgguccccuuacuacgcugugggaggggucuccaggaaaguucuggaauacaaccaucgcugucucaauggccaacauuuuuagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguucaacacauauaagagaucagggaucauggaaguugaccguuccgaggccaaagaaggacugaagaggggcgagacuaccaaacacgcagugagucgggguacagcuaaguugcgcugguuugucgagcgaaaucuggugaaaccugaaggcaagguaauagaucucggguguggaagaggcggguggagcuacuauugcgccggauuaaagaaagugacggagguuaagggcuacaccaaaggugggcccggacacgaagaaccgaucccaauggccacuuacggcuggaaccuggugaaacuucauucuggcaaagacgucuucuuuauuccucccgaaaagugugauacacugcuaugcgacaucggggaguccucaccaaaucccaccauugaggaaggaaggacucuccgggugcugaaaauggucgagccuugguugcgcgguaaccaauucuguaucaagauucugaauccguauaugcccagcgugguugaaacacucgagcagaugcagagaaagcacggcgggaugcuuguaaggaacccacugucgcgaaauucuacccaugagauguacugggugaguugcggaacgggcaacaucgucuccgcggugaauaugaccagccggauguuacugaaccguuuuacaauggcucacagaaaaccuacuuaugaacgcgauguugacuugggugcagggaccaggcacguggccgucgagcccgaaguggcuaaccucgauauaauuggacagcggaucgagaauaucaagcaugaacacaaaucaacauggcauuacgacgaggauaacccuuauaagacuugggccuaccacggcuccuaugagguaaaaccaucuggcagcgcaaguuccauggugaaugggguugucaagcugcuaaccaagcccugggacgugauuccuauggugacacaaauagccaugaccgauacuacgccauucggacagcagagagucuuuaaagaaaagguugacacacgcacccccaaagcuaagagggguacugcgcaaaucauggaggugaccgccaaauggcuuuggggcuuccugagccgaaacaagaagccgcggauuuguacaagagaagaguuuacgaggaaaguacgcucuaaugcagcuaucggggccguguucgucgacgaaaaccaguggaacucagcaaaggaggccguggaggaugaacguuuuugggaccucguucaucgggagagagaacugcacaaacagggaaagugcgcuaccugcguguacaacaugaugggcaaaagggagaagaaguugggugaguucgggaaagccaagggaagucgcgcgauuugguacauguggcugggcgcacgauuucucgaguucgaggcccuuggcuucaugaaugaagaucacugguuuucccgggagaacagccugucuggggucgaaggagaggguuuacauaaacugggcuauaucuugagagacauaucgaagaucccugggggaaauauguacgcugaugacacugccggcugggauacaaggauuaccgaggacgaucuccagaacgaagcacgcaucacugacauuauggagccagaacacgcucugcuagccagaucaaucuucaaacuuacauaucaaaauaaggugguacggguucagaggcccgcuaaaaacgguaccgugauggaugucauaagccgucgagaccagcgcggguccggacaggugggcacauacggccugaauacuuuuaccaacauggaggcccaacucauuagacagauggaaagugaggggaucuucucuccuagcgagcuggaaacgccaaacuuggcagagcggguguuagauuggcuggaaaaguauggagucgagaggcucaagcgcauggcgaucuccggugacgacuguguugugaaacccauugaugacagauuugccaccgcucuuacagcccugaaugauaugggcaagguacggaaagacauaccgcagugggaaccuucaaagggguggaacgauuggcagcaagugcccuucugcagucaucacuuucaccagcuaaucaugaaagacggaagggagauugucgugccaugucgaaaucaggaugagcugguuggccgugcaagagugucucagggugcuggguggagccuccgcgaaacugccugcuugggaaaguccuacgcacaaauguggcagcugauguauuuccaucggagggaccuuagacuggccgcgaacgcuaucuguucagccgucccuguggauuggauucccaccagccgcacaacuuggucuauccacgcacaucaccaguggaugaccacggaggacaugcucuccguauggaaucggguuuggauagaagagaacccauggauggaagauaagacacauaucaguagcuggggcgacgugcccuacuuaggcaaaagggaggaccaauggugcgggucgcugauuggauugaccgcccgagcuacuugggccacaaauauccaggucgcaauuaaccaggugagacggcugaucgguaaugagaacuaccucgauuauaugaccuccaugaagagguuuaaaaaugaaucugacccugagggcgcucuuugguga

SEQ ID NO: 13922 - RNA, 9879 nt, Artificial Sequence
  derived and/or modified CDS sequence (opt3) from DENV-1__KF921949__SS-prME
agcgugaccaugcugcucaugcuuaugcccaccgcccuggcuuuccacuugacuacgcggggcggggaaccucauaugaucgucuccaagcaggaaaggggaaagucuuuacuguuuaagaccucagccgguguuaauaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucagaaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguuaccgggauucuggcacagggaaagaaaaugaucagaccucaacccauggaguacaaguauucguggaaaagcuggggcaaggcuaagauaaucggggccgacgugcagaauacaacuuuuauuaucgauggaccaaacaccccugaaugucccgacgaucagagggcguggaauauuugggaggucgaggacuacggcuucgguaucuuuacaacgaacauauggcuuaaauugcgugauuccuauacccaggugugcgaccaccggcucaugucagccgcuauuaaggauaguaaagcaguucacgccgacaugggguacuggaucgaaucugagaagaaugaaacuuggaaacuggcucgagccagcuucauugaggugaagacauguaucuggccaaagucccauacccuauggucaaacggaguacuggaaagcgagaugauaauccccaaaauuuauggcgguccuaucucucaacacaauuacagaccaggcuacuucacucagacagcagggccguggcaucucggaaagcuggagcuugauuuugacuugugcgaaggcaccacggucgugguggaugagcacugcgggaacaggggacccucccugcgcacuaccacagucaccggcaaaauuauccacgaaugguguugccggaguuguacuuuaccuccacucagauucaggggugaggacgggugcugguauggaauggagauacgccccguuaaggaaaaagaggaaaaucuggugaaguccaugguaucugcgggcuccggugagguggacucauuuagucuuggccuguuguguauuagcaucaugaucgaagaggucaugcgaucgcgguggucccguaagaugcucaugacagggacccuggccguguuccuacugcucauuaugggacagcugacauggaacgaucuuaucagauugugcauuaugguuggcgcuaaugccucugacaggauggggaugggaacuaccuaccuggcauuaauggcuacguuuaaaaugcgcccuauguucgccgugggccuccuguuucggagacuuacaagcagggagguccugcuacucaccauaggucugucauugguggcaaguguugaacugccaaacuccuuagaggaacucggggauggacuggccaugggcaucaugauucuuaagcuguugacugacuuccaaucucaucagcucugggcuacccugcuaagccugacauuuaucaaaacuaccuucucccuucacuaugcguggaagacgauggccauggugcucucaauugucagccuguuucccuugugucugaguacaaccucucagaaaacuacaugguuaccgguacuccugggcucccuugggugcaagccucugaccauguucuugaucgcagagaauaagauauggggacgacgcagcuggccacucaacgaagguaucauggcugugggcauuguuucgauccugcuaucaucucugcuuaaaaacgaugugccccucgccgggccucugauugccggaggcauguugaucgcuuguuacgucauaagugguuccagcgcagacuuaucucuggagaaggccgcggaggugagcugggaagaggaagcugagcauuccggggccucacacaauauucucguagaagugcaggaugacggaacuaugaaaaucaaggaugaggagcgggacgauacacugaccauccuucugaaagcaacguugcuagccgucaguggcguuuauccccugagcauuccagcuacucucuuugugugguacuucuggcaaaagaaaaagcagagaucuggcgugcugugggacaccccuucacccccagaagucgagagggcagugcuugaugacgggauauaucguaucaugcagcgcggauuacugggucggagccagguuggcguagggguguuccaagaaaacgucuuucauacaauguggcacgugaccagaggagccguucucauguaccagggcaagagguuggagccgaguugggcgagcgugaaaaaggaccugauuuccuacggugggggauggcgacuccagggcucuuggaauacaggcgaggaaguccaggugaucgcuguagagccugggaaaaaccccaagaauguccaaacugccccaggaaccuucaaaacgcccgaaggugaggugggcgcaauugcccuggauuuuaagccugggacaucgggaagcccaaucguuaaccgggaaggcaagauagugggucuuuaugggaauggagucgugacuaccucaggcacauacguuuccgcuaucgcccaggcaaaagcuagucaggagggcccccugccugagauugaagacgagguguuccgcaagagaaacuugaccaucauggaucuacacccggggucuggaaaaacuaggcgguaucugccagccauuguccgagaagcgaucaagagaaaacuccgcaccuuaauacuggcccccacaagggugguagcaagcgagauggcugaagcccuuaaggguaugccuauucguuaccaaacgacugcugugaaguccgagcauaccggcaaagagaucguugaccugaugugccacgcaacauuuaccaugcggcucuugucaccagucagagugcccaauuauaacaugaucauuauggaugaagcccauuucacugacccuucuagcaucgccgcuaggggguacauaaguacacgcgugggaaugggcgaggcggcagccauuuuuaugaccgcuacgccgcccgguuccgucgaagccuucccacagagcaaugcaguaauccaggaugaggaacgagacauuccugagagaucuuggaacucaggguaugaguggaucacugauuuucccggaaagacagugugguucguuccauccauaaaaaguggcaaugacauugccaacugucugcggaagaauggcaaaagggugauccagcucagccgcaagaccuuugauaccgaauaccaaaagacuaaaaacaacgacugggacuacgucgugacaaccgauaucucggagaugggggcuaauuuccgugcggacagaguuauugauccucggaggugccugaagcccgugauccuuaaagacggaccagaacgcgucauucuagccgguccgaugccugugacaguagcaucugcugcccagcgaagaggccggauagggaggaaccacaauaaggagggagaucaguauaucuacaugggccagccccugaacaaugacgaggaucaugcacacuggacugaagccaaaauguuguuagacaacauuaauacgccagaggguaucauccccgcucuguucgaaccugagcgcgaaaaguccgccgcgauugauggggaguauagacucaggggcgaggcacggaagaccuuuguggaacugaugcgucgcggagaccuuccaguuuggcugagcuacaaagucgccucagagggcuuccaauauagugaucgaagauggugcuuugacggggaaaggaacaaucaggugcucgaggaaaacauggauguggagauauggacaaaggagggagaacggaaaaaguugcgccccagauggcuggacgcuaggacuuacucugacccucuagcccugcgggaguucaaagaauuugcugcaggucgaagauccgucagcggcgaucucauccuugagauugggaagcugccgcagcacuuaacccagcgcgcccaaaaugcuuuggacaaccugguuaugcuccauaauucagaacagggaggcagggccuaucggcacgcaauggaggagcugccagauacaaucgaaacccuuaugcugcucgcguugauugccgugcugacuggugggguaacguuauucuuucuaaguggccguggacugggcaaaaccagcaucgggcuccuuugugugauggcuuccucuguccuguuguggauggccagcguggagccccauuggauagcagcuuccaucauucuggaguucuuucucaugguucugcuuaucccugagcccgacagacagaggacaccacaggauaaccaacucgccuacguggucauuggacuguuguucaugauccugacuguagcagccaaugagauggguuuacuagaaaccacaaagaaggaccugggcauagggcacguggcuguugagaaccaccaucacgcggccaugcucgauguggaccuucauccugcaucagcuuggacccuguacgccgucgccacuacaauuaucacgcccaugaugcgccacaccauugaaaacacuacagcaaauaucucuuugaccgcuauagccaaccaggcggcuauccugaugggacucgauaaaggcuggccaauuaguaagauggacaucggugugccucugcuugccuuagggugcuauucgcaggucaauccgcugacccucacagcagccguguugaugcugguugcucauuacgcaauuaucggccccggacuacaagccaaagcgacucgggaggcucagaagcgaacggccgcaggcauaaugaaaaacccaaccguggaugggauuguagccaucgaccuggauccuguggucuaugacgcuaaguuugaaaagcagcucggacagaucaugcuucugauuuuguguacaagccaaauccugcucaugagaacuaccugggcccugugcgaguccauaacauuagcaaccggcccccuuacuacgcugugggaggguucuccagggaaauucuggaauacaaccauugcuguuucaauggccaacaucuuuaggggaagcuaccucgcgggcgccggucuagcauucucccugaugaagaguuugggcgggggacgccggggcacuggggcucagggagaaacccugggcgagaaauggaagagacagcucaaucagcuuucuaaaagcgaguucaacacauauaagcguucagguauuauggagguggacagguccgaagccaaggaggggcugaaacggggagagacuaccaagcacgcagucagucgcggcacagcuaaauugcgaugguuuguggaaagaaaucugguaaagccugaggguaaagugaucgaucucggcugugggaggggaggcuggagcuacuauugcgccggguuaaagaagguuacggaagugaaaggauacaccaagggcggucccgggcacgaggaaccgauaccaauggccacuuacggauggaaccuggucaaacuucauucuggcaaggacguguucuuuaucccucccgagaaaugugauacacugcuaugcgacauuggcgaguccucaccaaaucccaccaucgaagaggggcggacucuccgcguccugaagaugguggaaccuugguugagaggaaaccaauucuguauuaaaauccugaauccguauaugcccagcguuguagagacacucgagcagaugcagaggaagcacgguggcaugcuugugcgaaacccacugucgagaaauucuacccaugaaauguacugggucaguugcgggacgggaaacauuguguccgcgguuaauaugaccagccguauguuacugaacagauuuacaauggcucaccgcaagccuacuuaugagagggauguggacuugggcgcagguacccggcacgucgccguggaacccgagguagcuaaccucgauaucauagggcagagaauugaaaauaucaaacaugagcacaagucaacauggcauuacgacgaggauaacccuuauaaaacuugggccuaccacggauccuaugaagugaagccaucuggcagcgcaaguuccaugguuaauggcgucgugaaacugcuaaccaagcccugggacgugaucccuauggucacacaaauugccaugaccgauacuacgccauucgggcagcagcgcguuuuuaaggagaaaguggacacaaggacccccaaggcuaaacgaggaacugcgcaaauaauggaaguaaccgccaaguggcuuugggguuuccugagccggaacaaaaagccgagaaucuguacaagggaggaauuuacgaagaaagugcgcucuaaugcagcuauuggcgccgucuucguggacgagaaccaguggaacucagcaaaggaggccguugaagaugagcguuuuugggaccucgugcaucgggaaagagagcugcacaaacaggggaagugcgcuaccugcgucuacaacaugaugggaaaaagggaaaagaaguugggcgaguucgguaaagccaaggggagucgcgcgaucugguacauguggcugggagcacgauuucucgaguucgaagcccuuggcuucaugaaugaggaucacugguuuucccgggaaaacagccugucuggcguggagggggagggauuacauaaacuggguuauauuuugagagacaucucgaagauaccuggcgggaauauguacgcugaugacacugccggaugggauacaaggaucaccgaagacgaucuccagaacgaggcacgcauuacugacaucauggaaccagagcacgcucugcuagccaaaucaauuuucaaacuuacauaucaaaauaaaguaguuagagugcagcggcccgcuaagaacggcaccgucauggaugugaucagcaggcgugaccagcgagguuccggacaggugggaacauacggccugaauacuuuuaccaacauggaagcccaacucauacgccagauggagagugagggcauuuucucuccuagcgaacuggagacgccaaacuuggcagaaagagucuuagauuggcuggagaaguaugggguugaacggcucaaaaggauggcgaucuccggagacgacugugugguaaagcccaucgaugaccgcuuugccaccgcucuuacagcccugaaugauauggguaaagugagaaaggacauuccgcagugggagccuucaaaaggcuggaacgauuggcagcaaguccccuucugcagucaucacuuucaccagcuaauaaugaaggacgggcgggagaucgugguuccauguaggaaucaggaugaacuggugggacgagcacgugucucucagggcgcugguuggagccucagagagacugccugcuuggggaaguccuacgcacaaauguggcagcugauguauuuccaucgccgggaccuuaggcuggccgcgaacgcuauuuguucagccgugccuguagauuggauccccaccagcagaacaacuuggucuauucacgcacaucaccaguggaugaccacggaagacaugcucuccguuuggaaucgcguguggaucgaggaaaacccauggauggaggauaaaacacauauaaguagcuggggagacguccccuacuuaggcaagcgggaggaccaauggugcggcucgcugaucggguugaccgccagggcuacuugggccacaaauauucagguggcaaucaaccagguucgaagacugauuggaaaugaaaacuaccucgauuauaugaccuccaugaaacgguuuaagaaugagucugacccugaaggugcucuuugguga

SEQ ID NO: 13923 - RNA, 9879 nt, Artificial Sequence
  derived and/or modified CDS sequence (opt3) from DENV-1__GU131747__SS-prME
uccgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaacuugccgagacgcagcacgguacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccgcagggaaacugguucaucagauuuucggaaccgcguacggcguguuguuuucuggugucagcuggacuaugaagauagggaucggcgugcuccugacaugguuaggacuaaauucacgaaguaccucccuaagcaugacauguauugcuguaggccucgugacucuguaccuugggguuaugguccaggccgauucuggaugcgugaucaacuggaaaggccgcgaauugaagugugguucagggaucuucgugaccaaugagguccacacguggacagaacaauauaaguuucaggcagacaguccgaaaagacugagcgccgcuauuggaaaggccugggaggagggcguuugcgguauaagguccgcaacccggcucgaaaacaucauguggaaacagauuucuaacgagcugaaucauaucuuacuggaaaacgacaugaaguucacuguggugguaggcgaugucgcugggauucuugcccagggcaagaagaugauccgcccucaacccauggaguacaaauauucguggaaaagcuggggcaaggcgaagauaaucggggccgacgugcagaauaccacauuuauuaucgauggaccaaacacuccugaaugucccgacgaucagagagcuuggaauauuugggagguugaggacuacggcuucgguaucuuuaccacaaacauaugguugaagcucagggauuccuauacacaggugugcgaccaccgucugaugucagcagccauuaaagauagucgggcuguccacgccgacaugggguacuggaucgaaucugagaagaaugaaaccuggaaacuagcacgagcgagcuucauugaggugaagacuuguaucuggccaaagucccauacacuguggucaaacggaguucucgaaagcgagaugauaauccccaaaauuuauggcgguccuaucucucaacacaauuacagaccaggcuacuucacccagacugccgggccguggcaucugggaaaacuugaguuggauuuugaccugugcgaaggcacaaccgugguagucgaugagcacugcgggaacaggggacccuccuuacgcacgacuaccgugacaggcaaaauuauccacgaaugguguugccggaguuguacccucccuccacugagauucaggggugaggacgggugcugguauggaauggagauacgccccgugaaggaaaaagaggaaaaucuugucaagagcaugguuucugcuggcuccggugagguggacucauuuagucugggcuugcucuguauuagcaucaugaucgaagagguaaugcgaucgcgguggucccguaagaugcugaugacugggacacuagccguguucuuucugcucauuaugggacagcugaccuggaacgaucuuaucagauugugcauuauggucggcgcaaaugcuucugacaggauggggaugggaacaacuuaccuggccuuaauggcaaccuucaaaaugcgcccuauguuugccgugggccuccuguuccggagacuuacgagcagggagguucugcuacucacaauaggucugucauugguggcuagugucgaacugccaaacuccuuagaggaacucggggauggacuggcgaugggcaucaugauucuuaagcuguugaccgacuuucaaucucaucagcucugggccacucugcuaagccugaccuucaucaaaacaacuuuuucccuucacuaugcauggaagaccauggcuauggugcucucaauuguuagccuguuccccuugugucugaguacgacaucucagaaaaccacuugguuaccgguguuucucggcucccuggggugcaagccucuuacaauguuccugaucgccgagaauaagauauggggacgacgcagcuggccauugaacgaagguaucauggccgucggcauuguaucgauccuccugucaucucuacugaaaaacgaugugccccuugcugggccucucauugcaggaggcaugcugaucgccuguuacguuauaagugguuccagcgcggacuugucuuuagagaaggcugccgaggugagcugggaagaggaagcagagcauuccggggccucacacaauauucuggucgaagugcaggaugacggaaccaugaaaaucaaggaugaggagcgggacgauacucucacaguacugcuuaaagcuacccuguuggcagugaguggcgucuauccccuaagcaucccagccacgcuguucguuugguacuuuuggcaaaagaaaaagcagagaucuggcgugcucugggacacuccuucacccccagaaguggagagggcgguccuggaugacgggauuuaucguauaaugcagcgcggacuuuuaggucggagccaggugggcguugggguauuccaagaaaacguguuucauaccauguggcacgucacaagaggagcugugcugauguaccagggcaagaggcucgagccgaguugggccagcguuaaaaaggacuugaucuccuacggugggggauggcgacugcagggcucuuggaauaccggcgaggaagugcaggucauugcaguggagccugggaaaaaccccaagaauguacaaacagccccaggaacuuucaaaacccccgaaggugaggucggcgcuaucgcccucgauuuuaagccugggacgucgggaagcccaauugugaaccgggaaggcaagaucguuggucuguaugggaauggaguggucacaacuucaggcaccuacguguccgcaauagcucaggccaaagcgagucaggagggcccccuuccugagaucgaagacgagguuuuccgcaagagaaaccugacaauuauggauuugcacccggggucuggaaaaaccaggcgguaucuaccagccaucgugcgagaagcaauuaagagaaaacugcgcacucucaucuuagcucccaccagggucguggccagcgagauggcugaagcacugaaggguaugccuauacguuaccaaacaacggccguaaaguccgagcauacuggcaaagagauuguggaccuuaugugccacgccaccuuuacaaugcggcugcucucaccaguuagaguccccaauuauaacaugaucaucauggaugaagcucauuucaccgacccuucuagcauugcggcaaggggguacaucaguacucgcgugggaaugggcgaggccgcugccauauuuaugacagcaaccccgcccgguuccguggaagccuucccacagagcaaugcugucauucaggaugaggaacgagacaucccugagagaucuuggaacucaggguaugaguggauuacggauuuucccggaaagacuguaugguucgugccauccaucaaaaguggcaaugacauagcgaacuguuugcggaagaauggcaaaaggguuauucagcugagccgcaagacauucgauaccgaauaccaaaagaccaaaaacaacgacugggacuacguggucacuacagauaucucggagaugggggccaauuuucgugcagacagagugaucgauccucggaggugccucaagcccguuauucugaaagacggaccagaacgcgugauccuugcugguccgaugccugucaccguggccucugcagcccagcgaagaggccggauugggaggaaccacaauaaggagggagaucaguauauauacaugggccagccccuaaacaaugacgaggaucaugcucacuggacagaagccaaaaugcuguuggacaacaucaauacuccagaggguauuauccccgcguuauucgaaccugagcgcgaaaaguccgcagccaucgauggggaguauagacugaggggcgaggcucggaagacguuuguagaacucaugcgucgcggagaccugccaguguggcuuagcuacaaaguugccucagagggcuuccaauauagugaucgaagauggugcuuugacggggaaaggaacaaucagguccuggaggaaaacauggauguggagauuuggaccaaggagggagaacggaaaaagcuccgccccagaugguuggacgcuaggacauacucugacccucuggcacuacgggaguucaaagaauuugccgcuggucgaagauccgugagcggcgaucugauacucgagaucgggaaacuuccgcagcaccugacucagcgcgcccaaaaugcauuagacaacuuggucaugcugcauaauucagaacagggaggcagggcguaucggcacgccauggaggagcucccagauaccauugaaacacugaugcuucuggcucucaucgccguuuugaccgguggggugacucuguucuuuuuaaguggccguggacuaggcaaaacgagcauugggcugcucuguguaauggcauccucugugcuucuguggauggcuagcgucgagccccauuggaucgccgcauccauaaucuuggaguucuuucugauggugcuccugauuccugagcccgacagacagaggaccccacaggauaaccaacuugccuacguugugaucggacuccuguucaugauuuugacagucgcugcgaaugagaugggucuguuagaaacuaccaagaaggaccuaggcaucgggcacguagccguggagaaccaccaucacgcagcuaugcuggauguugaccuccauccugccucagccuggacacuuuacgcaguggcuaccacuauaauuacacccaugaugcgccacacgaucgaaaacaccacugccaauauuucucugacagcgaucgcuaaccaggccgcaauauugaugggacuggauaaaggcuggccaaucaguaagauggacauuggugucccucuccuggcccuugggugcuauagccaggugaauccguuaacccugaccgcugcaguccucauguugguggcccauuacgcgaucauuggccccggacugcaagcuaaagccacacgggaggcacagaagcgaacugccgcuggcaucaugaaaaacccaacgguugaugggauaguggccauugaccuagauccuguaguguaugacgcaaaguuugaaaagcagcugggacagaucaugcuccuuauccuguguaccagccaaauuuugcugaugagaacaacuugggcucucugcgaguccaucacccuggccacaggccccuuaaccacucuuugggaggguucuccagggaaauucuggaauacgacaauagcggucucaauggccaacauuuucaggggaagcuaccuggcaggcgcuggucucgccuuuucccuaaugaagagucugggcgggggacgccggggcaccggggcacagggagaaacuuugggcgagaaauggaagagacagcugaaucagcucucuaaaagcgaguucaacaccuauaagcguucagguaucauggagguugacagguccgaagcuaaggaggggcuuaaacggggagagacaacuaagcacgccgugagucgcggcaccgccaaacugcgaugguuugucgaaagaaauuuggugaagccugaggguaaaguaauugaucugggcugugggaggggaggcuggagcuacuauugcgcggggcucaagaaggugacagaaguuaaaggauacacgaagggcggucccgggcacgaggaaccgaucccaauggcuaccuacggauggaacuuagugaaacugcauucuggcaaggacgucuucuuuauaccucccgagaaaugugauacucuucugugcgacaucggcgaguccucaccaaaucccacaauugaagaggggcggacccuacgcgugcucaagauggucgaaccuuggcugagaggaaaccaauucuguaucaaaauuuugaauccguauaugcccagcgugguugagacucuggagcagaugcagaggaagcacgguggcaugcucguacgaaacccacuuucgagaaauucuacacaugaaauguacugggugaguugcgggaccggaaacaucgucuccgcagugaauaugacgagccguaugcuguuaaacagauuuaccauggcccaccgcaagccuacauaugagagggauguugaccugggcgcugguacucggcacguggccgucgaacccgagguggcaaacuuggauauuaucgggcagagaauagaaaauauuaaacaugagcacaagucaaccuggcauuacgacgaggauaacccuuauaaaacaugggccuaccacggauccuaugaaguaaagccaucuggcagcgcuaguuccauggugaauggcguugucaaacuccugacuaagcccugggacgugaucccuauggugacccaaaucgcgaugacagauaccacuccauucgggcagcagcgcgucuuuaaggagaaaguugacacgaggacacccaaggccaaacgaggaaccgcacaaauuauggaagugacugcuaaguggcuaugggguuuccuuagccggaacaaaaagccgagaauauguaccagggaggaauuuacacgcaagguacguucuaaugccgcaaucggcgccguguucgucgacgagaaccaguggaacucagcuaaagaggccguggaagaugagcgguuuugggaccugguucauagagaaagggagcuccacaagcaggggaaaugcgcgacgugcguguacaacaugaugggaaagcgcgagaagaagcugggcgaguucgguaaggcaaaagggagucgagccauuugguacaugugguugggagcucgguuccuggaguuugaagcccucggcuucaugaaugaggaucacugguuuuccagagaaaacagccuuucuggcgucgagggggagggacugcauaaguuagguuauauccugagggacauuucgaaaaucccuggcgggaauauguacgcagaugacaccgcuggaugggauacucgcauaacagaagacgauuugcagaacgaggccagaaucaccgacauuauggaaccagagcacgcucuccuggccaagucaaucuucaaacuaacuuaucaaaauaaggugguacggguucagaggcccgccaaaaauggcacagugauggaugucauuagccgucgagaccagcgcgguuccggacaggugggaaccuacggccuuaauacauuuacuaacauggaagcgcaacugaucagacagauggagagugagggcauauucucuccuagcgaacucgagaccccaaaccuggccgaacggguguuggauugguuagagaagcauggggucgaaaggcugaagcgcauggcuauuuccggagacgacuguguugugaaacccaucgaugacagauuugccacggcacucaccgcucuuaaugauauggguaagguacggaaagacaucccgcagugggagccuucaaagggcuggaacgauuggcagcaagugcccuucugcagucaccacuuucaucagcugauuaugaaagacgggagggagauagucgugccaugucgaaaucaggaugagcugguuggacgugccagagugucucagggcgcagguuggagccugcgcgagacagccugccucgggaaguccuaugcgcaaauguggcaguugauguacuuccaccggagggaccugagacuugcugccaacgcaaucuguucagccgucccuguggauuggauucccacuagccgcaccacauggucuauccaugcucaccaucaguggaugacuaccgaagacaugcuguccguauggaaucggguuuggauugaggaaaacccauggauggaggauaagacgcacaucaguagcuggggagacgugcccuaucucggcaaaagggaggaccaauggugcggcucguuaauagggcugacagcccgagcaaccugggcuacuaauauccaggucgccauuaaccaggugagacgguugaucggaaaugaaaacuaccuggauuacaugacauccaugaagagguuuaaaaaugagucugacccugaaggugcgcucugguga

SEQ ID NO: 13924 - RNA, 9879 nt, Artificial Sequence
  derived and/or modified CDS sequence (opt3) from DENV-1__GU131748__SS-prME
agcgugaccaugcuguucaugcucguccccacagcccuugcuuuucaccugacuacgagaggaggggaaccucauaugaucguuuccaagcaggaaagaggaaaaucuuuguuauucaagaccucagccggugugaauaugugcacacugauugccauggaccugggcgaacucugugaagauacuaugaccuacaaaugcccacggauaacagagaccgaaccggacgauguagacuguuggugcaaugcgacugauacaugggugaccuaugggacguguagucaaacuggagagcaccgccgagacaagcguagcgucgcucuggcaccccaugugggccuuggucuggagaccagaacagaaacuuggauguccucugagggggcauggaaacagauccagaggguugaaaccugggccuugcggcacccuggauuuacagugauugcucucuuccuggcacaugccaucggcaccucgauuacgcagaagggcaucauauuuauccugcucauguuagucacuccaucaauggcuaugcgcugcguggggauuggaagcagagauuucguugagggucugaguggcgccacauggguugacgugguccuugagcacggguccugugugaccacuauggcgaaggauaaacccacauuggacaucgaacugcuaaagaccgaggugacgaacccugcaguccucaggaaacugugcauugaagccaagaucucuaauaccacaacugauagccgguguccaacccaaggagaggcuacacuuguugaagaacaagacgccaacuuugugugccgccgaacuuucguagauagaggcugggguaauggguguggacuguuuggcaaaggcuccuugauaaccugcgcaaaguucaagugcgugacaaaacucgaggggaagauuguccaguacgaaaaccugaaauauucagugaucguuaccgugcacacuggagaccagcaucaagucgguaaugagaguacggaacacggcacaaccgcuacuauuacaccccaagccccuaccaccgagauccaguuaacugacuacggggcgcugacacucgauuguagcccaaggacgggacuugacuuuaacgaaauggugcuguugaccaugaaggagaaaucuuggcuaguacauaagcagugguuccuggaucucccgcugcccuggacuuccggcgccucaacaagccaagagaccuggaaucggcaggaccuucugguuacauuuaaaacugcacacgcuaagaagcaggaaguggucguguuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugucauguguaccggaucguucaaacucgagaaggaaguggccgagacgcagcacgguacaguucuggugcagauaaaguacgagggcaccgacgcuccuugcaaaaucccauuuucgacucaagaugaaaaggggguaacacagaacggacgccuuauuaccgcgaaucccaucgucacugacaaagagaagccugugaacauagaagcagagccacccuucggcgagucuuauauuguuaucggugccggggaaaaggcuuugaagcuguccugguuuaagaaaggcucaaguaucggaaagauguucgaggccaccgcaagaggcgccaggcggauggcuauucucggggauacagccugggacuuuggaagcaucgguggcguguucacguccgucgggaaacuggugcaucagauuuuuggaaccgcauacggcguacuuuucucuggugugagcuggacuaugaagauagggaucggcguucuguugacauggcucggacuaaauucacgaaguaccuccuuaagcaugacauguauugcggucggccuggugacucuauaccucggggugaugguccaggcugauucuggaugcguuaucaacuggaaaggccgcgaacugaagugugguucagggaucuuugugaccaaugaggugcacacguggacagaacaauauaaguuccaggccgacaguccgaaaagacuuagcgcagccauuggaaaggcuugggaggagggcguaugcgguauaagguccgccacccgguuggaaaacaucauguggaaacagauuucuaacgagcugaaucauauccuccuggaaaacgacaugaaguuuacugucgugguuggcgauguggcagggauuuuagcucagggcaagaaaaugauccgcccucaacccauggaguacaaauauucguggaaaagcuggggcaaggccaagauaaucggggcggacguccagaauaccacauucauuaucgauggaccaaacacuccugaaugucccgacgaucagagagccuggaauauuugggagguggaggacuacggcuuugguaucuucaccacaaacauauggcugaaacuuagggauuccuauacgcagguuugcgaccaccguuugaugucagcugcaauuaaagauaguaaggccgugcacgcugacaugggguacuggaucgaaucugagaaaaaugaaaccuggaagcucgcccgggcauccuucauugagguaaagacuuguaucuggccaaaaucccauacacuguggucaaacggaguccuagaaagcgagaugauaauccccaagauuuauggcgguccuaucucucaacacaauuaccgaccaggcuacuuuacccagacugcggggccguggcaucugggaaaacucgagcuggauuucgaccuuugcgaaggcacaaccgugguggucgaugagcacugcgggaacagaggacccuccuugaggacgacuaccguuacaggcaagauuauccacgaaugguguugccgcaguuguacccugccuccauuacgguuuagaggugaggacgggugcugguauggaauggagauaaggcccgugaaagaaaaggaggaaaaucucguaaagagcauggugucugccggcuccggugaggucgacucauucagucugggccuucuguguauuagcaucaugaucgaagaggugaugcgcucgcgauggucccggaaaauguugaugacugggacacucgcuguauuuuuccugcuaauuaugggacagcugaccuggaacgaucucauccgucugugcauuauggugggcgccaaugcaucugacagaauggggaugggaacaacuuaccuugcuuugauggccaccuuuaagaugaggccuauguucgcagucggccuguuauuucgccggcucacgagcagagaggugcugcuucugacaauaggucuaucacucguugccaguguggaacugccaaacuccuuggaggaacugggggauggauuagcuaugggcaucaugauucucaaacugcuuaccgacuuccaaucucaucagcugugggcgacuuugcucagccugaccuuuaucaagacaacuuucucccuacacuaugccuggaaaaccauggcaaugguccugucaauuguaagccuuuuuccccucugucugaguacgacaucucagaagaccacuugguugccggugcuguuaggcucccucgggugcaagccucugacaauguuccuuaucgcugagaauaaaauauggggaaggcgaagcuggccacugaacgaagguaucauggccguuggcauugugucgaucuugcucucaucucugcuaaagaacgaugucccccuggccgggccucuuauugcuggaggcaugcucaucgcauguuacgugauaagugguuccagcgccgaccugucuuuggagaaagcggcugagguaagcugggaagaggaagccgagcauuccggggcaucacacaauauuuuaguggaaguccaggaugacggaaccaugaagaucaaagaugaggagcgcgacgauacucugacaauccuccugaaggccacccuucuggcuguuaguggcguguaucccuugagcauuccagcaacgcuauucguguggcauuuuuggcagaagaagaagcagcggucuggcguccugugggacacuccuucacccccagaaguggagagagccguucucgaugacgggauauacaggaucaugcagcguggacugcuuggucgcagccagguaggcgugggggucuuccaagaaaacguguuucacaccauguggcacguuacacggggagcgguguuaauguaucagggcaaaagacuggagccgaguugggcuagcgucaagaaagaccucauuuccuacggugggggauggagguugcagggcucuuggaauaccggcgaggaagugcagguaaucgccgucgagccugggaagaaccccaaaaaugugcaaacagcaccaggaacuuucaagacccccgaaggugagguuggcgccauugcucuggauuuuaagccugggacgucgggaagcccaaucgugaaccgagaaggcaaaauagucggucucuacgggaauggagugguuacaacuucaggcaccuauguguccgccaucgcacaggcuaaggccagucaggagggcccccugccugagauugaagacgaggucuuccggaaacgcaaccuuacaaucauggaucugcauccggggucuggaaagaccagaagguacuugccagcgauugugcgggaagccaucaaacgaaagcuaagaacucugauacucgcacccacccgcguaguggcuagcgagauggccgaggcuuuaaaggguaugccuauuagguaucaaacaacggcaguuaaauccgagcacacuggcaaggagaucgucgaccugaugugccaugccaccuuuacaaugcgucuucugucaccagugcgggugcccaauuacaacaugaucauuauggaugaagcccacuucaccgacccuucuagcaucgcugcgagaggguauauaaguacuagggucggaaugggcgaggcagccgcuauuuuuaugacagccaccccgcccgguuccguagaagcauucccacagagcaaugccgugauccaggaugaggaacgcgacauuccugagcgaucuuggaacucaggguacgaguggaucacggauuuucccggaaaaacuguuugguucgugccauccauaaagaguggcaaugacauugcuaacugucucaggaaaaauggcaagcgggucauccaguugagcaggaagacauucgauaccgaauaucagaaaaccaagaacaacgacugggacuacgugguuacuacagauaucucggagaugggggcgaauuuucgcgccgaccgugugauugauccuagacggugccugaaacccgucauccucaaggacggaccagaaagggugauucuggcagguccgaugccuguaaccguggcuucugccgcacagcgccgaggcagaauagggcggaaccauaauaaagagggagaucaguacaucuauaugggccagccccuuaacaaugacgaggaucacgcccacuggacagaagcuaagaugcuacuggacaacauuaauacuccagaggguaucauccccgccuuguucgaaccugagagggaaaaguccgcggcaauugauggggaguaccgcuuaagaggcgaggccaggaaaacguuuguugaacugaugcggcguggagaccucccagucuggcugagcuauaagguggcuucagagggcuuccaauacagugaucgccgauggugcuuugacggggaaagaaacaaucaggugcuugaggaaaacauggaugucgagauauggaccaaagagggagaaaggaagaaacugcggccccgcuggcucgacgccagaacauauucugacccuuuggcucugagggaguucaaggaauuugcagccggucggcgauccguuagcggcgaucuaauccuggagauugggaaacucccgcagcaucuuacucagagagcucaaaaugcccuggacaacuuagugauguugcacaauucagaacagggaggccgcgcauacaggcaugcgauggaggagcugccagauaccaucgaaacacucaugcugcuugcccugauugcuguacucaccgguggggugacuuuguucuuucugaguggccggggauuaggcaagacgagcaucgggcuacugugugucauggccuccucugugcuccuuuggauggcaagcguugagccccacuggauagcugccuccaucauucuggaguucuuuuugauggugcugcucaucccugagcccgaccgucagagaaccccacaggauaaccaacuggcauaugucguaauuggacuucucuucaugauccugacaguggccgcuaaugagauggguuugcuggaaacuaccaagaaagacuuaggcauagggcacguugcgguggagaaccaucaccaugccgcaaugcuagaugucgaccugcacccugcuucagccuggacacucuacgccguggcaaccacuauuaucacacccaugaugaggcauacgauugaaaacaccacugcuaauaucucucuuacagccauagcgaaccaggcugccauccugaugggauuggauaagggcuggccaauuaguaaaauggacaucggugucccucugcucgcacuggggugcuacagccaggugaauccgcuuaccuuaaccgccgcuguucugaugcucguggcacacuaugccauuaucggccccggauugcaagcgaaggcuacacgcgaggcccagaaacggacugcagccggcauaaugaagaacccaacgguagaugggauuguggcuaucgaccuggauccugucguuuacgacgccaaguuugaaaaacagcuaggacagaucaugcugcucauucuuuguaccagccaaauccuguugaugcgaacaacuugggcacugugcgaguccauaacccucgcuacaggcccccugaccacuuuaugggaggguucuccagggaaguucuggaauacgacaauugccgugucaauggcgaacaucuucagaggaagcuaucuugccggcgcaggucuggcuuuuucccucaugaaaagucuaggcgggggaaggcgcggcaccggggcccagggagaaacucugggcgagaaguggaaacggcaguugaaucagcugucuaagagcgaguucaacaccuacaagagaucagguauuauggaggucgaccguuccgaagcaaaagaggggcucaagaggggagagacaacuaaacacgcugugagucggggcaccgccaaacuucgcugguuuguagaacgaaaucuggugaaaccugaggguaagguuaucgauuugggcugugggagaggaggcuggagcuauuacugcgccgggcugaagaaagugacagaagucaagggauauacgaaaggcggucccgggcaugaggaaccgauaccaauggcgaccuacggauggaaccucgugaaguuacacucuggcaaagacgucuucuuuaucccucccgagaagugugauacucugcuuugcgacauuggcgaguccucaccaaaucccacaaucgaagaggggaggacccugcgggugcuaaaaaugguugaaccuuggcuccgcggaaaccaauucuguauuaagauccugaauccguacaugcccagcguaguggagacuuuggagcagaugcagagaaagcaugguggcaugcuggucaggaacccacucucgcgaaauucuacacacgaaauguauugggugaguugcgggaccggaaacauuguuuccgcugugaauaugacgagccggaugcuucugaaccguuuuaccauggcacacagaaaaccuacauacgagcgcgaugucgacuuaggcgccgguacuaggcauguggcuguagaacccgagguggccaaccuggauaucauagggcagcggauugaaaauaucaagcacgagcauaaaucaaccuggcacuaugacgaggauaacccuuacaagacaugggcauaucauggauccuacgaaguuaaaccaucuggcagcgccaguuccauggucaauggcguggugaaguugcucacuaagcccugggacgucaucccuaugguuacccaaauugcuaugacagauaccacuccauucgggcagcagagaguguuuaaagagaagguagacacgcgcacacccaaagcgaagaggggaaccgcccaaauaauggaagugacugcaaaauggcugugggguuuccuaagccgaaacaagaagccgcggaucuguaccagagaggaauuuacaaggaaaguccgcucuaaugcugccauuggcgcaguguucguugacgagaaccaguggaacucagccaaggaggcuguggaagaugagcguuuuugggaccuuguccaccgggaaagagagcugcacaaacaggggaagugcgccacgugcguguauaacaugaugggaaaaagggaaaagaagcucggcgaguucgguaaagcgaaggggagucgcgcaaucugguacauguggcugggagcccgauucuuggaguuugaagcucugggcuucaugaaugaggaucauugguuuucccgggaaaacagccucucuggcguagagggggagggacuucacaaacuggguuacauuuuaagagacaucucgaagauaccuggcgggaauauguaugccgaugacaccgcaggaugggauacuaggaucacagaagacgaucugcagaacgaggcucgcauuaccgacaucauggaaccagagcaugccuugcucgcuaaaucaauuuucaagcugacuuaccaaaauaaaguugugagaguccagcggcccgccaagaacggcacagugauggaugugaucagcaggcgugaccagcgagguuccgggcaggucggaaccuauggccuaaauacauuuacuaacauggaagcacaacuuauacgccagauggagagugagggcauuuucucuccuagcgaacuggagaccccaaaccucgcggaaagaguucuggauugguuggagaaguacggggugaaacgguuaaagaggauggccaucuccggagacgacuguguagugaaacccaucgaugaccgcuuugcuacggcccugaccgcacucaaugauauggguaaggucagaaaagacauuccgcagugggaaccuucaaagggcuggaacgauuggcagcaagugcccuucugcagucaccacuuucaucagcuuauaaugaaggacgggcgggagaucguugugccauguaggaaucaggaugagcuggucggacgagcucgugugucucagggcgccgguuggagccuaagagaaacagcaugccuggggaaauccuaugcccaaauguggcagcucauguacuuccaccgccgggacuugaggcuggcggcuaacgccauuuguucagcaguaccuguugauuggauccccacuagcagaaccacauggucuauucaugcccaccaucaguggaugacuaccgaggacaugcuuuccguguggaaucgcgucuggaucgaagagaacccauggauggaagauaagacgcacauaaguagcuggggagacgugcccuaucugggcaaacgggaggaccaauggugcggcucgcucaucggguuaacagcuagggccaccugggcaacuaauauucagguugcuaucaaccaggugcgaagacugauuggaaaugagaacuacuuggauuacaugacauccaugaagcgguuuaaaaaugaaucugacccugagggugcccugugguga

SEQ ID NO: 13925 - RNA, 9879 nt, Artificial Sequence
  derived and/or modified CDS sequence (opt3) from DENV-1__GQ868615__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaagaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugauucucucaaucguuagccuguuccccuugugucugaguacgacaucucagaagaccacuugguuaccggugcuccugggcucccuugggugcaagccucugacaauguuuuugauagcugagaauaaaaucuggggaaggcgaagcuggccacucaacgaagguauuauggccgucggcaucguaucgauucugcuaucaucucugcuuaagaacgaugugccccucgccgggccucugaucgcuggaggcauguugauagcauguuacguuauuagugguuccagcgccgacuuaucucuggagaaagcggcugaggugagcugggaagaggaagccgagcauuccggggcaucacacaauauccucgucgaagugcaggaugacggaaccaugaagaucaaagaugaggagcgcgacgauacucugacaauucuucugaaggccaccuugcuagcuguaaguggcguguauccccugagcauaccagcaacacucuucgucugguacuucuggcagaagaagaagcagcggucuggcguucugugggacacuccuucacccccagaaguggagagagccgugcuugaugacgggaucuauaggauuaugcagcguggauuacugggucgcagccaggucggcguggggguuuuucaagaaaacguauuccauaccauguggcacgugacacggggagcgguccucauguaccagggcaaaagauuggagccgaguugggcuagcgugaagaaagaccugaucuccuacggugggggauggaggcuccagggcucuuggaauaccggcgaggaaguucaggugauugccgucgagccugggaagaaccccaaaaaugugcaaacagcaccaggaacuuuuaagacccccgaaggugagguaggcgccaucgcucuggauuucaagccugggacgucgggaagcccaauagucaaccgagaaggcaaaaucgugggucuuuaugggaauggaguugugacaacuucaggcaccuacgucuccgccauugcacaggcuaaggccagucaggagggcccccugccugagaucgaagacgagguguuucggaaacgcaacuugacaauuauggaucuacacccggggucuggaaagaccagaagguaucugccagcgaucguucgggaagccauaaaacgaaagcucagaacuuuaauucuggcacccacccgcguggucgcuagcgagauggccgaagcucuuaaggguaugccuaucagguaccaaacaacggcagugaaauccgagcauacuggcaaggagaucguagaccugaugugccacgccaccuucacaaugcgucucuugucaccagugcggguucccaauuauaacaugauuaucauggaugaagcccauuuuaccgacccuucuagcauagcugcgagaggguacauuaguacuagggucggaaugggcgaggcagccgcuaucuucaugacagccaccccgcccgguuccguggaagcauuuccacagagcaaugccgugauucaggaugaggaacgcgacaucccugagcgaucuuggaacucaggguaugaguggauaacggauuuccccggaaaaacugucugguuuguaccauccauuaagaguggcaaugacaucgcuaacugucugaggaaaaauggcaagcgggugauccagcucagcaggaagacauucgauaccgaauaccagaaaaccaagaacaacgacugggacuacguugugacuacagauauuucggagaugggggcgaauuuccgcgccgaccgugucaucgauccuagacggugccugaaacccgugauucuuaaggacggaccagaaaggguuauacuagcagguccgaugccugugaccgucgcuucugccgcacagcgccgaggcagaaucgggcggaaccacaauaaagagggagaucaguauauuuacaugggccagccccugaacaaugacgaggaucaugcccacuggacagaagcuaagauguuguuagacaacaucaauacuccagaggguaucauucccgcccuguuugaaccugagagggaaaaguccgcggcaauagauggggaguaucgccucagaggcgaggccaggaaaacguucguggaacugaugcggcguggagaccuuccaguauggcugagcuacaagguggcuucagagggcuuucaauauagugaucgccgauggugcuucgacggggaaagaaacaaucagguucucgaggaaaacauggaugucgagaucuggaccaaagagggagaaaggaagaaauugcggccccgcuggcuggacgccagaacauacucugacccucuagcucugagggaguuuaaggaguucgcagccggucggcgauccgugagcggcgaucucauucuugagaucgggaaacugccgcagcacuuaacucagagagcucaaaaugccuuggacaaccuggugaugcuccauaauucagaacagggaggccgcgcauauaggcacgcgauggaggagcugccagauaccauugaaacacuuaugcugcucgccuugaucgcuguccugaccggugggguuacuuuauuuuuccuaaguggccggggacugggcaagacgagcauagggcuccuuugugugauggccuccucuguacuguuguggauggcaagcguggagccccauuggaucgcugccuccauuauccuggaauuuuuccucaugguccugcuuauuccugagcccgaccgucagagaaccccacaggauaaccaacucgcauacgugguuaucggacuguuguuuaugauacugacaguggccgcuaaugagauggguuuacuagaaacuaccaagaaagaccugggcauugggcacgucgcgguagagaaccaccaucacgccgcaaugcucgauguggaccuucauccugcuucagccuggacacuguacgccguugcaaccacuaucauuacacccaugaugaggcacacgaucgaaaacaccacugcuaauauaucuuugacagccaucgcgaaccaggcugccauucugaugggacucgauaagggcuggccaaucaguaaaauggacauuggugugccucugcuugcauuagggugcuauucgcaggucaauccgcugacccucaccgccgcuguguugaugcuggucgcacauuacgccaucauaggccccggacuacaagcgaaggcuacacgcgaggcccagaaacggacugcagccggcauuaugaagaacccaacgguggaugggaucguugcuaucgaccuggauccugugguauaugacgccaaguucgaaaaacagcucggacagauuaugcuucugaucuuguguaccagccaaauacugcucaugcgaacaacuugggcacugugcgaguccauuaccuuagcuacaggcccccuuaccacucugugggaggguucuccagggaaguuuuggaauacgacaaucgccgugucaauggcgaacauuuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguaucauggaggucgaccguuccgaagcaaaagaggggcugaagaggggagagacaacuaaacacgcuguuagucggggcaccgccaaguugcgcugguucguggaacgaaaucuggucaaaccugaggguaaggugauagaucucggcugugggagaggaggcuggagcuacuauugcgccggguuaaagaaaguaacagaagugaagggauacacgaaaggcggucccgggcacgaggaaccgaucccaauggcgaccuacggauggaaccugguuaaacuucauucuggcaaagacguguuuuucauuccucccgagaagugugauacucugcuaugcgacaucggcgaguccucaccaaaucccacaauugaagaggggaggacccuccggguccugaaaaugguggaaccuugguugcgcggaaaccaauuuuguaucaagauucugaauccguauaugcccagcgucguggagacucucgagcagaugcagagaaagcacgguggcaugcuuguuaggaacccacugucgcgaaauucuacacaugaaauguacuggguaaguugcgggaccggaaacaucguguccgcugucaauaugacgagccggauguuacugaaccguuucaccauggcacacagaaaaccuacauaugagcgcgauguggacuugggcgccgguacuaggcacguugcuguggaacccgaggucgccaaccucgauauaauugggcagcggaucgaaaauaucaagcaugagcacaaaucaaccuggcauuacgacgaggauaacccuuauaagacaugggcauaccacggauccuaugaagugaaaccaucuggcagcgccaguuccaugguaaauggcgugguuaagcugcuaacuaagcccugggacgucauuccuauggugacccaaauagcuaugacagauaccacuccauuugggcagcagagaguguucaaagagaaggucgacacgcgcacacccaaagcgaagaggggaaccgcccaaaucauggaaguuacugcaaaauggcuuugggguuuucugagccgaaacaagaagccgcggauuuguaccagagaggaguucacaaggaaagugcgcucuaaugcugccaucggcgcaguauuuguggacgagaaccaguggaacucagccaaggaggcugucgaagaugagcguuucugggaccucgugcaucgggaaagagagcugcacaaacaggggaagugcgccacgugcguuuacaacaugaugggaaaaagggaaaagaaguugggcgaguuugguaaagcgaaggggagucgcgcaauuugguacauguggcugggagcccgauuccucgaguucgaagcucuuggcuuuaugaaugaggaucacugguucucccgggaaaacagccugucuggcguggagggggagggauuacauaaacuggguuauaucuugagagacauaucgaagaucccuggcgggaauauguacgccgaugacaccgcaggaugggauacuaggauuacagaagacgaucuccagaacgaggcucgcaucaccgacauuauggaaccagagcacgcccugcuagcuaaaucaaucuuuaaacuuacuuaucaaaauaaagucgugagaguacagcggcccgccaagaacggcacaguuauggaugugauaagcaggcgugaccagcgagguuccgggcaggucggaaccuacggccugaauacauucacuaacauggaagcacaacucauucgccagauggagagugagggcaucuuuucuccuagcgaacuggagaccccaaacuuggcggaaagaguguuagauuggcuggagaaguaugggguggaacggcucaaaaggauggccaucuccggagacgacugugucguuaagcccauugaugaccgcuucgcuacggcccuuaccgcacugaaugauauggguaaagugagaaaggacauaccgcagugggagccuucaaaaggcuggaacgauuggcagcaaguacccuuuugcagucaucacuuccaccagcuaaucaugaaggacgggcgggagauuguggucccauguaggaaucaggaugaacuggugggacgagcucguguuucucagggcgccgguuggagccucagagagacagcaugcuuggggaaguccuacgcccaaauguggcagcugauguauuuucaucgccgggaccuuaggcuggcggcuaacgccaucuguucagcagugccugucgauuggauucccacuagcagaaccacauggucuauccacgcccaucaccaguggaugacuaccgaagacaugcucuccguguggaaucgcguauggauagaggaaaacccauggauggaggauaaaacgcauaucaguagcuggggagacguucccuacuuaggcaagcgggaggaccaauggugcggcucgcugauuggguugacagcuagggccaccugggcaacuaauauccagguggcuauuaaccagguccgaagacugaucggaaaugaaaacuaccucgauuauaugacauccaugaaacgguucaagaaugagucugacccugaaggugcccuuugguga

SEQ ID NO: 13926 - RNA, 9879 nt, Artificial Sequence
  derived and/or modified CDS sequence (opt3) from DENV-1__GU131749__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggaagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguaccgaguguuguuuucuggcguaagcuggaccaugaagauugguauaggggugcuccugacuugguuaggccugaauucacgcaguacaucccuaagcaugaccuguaucgcuguuggacucgucacacuguaccuuggcgugauggugcaggccgacucugggugcgucauuaacuggaaaggaagagaguugaaguguggcucagguaucuucguuacuaaugaagugcacaccuggacggagcaauauaaguuucaggcagauaguccgaaaaggcugagcgccgcuaucgggaaggccugggaggaaggagugugcggcauucgguccgcaacacgccucgagaacauaauguggaaacagaucucuaacgaacugaaucauauuuuacuggagaacgacaugaaguucaccguagucgugggugacguugcuggcauccuugugcaggggaaaaagaugauuagaccucaacccauggaauacaaauauucguggaagagcuggggaaaggccaaaaucauaggcgcggauguccagaauuccacuuuuaucauugacgggccaaacaccccugagugucccgaugaccagagggccuggaauaucugggagguggaagauuacggauucggcauuuuuacaacuaacaucugguugaagcuccgugacucauauacccagguuugcgaucaccggcugaugagugcugcaauaaaagacucuaaggccgugcacgcugauauggguuacuggauugagagcgaaaaaaaugagacauggaagcuagcccgagcauccuucaucgaaguaaagacguguauuuggccaaaaucacauacccuguggagcaacgggguccucgagucugagaugaucauacccaagauccacggaggcccuauuucccaacauaauuauagaccagguuacuucacucagacagcgggcccguggcaccuggggaaacuugaauuggacuuugaucugugcgagggaaccacugugguggucgacgaacacugcggcaacagggggcccaguuuacgcacaaccacgguuacuggaaagaucauucaugagugguguugccggagcuguacccucccuccacugagauucaggggcgaggaugguugcugguacgggauggaaauccgccccgugaaagagaaggaagagaaucuuguaaagucuaugguguccgccggaucaggcgaagucgacaguuuuagccuggguuugcucuguauaucgauuaugaucgaggaggugaugcgaucccgguggucucguaaaaugcugaugacaggcacccuagcuguuuucuuucugcucaucauggggcagcugacuuggaacgaccuuauuagauugugcaucauggugggagccaaugcaagcgauaggaugggcauggggacaaccuaucuggcuuuaauggccacauucaagaugcgcccuauguuugcagucggacuccuguuccggagacuuacuucaagggaagugcugcuacucaccauuggccugaguuugguugccuccguggagcugccaaacucuuuagaagagcucggugacgggcuggcuaugggaauaaugauccuuaaacuguugacggauuuucaaagcuaccagcucugggcgacacugcuaucccugaccuucauuaagacuaccuuuucacuucacuaugccuggaaaacaauggcaaugguccucagcaucguaagucuguuccccuugugucugucuacuaccucccagaagacgacaugguuaccggugcuccugggcagccuuggcugcaagccucugaccauguuuuugauugcugaaaauaaaaucugggggcgaaagucguggccacucaacgagggaauaauggccguugguaucgugucaauucugcuaucuagucugcuuaaaaacgacgucccccucgccggcccucugaucgcugggggaauguugauugcauguuacgugaucuccggcagcucugccgauuuaagccuggagaaggcggcugaaguauccugggaggaagaggccgaacauucaggugcaagucacaauauacucguggagguccaggacgaugggacuaugaaaauuaaggacgaggaacgcgaugacacacugaccauccuucugaaagccacuuugcuagcuguuagcggaguguauccccugucuaucccagcaacacucuucguguggcauuucuggcaaaagaagaaacagcgguccggcguccugugggauaccccuucacccccagagguggaaagagccguucuugacgauggcauuuacaggauaaugcagcguggguuacugggacgcagucagguaggugugggcgucuuucaagagaacguguuccacacgauguggcacguuacucggggggcggugcucauguaucagggaaagagauuggagccgagcugggcuuccgucaaaaaggaccugaucucuuacggcgguggguggagguuucagggaucguggaauaccggcgaagaggugcagguaauugccgucgaaccuggcaaaaaccccaagaaugugcaaacagcaccagggaccuucaagacacccgagggagaaguuggugccaucgcucucgacuuuaaaccuggcacuagcgggucaccaauugugaaccgagagggaaagaucgucggccuguacgguaauggggugguuaccacguccggaacauaugugagugccauagcacaggcuaaagccucucaggagggcccccuuccugaaaucgaggaugaagucuuccggaagcgcaaccugacuauuauggacuugcauccgggcagcgggaaaaccagaagguaccuaccagcgaucgugcgggaggccauuaagcgaaagcugagaacacucaucuuagcacccacccgcguaguggcuuccgaaauggccgaggcucugaaaggaaugccuauaagguaucaaacuaccgcaguuaagucagagcacacagguaaagaaauugucgaucuuaugugccaugccacguuuacuaugcgucugcucucuccagugcgggugcccaauuacaacaugaucaucauggacgaggcccacuucaccgauccuagcaguauugcugcgagaggcuauaucuccacaagggucgggaugggagaagcagccgcuauauuuaugaccgccacuccgcccggcagcauggaggcauucccacagucuaaugccguaauucaggacgaagagcgcgauaucccugagcgaucauggaacuccgguuacgaauggauuacagacuuucccgggaagaccgugugguucguuccaaguaucaaagcuggaaaugauauagcgaacuguuugagaaagaauggcaagcgggugauucagcugagcaggaaaacguucgacacugaguaucaaaagacaaaaaacaacgauugggacuacgucgugaccaccgacaucucggaaaugggcgccaauuuucgcgcagaucguguuaucgacccuagacggugccucaagcccgugauucugaaagaugggccagagagggucauccuugcuggaccgaugccugugacuguagccucugcagcccagcgccgagguagaauuggccggaaccauaauaaggagggggaccaguacauauauaugggacagccccuaaacaaugaugaagaccacgcucacuggacagaggccaagaugcuguuggauaacaucaauaccccagaaggcauuauccccgcguuauucgagccugaaagggagaaauccgcagccaucgacggugaguaccgccugagaggggaagcuaggaagacauuuguggagcucaugcggcguggcgaucugccaguuuggcuuagcuauaaagucgccucagaaggauuccaauacagugaccgccgauggugcuuugauggcgagagaaacaaucaggugcuggaagagaacauggacguggagauuuggacuaaggaaggggagaggaaaaagcuccggccccgcugguuggaugcuagaacguauucugacccucuggcacuaagggaauucaaagaguuugccgcuggacggcgauccgucagcggugaccugauacucgaaaucggcaagcuuccgcagcaucugacccagagagcccaaaaugcauuagauaacuugguuaugcugcacaauucagagcaggggggacgcgcguacaggcaugccauggaggaacucccagacacaauugagacucugaugcuucuggcucucaucgccguguugaccggcgguguaacacuguucuuuuuaagugggaagggccuaggaaaaaccagcauuggccugcucugugugauggcauccucuguccuucuguggauggcuagcguggaaccccacuggaucgccgcauccauaaucuuggaguucuuucugaugguucuccugauuccugagcccgaucggcagcguacuccacaggacaaccaacuugccuauguggucaucgggcuccuguucaugauuuugacgguagcugcgaaugaaaugggacuguuagagaccacaaagaaagaucuagguaucggccacguggccguugaaaaccaucaccaugcagcuaugcuggacguggaucuccacccugccucagccuggacucuuuacgcagucgcuaccacaauaauuacccccaugaugagacauacuaucgagaacacaacggccaauauuucucugaccgcgaucgcuaaccaggccgcaauauugauggggcuggacaagggauggccaaucaguaaaauggauauuggcgugccucuccuggcccuugguugcuacucgcaggucaauccguuaacucugacagcugcagugcucauguugguugcccacuaugcgaucauugggcccggccugcaagcuaaggccaccagggaagcacagaagcgcaccgccgcuggaaucaugaaaaacccaacaauagacggcauuguggccaucgaucuagacccuguaguguacgaugcaaaguuugagaaacagcuggggcagaucaugcuccuuauucuguguacuagccaaaucuugcugaugcggacgaccugggcucucugcgaguccauaacacuggccacuggacccuuaaccacacuuugggaaggcucuccagguaaguucuggaauaccacuauugcggucucaauggccaacaucuuccgagggagcuaucuggcaggagcuggccucgccuuuucccuaaugaaaagucuggguggcgggagaaggggaacgggcgcacagggggagacauugggagaaaaguggaagcgccagcugaaucagcucucuaaaagcgaguucaacaccuacaagcggucaggcauuauggaaguugacagauccgaggcuaaagagggucuuaagcguggggaaacuaccaaacacgccgugaguaggggaacagccaagcugcggugguuugucgagcgcaauuuggugaagccugaaggcaaaguaaucgaccuggguuguggccgagggggauggagcuauuacugcgcgggccucaagaaagugacugagguuaagggguauaccaaaggaggccccggucaugaagagccgauaccaauggcuacauacggguggaacuuagugaagcugcacucuggaaaagaugucuucuuuaucccucccgagaagugugacacgcuucugugcgauauuggcgaauccucaccaaaucccaccaucgaggaaggcagaacucuaagggugcucaagauggucgagccuuggcugcgggggaaccaauucuguauuaaaaucuugaauccguacaugcccagcgugguugagacacuggaacagaugcagcgcaagcauggagguaugcucguaagaaacccacuuucgaggaauucuacccacgagauguauugggugaguugcggcacugggaacauugucuccgcaaucaauaugacaagccgaaugcuguuaaaccgguuuaccauggcccaccguaaaccuacguacgaaagagacguggaucugggagcuggcacccgccauguugccguggagcccgaagucgcaaacuuggacauaauuggucagaggaucgagaauaucaagcacgagcauaaaucaacauggcacuaugaugaagacaacccuuacaagacuugggccuaucauggguccuacgaggugaagccaucuggaagcgcuaguuccaugguaaauggcgugguuaaacuccugaccaagcccugggaugucauuccuauggugacacaaauagcgaugacugacaccacaccauucggccagcagcggguguuuaaagaaaaggucgauaccagaacucccaaagccaagcgcgggacggcacaaaucauggagguuacagcuagguggcuauggggauuccuuagccgaaacaagaaaccgcggauuuguaccagagaagaguuuacuaggaaggugcgcucuaaugccgcaaucggugccguauucguggacgagaaccaguggaauucagcuaaagaagccgucgaggacgaucguuuuugggaccuggugcaccgggaaagagagcuccacaagcagggcaaaugcgcgaccugcguuuauaacaugauggggaagagggaaaagaaacugggagaguucggcaaggcaaaagguagucgcgccauuugguacaugugguugggggcucgauuccuggaguuugaagcccucggauucaugaaugaggaucauugguuuucccgggaaaacagccuuucuggcguggagggcgaggggcugcacaaguuaggauacauccugagagacauaucgaaaaucccugguggcaauauguaugcagaugacacagcugggugggauacgaggauuaccgaagacgauuugcagaacgaggccaagaucacugacauuauggaaccagagcaugcucuccuggccaaaucaaucuucaagcuaacauaccaaaauaaggucgugcgcguacagagacccgcaaaaaacggaaccguuauggaugugauaagccggagggaccagcguggcuccggucaggucgggacuuauggacuuaauacauuuaccaacauggaagcgcaacugauucgacagauggagagugagggcaucuuccucccuaacgaacuggagacaccaaauuuggccggccgcguguuagauuggcuggaaaaguacgggguggagagacucaaacggauggcuaucucuggagacgacugugucguuaagcccauugaugacagguuugccacugcacuuaccgcucugaacgauauggguaaagugcgcaaggacauaccgcagugggaaccuagcaagggcuggaaugauuggcagcaaguacccuucugcucccaccacuuucaucagcuaaucaugaaagacgggagagagauuguggucccaugucggaaccaggaugagcuggugggaagggcccgaguuucacagggcgcagguuggagucuccgugaaacggccugcuuggggaagucuuaugcgcaaauguggcagcugauguacuuccacagacgcgaccuucggcuggcugccaaugcaaucuguagcgccgugccugucgauugggugcccaccuccaggacaacuuggucaauucaugcucaccaucaguggaugaccacagaggacaugcucagcguauggaacagaguuuggaucgaagagaauccauggauggaagauaaaacucgcauaucuuccugggaggacgugcccuauuuaggaaagcgggaggaccaauggugcggcagucugaucggcuugaccgccagggcaacgugggcuacaaacauucaggucgccaucaaucaggugcgaagacugauugggaacgaaaauuacagcgauuacaugaccucgaugaaacgguuuaagaacgaguccgaaccugagggagcgcucugguga

SEQ ID NO: 13927 - RNA, 9879 nt, Artificial Sequence
  derived and/or modified CDS sequence (opt3) from DENV-1__GU131750__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacuaauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuauugagaaagcggcugaggugagcugggaagaggaagccgagcauuccggggcaucacacaauaucuuaguagaagugcaggaugacggaaccaugaagaucaaagaugaggagcgcgacgauacucugacaauucuccugaaggccacccuucuggcugucaguggcguuuaucccuugagcauaccagcaacgcuauucgugugguacuucuggcagaaaaagaagcagcggucuggcgugcugugggacacuccuucacccccagaagucgggagagccgugcucgaugacggaaucuauaggauuaugcagcguggucugcuuggccgcagccagguugggguaggaguguuucaagagaacgucuuccauaccauguggcacgugacacggggcgcgguuuuaauguaccaggguaaaagacuggaaccgaguugggcuagcgugaagaaagaccucaucuccuacgggggaggcuggagguugcagggcucuuggaauaccggggaggagguccaggugauugccguagaaccuggaaagaaccccaaaaauguccaaacagcaccagguacuuuuaagacccccgagggcgaagugggggccaucgcucuggauuucaagccuggaacgucgggcagcccaauaguuaaccgagaggguaaaaucguggggcucuauggaaauggcgucgugacaacuucaggcaccuacguuuccgccauugcacaggcuaaggccagucaggaagggccccugccugagaucgaggacgaaguguuucggaaacgcaaccuuacaauuauggaucugcacccgggaucugguaagaccagaagguauuugccagcgaucguccgggaggccauaaaacgaaagcuaagaacucugauucucgcacccacccgcgugguagcuagcgaaauggccgaggcuuuaaagggcaugccuaucagguaccaaacaacggcagugaaauccgaacauacugggaaggagaucguugaccugaugugccacgccaccuucacaaugcgucuucugucaccaguccgggugcccaauuauaacaugauuaucauggaugaggcccauuuuaccgacccuucuagcauagcugcgagaggauacauuaguacuagggugggcaugggugaagcagccgcuaucuucaugacagccaccccgcccggguccgucgaggcauuuccacagagcaaugccguaauucaggaugaggaacgcgacaucccugaacgaucuuggaacucaggauaugaguggauaacggauuuccccggcaaaacugugugguuuguuccauccauuaagaguggcaaugacaucgcuaacugucucaggaaaaaugggaagcgggugauccaguugagcaggaagacauucgauaccgaguaccagaaaaccaagaacaacgacugggacuacgucgugacuacagauauuucggaaaugggagcgaauuuccgcgccgaccguguuaucgauccuagacggugccugaaacccgugauucucaaggacgguccagagagggucauacuggcaggcccgaugccugugaccguagcuucugccgcacagcgccgagggagaaucggacggaaccacaauaaagaaggcgaucaguauauuuacaugggucagccccuuaacaaugacgaggaucaugcccacuggacagaggcuaagaugcuacuggacaacaucaauacuccagaagggaucauucccgccuuguuugagccugaaagggagaaguccgcggcaauagauggcgaauaucgcuuaagaggagaggccaggaaaacguucguggagcugaugcggcguggcgaccucccaguuuggcugagcuacaaggucgcuucagaaggguuucaauauagugaucgccgauggugcuucgacggagagagaaacaaucaggugcuugaagagaacauggauguggaaaucuggaccaaagagggugagaggaagaaacugcggccccgcuggcucgacgccagaacauacucugacccuuuggcucugagggaauuuaaggaguucgcagccggccggcgauccgucagcggggaucuaauucuggaaaucggaaaacucccgcagcaccuuaugcagagagcucaaaaugcccuggacaacuuaguuauguugcauaauucagagcagggcggucgcgcauauaggcacgcgauggaggaacugccagauacuauugagacccucaugcugcuugcccugaucgcugugcucacagggggcguaaccuuguuuuuccugaguggacggggcuuagggaagacuagcauaggacuacugugugugauggccuccucuguccuccuuuggauggcaagcguggaaccccauuggaucgcugccuccauuauccuggaguuuuucuugaugguucugcucauuccugaacccgaccgucagagaacgccacaggauaaccaacuggcauacguggucaucggucuucucuuuaugauacugaccguagccgcuaaugagaugggcuugcuggagacaacuaagaaagacuuagggauuggacacguggcgguugaaaaccaccaucacgccgcaaugcuagauguggaccugcauccugcuucagccuggacccucuacgccgucgcaacaaccaucauuacucccaugaugaggcacacaaucgagaacacgaccgcuaauauaucucuuacugccaucgcgaaccaggcugccauucugaugggcuuggauaaggguuggccaaucaguaaaauggacauuggggugccucugcucgcacugggcugcuauucgcaggucaauccgcuuacauuaaccgccgcugugcugaugcucguugcacauuacgccaucauaggacccggcuugcaagcgaaggcuacccgcgaagcccagaaacggacagcagccgggauuaugaagaacccaacuguggauggaaucguagcuaucgaccuggauccuguggucuaugacgccaaguucgagaaacagcuaggccagauuaugcugcucauccuuuguacgagccaaauacuguugaugcgaaccacaugggcacugugcgaauccauuacucucgcuaccgguccccugacaaccuuaugggaggggucuccaggaaaguuuuggaauacuacgaucgccguuucaauggcgaacauuuucagaggcagcuaccuugccggugcaggccuggcuuucucccucaugaaaagucuagggggaggcaggcgcgggacaggagcccagggcgagacccugggugaaaaguggaaacggcaguugaaucagcugucuaagagcgaguuuaacacuuauaagagaucagggaucauggaaguggaccguuccgaggcaaaagaaggacucaagaggggcgagaccacaaaacacgcugucagucgggguacugccaaacuucgcugguucguggagcgaaaucugguaaaaccugaaggcaaggugauagauuugggguguggaagaggcggguggagcuacuauugcgccggacugaagaaaguuaccgaggugaagggcuacacaaaaggugggcccggacacgaggagccgaucccaauggcgacguacggcuggaaccucgucaaguuacauucuggcaaagacguguuuuucauuccucccgaaaagugugauacccugcuuugcgacaucggggaguccucaccaaaucccacuauugaggaaggaaggacacugcggguccuaaaaaugguggagccuuggcuccgcgguaaccaauuuuguaucaagauucugaauccguauaugcccagcguuguagaaaccuuggagcagaugcagagaaagcacggcgggaugcuggugaggaacccacucucgcgaaauucuacucaugagauguacugggucaguugcggaacaggcaacaucguguccgcuguuaauaugaccagccggaugcuucugaaccguuucacgauggcacacagaaaaccuaccuaugaacgcgauguggacuuaggugccgggacaaggcacgucgcuguggagcccgaaguagccaaccuggauauaauuggacagcggaucgagaauaucaagcaugaacacaaaucaacuuggcauuacgacgaggauaacccuuauaagaccugggcauaccacggcuccuaugaggugaaaccaucuggcagcgccaguuccaugguuaauggggucgugaaguugcucacaaagcccugggacgugauuccuauggucacucaaauagcuaugaccgauacaaccccauuuggacagcagagaguuuucaaagaaaagguggacacucgcacgcccaaagcgaagagggguacagcccaaaucauggagguaaccgcaaaauggcuguggggcuuucuaagccgaaacaagaagccgcggauuuguacuagagaagaguucaccaggaaagugcgcucuaaugcugccaucggggcagucuuuguggacgaaaaccaguggaacucagccaaggaggcuguugaggaugaacguuucugggaccuugugcaucgggagagagaacugcacaaacagggaaagugcgccacaugcgucuacaacaugaugggcaaaagggagaagaagcucggugaauuugggaaagcgaagggaagucgcgcaauuugguacauguggcugggcgcccgauucuuggaguucgaggcucugggcuuuaugaaugaagaucacugguucucccgggagaacagccucucugggguggaaggagagggucuucauaaacugggcuauaucuuaagagacauaucgaagaucccugggggaaauauguacgccgaugacacggcaggcugggauaccaggauuacugaggacgaucugcagaacgaagcucgcaucacagacaccauggagccagaacacgccuugcucgcuaaaucaauuuuuaagcugacuuaucaaaauaaaguaguuagagugcagcggcccgccaagaacgguacagucauggaugugaucagcaggcgugaccagcgaggguccggacaggugggcaccuacggccuaaauacauucacuaacauggaggcacaacuuauacgccagauggaaagugaggggauauuuucuccuagcgagcuggaaaccccaaaccucgcggagagaguccuggauugguuggaaaaguauggaguugagcgguuaaaaaggauggccaucuccggugacgacugugugguaaagcccaucgaugaccgcuucgcuacggcccugaccgcacucaaugauaugggcaaagugagaaaggacauuccgcagugggaaccuucaaaaggguggaacgauuggcagcaaguccccuuuugcagucaucacuuccaccagcuuauaaugaaggacggacgggagaucgugguuccauguaggaaucaggaugagcuggugggccgagcucgugucucucagggugccggguggagccuaagagaaacagcaugccugggaaaguccuacgcccaaauguggcagcucauguauuuucaucgccgggacuugaggcuggcggcuaacgccauuuguucagcagugccuguagauuggauccccacuagcagaaccacauggucuauucacgcccaucaccaguggaugacuaccgaggacaugcuuuccguuuggaaucgcguguggaucgaagagaacccauggauggaagauaaaacgcauauaaguagcuggggcgacguccccuaccugggcaagcgggaggaccaauggugcgggucgcucaucggauuaacagcuagggccaccugggcaacuaauauucagguggcuaucaaccagguucgaagacugauugguaaugagaacuacuuggauuauaugacauccaugaaacgguucaagaaugaaucugacccugagggcgcccugugguga

SEQ ID NO: 13928 - RNA, 9879 nt, Artificial Sequence
  derived and/or modified CDS sequence (opt3) from DENV-1__GU131751__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgauugccacaaucaccccccaggcgccuagcacugagauccaguuaaccgacuacggggcccugacacucgauuguucuccaaggaccggacuugacuuuaacgaaaugguccuguugacuaugaaggagaaauccuggcuagugcauaagcagugguuccuggaucucccgcugcccuggacaucaggcgcaagcacgagucaagagaccuggaaucggcaggaccuucugguaacuuuuaaaacagcucacgccaagaagcaggaaguuguggucuuggguucucaagagggggcuaugcacaccgcccucacaggcgcaacugaaauucagaccuccggaacgaccacaauauucgccggccaucugaaaugccguuuaaagauggauaaacugacucuaaaggggaugagcuaugugauguguaccggaucguucaaacucgagaaggaagucgcugagacacagcacgguacugugcugguucagaucaaguacgagggcaccgacgcgccuugcaaaauuccauuuucuacgcaagaugaaaagggggugacacagaacggacgccuuaucaccgcaaaucccauaguaacugacaaagagaagccugucaacauugaagccgagccacccuucggcgaguccuauaucgugaucggugcuggggaaaaagccuugaagcugucaugguuuaagaaaggcaguagcauuggaaagauguucgaggcaacagccagaggcgcuaggcggauggccauccucggggauaccgcaugggacuuuggauccauugguggcguuuucacuucuguggggaaacugguccaucagauauuuggaaccgcguacggcgugcuuuucagcgguguaucauggacaaugaagaucgggauuggcgugcuguugacguggcucggacugaauagucgauccaccagcuuaucuaugacuuguaucgcuguuggccuggucacacuauaccucggggugauggugcaggccgauucaggaugcgucaucaacuggaaaggccgcgaacugaagugugguagugggauuuuuguuaccaaugaggugcacacauggacugaacaauauaaguuccaggcagacagcccgaaaagacuuuccgccgcuauaggaaaggccugggaggagggcgugugcgguaucaggucugcaacccgguuggaaaacauuauguggaaacagaucucgaacgagcugaaucauauucuccuggaaaacgacaugaaguuuacgguagucgugggcgauguugcugggaucuuagcccagggaaaaaaggugauacgcccucaacccauggagcacaaauacagcuggaaguccuggggcaaggcgaaaaucauuggggccgacguccagaauacaaccuucaucauugauggaccaaacacuccugaaugucccgacgaucagagagcuuggaauaucugggagguggaggacuauggcuuugguauauucaccacaaacauuuggcugaagcuuagggauucauacacucagguuugcgaccaccguuugaugagugcagccauccgggauucuaaagcugugcaugccgacaugggguauuggauugaaagcgagaagaaugaaaccuggaaacucgcacgagcguccuucaucgagguaaagacauguauauggccaaagucacacacgcuguggagcaacggaguccuagaaucugagaugaucauucccaaaaucuacggcgguccuauuucccaacauaauuauagaccaggcuacuuuacccagacugccgggccguggcaccugggaaagcucgagcuggauuucgaccuuugcgaaggcacaaccgugguggucgaugagcacugcgggaacaggggacccaguuugcgcacuacaaccguuacgggcaaaaucauacaugaaugguguugccggagcuguacucugccuccauuaagauuuaagggugaggacgggugcugguacggaauggagauuaggcccgugaaagaaaaggaggaaaaucucguaaagucuaugguguccgcuggcucaggugaggucgacaguuucagccugggccuucuguguaucucgaucaugauugaagaggugaugcgcuccaaauggucucgaaagauguugaugaccgggacacucgccguuuuuuuccugcuaaucaugggacagcugaccuggaacgaucucauucggcugugcauaauggugggcgcaaaugcuagcgaccguauggggaugggaacuacauaucuugccuugauggcaaccuuuaaaaugagaccuauguucgccgucggccuguuauuuaggcgccucacaucacgggaggugcugcuucugacuaucggucuaagucucguugcuuccguggaacugccaaacucuuuggaggaacugggggauggauuagcgaugggcauuaugauccucaagcugcuuaccgacuuccaaagccaccagcugugggccacguugcucucccugacauuuauuaaaaccacuuucucacuacauuacgcauggaagaccauggcuaugguccugagcaucguaagucuuuuuccccucugucugucuacaacuucccagaagaccacgugguugccggugcuguuaggcagccucgggugcaaaccucugacaauguuccuuauagccgagaauaagaucuggggaagaaaaucguggccacugaacgaagguauuauggccguuggcaucgugucaauuuugcucucuagucugcuaaagaacgaugucccccuggcugggccucuuaucgcaggaggcaugcucauagccuguuaugugauuuccgguagcucugcggaccugagcuuggagaaagcugccgagguauccugggaagaggaagcagagcacucaggggccagucauaauaucuuaguggaaguccaggaugacggaaccaugaagaucaaagaugaggagagggacgauacucugacaauucuccugaaggcuacccuucuggcaguuagcggcguguaccccuugucuauaccagccacucuauucgugugguauuuuuggcaaaagaaaaagcagcgauccggcguccugugggacaucccuucacccccagaaguggagcgcgcgguucucgaugacgggauuuaccggaucaugcagagaggacugcuugguaggagucagguaggcgugggggucuuccaagaaaacguguuucacacaauguggcacguuacccguggagcuguguuaauguaucagggcaaacgccuggagccgagcugggccuccgucaagaaagaccucauuucuuacggugggggauggcgguugcagggcucguggaauacgggcgaggaagugcagguaaucgcagucgagccugggaagaaccccaagaaugugcaaacugccccaggaaccuucaaaacaagcgaaggugagguuggcgcuauagcccuggauuuuaagcccgggaccucaggauccccuaucgugaacagagaaggcaaaauugucggucucuacgggaauggagugguuacaacuaguggcaccuaugugucugcaaucgcucaggccaaggcgagccaggagggcccacugcccgagauugaagacgaggucuucaaaaagaggaaccuuacgaucauggaucugcauccuggguccggaaagacacgacgguacuugccggccauagugcgcgaagcaauuaaaagaaagcuaaggacucugauccucgcuccaacccggguaguggccucagagauggcugaagcauuaaaagguaugcccauccgauaucaaacaaccgccguuaagucugagcacacuggcaaagagauugucgaccugaugugccaugccaccuuuacaaugagacuucugagcccugugcgcgugccaaauuacaacaugaucauaauggaugaagcucacuucacggaccccaguuccauugcggcaaggggguauaucagcacucgugucggaaugggcgaggccgcugccauuuuuaugaccgcaacaccuccggguucuguagaagccuucccccagucaaaugcugugauccaggaugaggaacgggacauaccagagagauccuggaacaguggguacgaguggauuaccgauuuuccuggaaagacuguuugguucgugcccagcaucaagucgggcaaugacaucgcgaacugucucaggaaaaauggcaagcgcgucauucaguugucucgaaaaacauucgauaccgaauaucaaaagacgaaaaacaacgacugggacuacgugguuacuacagauaucuccgagaugggggccaauuuuagagcagaccgggugauugauccaaggcgcugccugaagccugucauacucaaggacggacccgaacgugugauccuggcugguccaaugccgguaaccguggccagcgcagcccagagacggggcaggauugggcgcaaccauaauaaagagggagaucaguacaucuauaugggccagccucuuaacaaugacgaggaucacgcucacuggaccgaagccaagaugcuacuggacaacaucaauacucccgaggguauuauaccagcguuguucgaacccgagcgagaaaaaucagcagccaucgauggggaguacagauuacggggcgaggcuaggaagacauuuguugaacugaugcgcagaggagaccucccugucuggcugaguuauaaaguggccucugagggcuuccaauacuccgauaggcgguggugcuuugacggggaacguaacaaucaggugcuugaggaaaacauggaugucgagauuuggaccaaggagggagaacgcaaaaagcugcgaccaagauggcucgacgcuaggacauauagcgaccccuuggcacugcgggaguucaaggaauuugccgcuggucgcagaucaguuaguggcgaucuaauccuggagauugggaaacucccucagcaucuuacucagagggcccaaaaugcacuggacaacuuagugauguugcacaauagcgaacagggaggccgggcguaccgacaugccauggaggagcugccggauacgaucgaaacccucaugcugcuugcucugauagccguacucacagguggggugacuuuguucuuucuguccggcagaggauuaggcaagaccucuaucgggcuacugugugucauggcaagcuccgugcuccuuuggauggcuucaguugagccacacuggauugccgcaucuaucauucuggaauucuuuuugauggugcugcucauccccgagccugaccgccagaggacaccccaggauaaccaacuggccuaugucguaauaggacuucucuucaugauucugaccguggcugcgaaugagauggguuugcuggaaacuacgaaaaaggacuuaggcaucgggcacguugccguggagaaccaucaccaugcagcuaugcuagaugucgaccugcacccagccagugccuggacccucuacgcaguggcuacaacuauuaucaccccuaugaugcggcauacaauagaaaacaccacugccaauaucucgcuuacagcgauugcuaaccaggccgcaauccugaugggauuggauaaaggcuggcccauuagcaagauggacaucggugucccacugcucgcccuggggugcuacucccaggugaauccucuuacguuaaccgcuacuguucugaugcucguggcacacuaugccauaauuggcccgggauugcaagcgaaggcuacacgugaggcccagaaaagaaccgcagccggcaucaugaagaaccccaccguagaugggaucguggcuauugaccuggauccagucguuuacgacgccaaauuugaaaagcagcuaggacagaucaugcugcucauacuuuguacaucucaaauucuguugaugaggacuacgugggcacugugcgagucaaucacccucgcuacaggcccucugacuaccuuaugggaggguagccccgggaaauucuggaauacaaccauugccguguccauggcgaacaucuuccgcggaaguuaucuugccggcgcaggucuggcuuuuucucucaugaagagccuaggcgggggacggcgaggcacuggggcccagggagaaacgcugggcgagaaguggaaaagacaguugaaucagcugucaaaguccgaauucaacacauacaaaaggagugguauaauggaggucgaccgcagcgaagcaaaggaggggcucaaacggggagagaccacuaagcacgcugugucuagaggcaccgccaagcuucguugguuuguagaaaggaaucuggugaaaccagaggguaagguuaucgauuugggcugugggcggggaggcugguccuauuacugcgccgggcugaaaaaggugacagaagucaaaggauauacuaagggcgguccugggcaugaggaacccauuccgauggcgaccuacggauggaaccucgugaaauuacacucaggcaaggacgucuucuuuaucccaccugagaagugugauacacugcuuugcgacauuggcgagagcucgcccaauccaacgaucgaagaggggcgcacccugcgagugcuaaaaaugguugaacccuggcucagaggaaaccaauucuguauuaagauccugaauccuuacaugccgucuguaguggagacuuuggagcagaugcagaggaaacaugguggcaugcugguccggaacccccucagucgcaauuccacacacgaaauguauugggugagcugcgggaccggaaacauaguuucagcugugaauaugacuuccagaaugcuucugaacagguuuacaauggcacaccgaaagccaaccuacgagcgggaugucgacuuaggcgccgguacgcgucauguggcuguagaaccugagguggccaaccuggauauuaucgggcagagaaucgaaaauauuaaacacgagcauaagucuaccuggcacuaugacgaggauaaccccuacaagacaugggcauaucauggaagcuacgaaguuaaaccuaguggcuccgccagcucuauggucaauggcguggugaaguugcucacuaaaccaugggacgucauacccaugguuacccaaaucgcuaugacagauacuaccccuuucgggcagcagcgcguguuuaaggagaaaguagacacaaggaccccaaaggcgaagcggggaacugcccaaauuauggaagugacggcaaaauggcugugggguuuccuaucaagaaacaagaaaccccgcaucuguacaagggaggaauuuacccgaaagguccggaguaaugcugccauuggcgcaguguucguugacgagaaccaguggaauuccgccaaagaggcuguggaagaugagagauuuugggaccuuguccacagggaacgcgagcugcacaagcaggggaagugcgccacuugcguguauaacaugaugggaaaacgugaaaagaaacucggcgaguucgguaaggcgaaagggagccgggcaaucugguacauguggcugggagccagauucuuggaguuugaagcucugggcuucaugaaugaggaucauugguuuucuagggaaaacucgcucucaggcguagagggggagggacuucacaagcuggguuacauauuacgcgacaucagcaaaauuccgggcgggaauauguaugccgaugacaccgcaggaugggauacacgaaucacggaagacgaucugcagaacgaggcuaagauuaccgacaucauggaaccugagcaugccuugcucgcuaaguccauauucaaacugacuuaccaaaauaagguugugcggguccagagaccagccaaaaacggcacagugauggaugugauuaguaggcgcgaccagagagguucugggcaggucggaaccuauggccuaaauacuuuuacaaacauggaagcacaacuuauccggcagauggagagcgagggcaucuucucccccucagaacuggagaccccuaaccucgcggggaggguucuggauugguuggaaaaguacggaguggagcguuuaaaacgaauggccauuaguggugacgacuguguagugaagccaauagaugaccgcuuugcuacagcccugacugcacucaaugauaugggcaaggucagaaaagacaucccccagugggaaccgucuaagggguggaacgauuggcagcaagugccuuucugcagccaccacuuucaucagcuuauuaugaaagacggacgggagaucguugugcccuguaggaaucaggaugagcuggucggccgcgcuagagugucccagggugccggguggucacuacgggaaaccgcaugccugggaaagagcuaugcccaaauguggcagcucauguacuuccacaggcgagacuugcgucuggcggcuaacgccauuuguucugcaguaccaguugauugggugccuacguccagaaccacauggaguauccaugcccaccaucaguggaugacuaccgaggacaugcuuagcgucuggaaucgcguguggauagaagagaaccccuggauggaagauaaaacacacaucucguccuggggcgacguuccauaucugggcaagcgggaggaccaauggugcgggucucucauuggauuaacugcuagggccaccugggcaacgaauauccagguggcuauuaaccaggucagacgccugaucgguaaugagaacuacuuggauuacaugacaucaaugaagcgguuuaaaaaugaaagcgaccccgagggcgcccugugguga

SEQ ID NO: 13929 - RNA, 9879 nt, Artificial Sequence
  derived and/or modified CDS sequence (opt3) from DENV-1__GU131753__SS-prME
agcgugaccaugcugcucaugcuuaugcccacggcacuggcuuuccacuugacuacgagaggaggggaaccucauaugaucgucaccaagcaggaaagggggaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuaccgcacuguuucuggcccaugcuauuggcacgucuaucacucagaagggcauuaucuucauacucuuaaugcuggugacaccaucgauggccaugcgcugcgucgggaucggaucaagagauuuuguggagggucuuagcggcgcgaccuggguagacguuguguuggagcacgggaguugugucacuacaauggcaaaggauaaacccacccuggacauugaacuacucaagacggaggugaccaacccugccgugcugaggaaacuuugcaucgaagcuaagauuuccaauacaacuaccgauucucgguguccaacacaaggagaggccacucugauggaagaacaagacgcaaacuucgucugccgccgaaccuuuguugauagaggcugggguaauggguguggauuguucggcaaaggcagccucaucacaugcgcuaaguuuaagugcgugaccaaacuggaggggaagauaguacaguacgaaaacuuaaaauauuccgugauugucacugugcacacgggagaccagcaucaaguugguaaugagucaacagaacacggcaccacugccaccaucacaccccaggcgccuaccagugagauucagcugacugacuacggggcccucacacuugauuguagcccaaggacgggacuggacuucaacgaaaugguguugcuaaccaugaaggagaaaucuuggcugguccauaagcagugguuucucgaucugccgcuucccuggacuuccggcgcaucaacaagccaagagaccuggaaucggcaggaccuguuggugacauucaaaacugcucacgccaagaagcaggaaguaguugugcucgguagucaagagggggcuaugcacaccgcccugacgggcgcaaccgaaauccagacaucuggaacuaccacaaucuuugccggccauuuaaaaugccgucugaagauggauaaacuaacucucaaggggauguccuaugucauguguaccgggucguucaaacuggagaaggaaguggcugagacgcagcacgguacaguccuugugcagauuaaguacgagggcaccgacgcgccuugcaaaauaccauucucgacucaagaugaaaaggggguuacacagaacggacgcuugaucaccgcaaaucccauuaucacugacaaagagaagccugugaacauagaagccgagccacccuuuggcgagucuuauauuguaaucggugcuggggaaaaagcccugaagcucuccugguucaagaaaggcucaaguaucggaaagauguuugaggcaaccgccagaggcgcuaggcggauggccauucugggggauacagcaugggacuucggaagcaucgguggcgucuuuacguccauugggaaacuugugcaucagauauucggaaccgcguacggcguucuguuuucuggugugagcuggacuaugaagaucgggauuggcgucuugcucacauggcugggauuaaauucacgaaguaccucccugagcaugacauguaucgcugugggccuaguaacucucuaccugggggugaugguucaggccgauucuggaugcgucaucaacuggaaaggccgcgaacuuaagugugguucagggauuuucgugaccaaugaggugcacacguggacagaacaauauaaguuucaggcagacaguccgaaaagauugagcgccgcuauaggaaaggccugggaggagggcgucugcgguaucagguccgcaacccggcuggaaaacauuauguggaaacagaucucuaacgagcucaaucauauucuguuagaaaacgacaugaaguucacuguuguggugggcgauguagucgggauccuggcucagggcaagaagaugauacgcccucaacccauggagcacaaauacucguggaaaagcuggggcaaggccaagaucauuggggcggacgugcagaauaccacauuuaucauugauggaccaaacacuccugaaugucccgacgaucagagagccuggaauaucugggagguugaggacuauggcuucgguauauuuaccacaaacauuuggcuuaagaugagggauuccuacacacaggugugcgaccaccguuugaugucagcugcaaucaaagauaguaaggccguccaugcugacaugggguauuggauugaaucugagaaaaaugaaaccuggaagcucgcccgggcauccuucaucgaggugaagacuuguauauggccaaaaucccacacacuguggucaaacggaguucuagaaagcgagaugaucauucccaagaucuacggcgguccuauuucucaacauaauuaucgaccaggcuacuucacccagacugcggggccguggcaccugggaaaacucgagcuggauuuugaccuuugcgaaggcacaaccgugguagucgaugagcacugcgggaacagaggacccuccuugaggacgacuaccgugacaggcaagaucauacaugaaugguguugccgcaguuguacccugccuccauuacgguucaaaggugaggacgggugcugguacggaauggagauuagacccgugaaggaaaaggaggaaaaucucgucaaaagcaugguuucugccggcuccggugagguggacucauuuagucugggccuucuguguaucagcaucaugauugaagagguaaugaggucgcgcuggucccgaaagauguugaugacugggacacucgcuguguuccugcuacugaucaugggacagcucaccuggaacgaucugauucggcuuugcauaauggucggcgccaaugcaucugaccguauggggaugggaacaacuuauuuggcucugauggccaccuuuaaaaugagaccuauguucgcagugggcuuacucuuuaggcgccugacgagccgggagguucuucugcuaacaaucggucucucacugguggccagugucgaauugccaaacucccuggaggaauuaggggauggacucgcuaugggcauuaugauccugaaacuucugaccgacuuccaaucucaccaguugugggcgacucuccugagccuaaccuuuauuaaaacaacucugucccuucauuacgccuggaagaccauggcaauggugcucucaaucguuagccugauacccuugugucugaguacgacaucucagaagaccacuugguuaccggugcuccugggcucccuugggugcaaaccucugacaauguucuugaucgcugagaauaagauuuggggaagaaaaagcuggccacucaacgaagguaucauggccgucggcguagugucgauucugcuaucaucucugcuuaagaacgauguuccccucgccgggccucugaucgcuggaggcauguugauagcauguuaugugauuagugguuccagcgccgacuuaucucuggagaaagcggcugaggucagcugggaagaggaagccgagcacuccggggcaucacauaauauccucguggaaguacaggaugacggaaccaugaagaucaaagaugaggagagggacgauacucugacaauucuucugaaggccaccuugcuagcugugaguggcgucuacccccugagcauaccagcaacgcucuuuguuugguauuucuggcaaaagaaaaagcagcgaucuggcgugcugugggacacuccuucacccccagaaguggagcgcgccguccuugaugacgggaucuaccggauuaugcagagaggauuacuggguaggagccaggugggcguugggguauuucaagaaaacguguuccacaccauguggcacgucacacguggagcggugcucauguaucagggcaaacgcuuggagccgaguugggcuagcguuaagaaagaccugaucuccuacggugggggauggcggcuccagggcucuuggaauaccggcgaggaagugcaggucauugccguggagccugggaagaaccccaagaauguacaaacagcaccaggaacuuucaaaacccccgaaggugaggucggcgccaucgcucuggauuuuaagccugggacgucgggaagcccaauagugaacagagaaggcaaaaucguuggucuuuacgggaauggaguggucacaacuucaggcaccuauguguccgccauugcacaggcuaaggccagucaggagggcccccugccugagaucgaagacgagguuuucaggaaacgaaacuugacaauuauggaucuacauccggggucuggaaagacccggcgcuaccugccagcgaucgugagagaagccaugaagaggaaacuccggacuuuaauacuggcacccacccgagucguggcuagcgagauggccgaagcucuuaaggguaugccuauuagauaucaaacaacggcaguaaaauccgagcacacuggcaaggagaucguggaccugaugugccaugccaccuuuacaaugcgccucuugucaccaguuaggguccccaauuacaacaugaucauuauggaugaagcccacuucaccgacccuucuagcaucgcugcgcguggguauauaaguacucgggugggaaugggcgaggcagccgcuauuuuuaugacagccaccccgcccgguuccguggaagcauucccacagagcaaugccgucauccaggaugaggaaagagacauuccugagaggucuuggaacucaggguacgaguggaucacggauuuucccggaaaaacuguaugguucgugccauccauaaagaguggcaaugacauugcuaacugucugcgcaagaauggcaaacgaguuauccagcucagcagaaagacauuugauaccgaauaucagaagaccaagaacaacgacugggacuacguggucacuacagauaucucggagaugggggcgaauuuccgggccgacagggugauugauccucgccguugccugaaacccguuauccuuaaggacggaccagaaagagugauucuagcagguccgaugccugucaccguggcuucugccgcacagcggaggggccgcauagggcgaaaccauaauaaggagggagaucaguacaucuauaugggccagccccugaacaaugacgaggaucacgcccacuggacagaagcuaaaauguuguuagacaacauuaauacuccagaggguaucauccccgcccuguuugaaccugagagagaaaaguccgcggcaauugauggggaguaccggcucaggggcgaggcccgcaaaacguucguagaacugaugagaaggggagaccuuccaguguggcugagcuauaagguugcuucagagggcuuccaauacagugaucggcguuggugcuuugacggggaacgcaacaaucagguccucgaggaaaacauggauguggagauauggaccaaagagggagaacgaaagaaauugagacccagguggcuggacgcccggacauauucugacccucuagcucugcgcgaguucaaggaauuugcagccgguagaagguccgugagcggcgaucucauccuugagauugggaagcugccgcagcauuuaacucagcgggcucaaaaugccuuggacaaccuggucaugcuccacaauucagaacagggaggccgagcauacagacaugcgauggaggagcugccagauaccaucgaaacacuuaugcugcucgccuugauugcuguucugaccgguggggugacuuuauucuuucuaaguggccgcggacugggcaaaacgagcaucgggcuccuuuguguaaccgccuccucugugcuguuguggauggcaagcgucgagccccacuggauagcugccuccaucauucuggaguucuuucucauggugcugcuuaucccugagcccgacaggcagcggacaccacaggauaaccaacucgcauauguugugauuggacuguuguucaugauccugacugucgccgcuaaugagauggguuuacuagaaaccacaaagaaagaccugggcauagggcacguagcgguggagaaccaucaccaugccaccaugcucgauguugaccuucacccugcaucagcuuggacucuguacgccguggccacaacgauuaucacccccaugaugcgucauacuauugaaaacacaaccgcaaauaucucuuugaccgcuauagccaaccaggcggcuauccugaugggacucgauaagggcuggccaauuaguaaaauggacaucggugucccucugcuugccuuagggugcuacagccaggugaauccgcugacacucacugcagccgucuugaugcugguggcucacuaugcaauuaucggccccggacuacaagccaaggcgacgagagaggcucagaagaggaccgccgcaggcauaaugaaaaacccaacaguugaugggauuguggccaucgaccuggauccuguaguguacgacgcuaaguuugaaaaacagcucggacagaucaugcuucugauuuuguguacuagccaaauccugcucaugcgcaccacaugggcccugugcgaguccauaaccuuagcaacuggcccccuuacgacacugugggaggguucuccagggaaguucuggaauaccacuauugcugucucaauggccaacaucuuucggggaagcuaucucgcgggcgccggucuagcauucucccugaugaaaaguuugggcgggggacgaagaggcaccggggcucagggagaaacacugggcgagaaguggaagaggcagcucaaucagcuuucuaaaagcgaauuuaacauuuacaagcgcucagguaucauggagguugaccgguccgaagccaaagaggggcugaagagaggagagacuaccaaacacgcagugagucguggcacagcuaaguugaggugguucgucgaacggaaucuggugaagccugaggguaaaguaauagaucucggcugugggcgcggaggcuggagcuauuacugcgccggguuaaagaaagugacggaaguuaagggauauaccaaaggcggucccgggcaugaggaaccgaucccaauggccacuuacggauggaaccuggugaaacuucacucuggcaaagacgucuucuuuacaccucccgagaagugugauacccugcuaugcgacauuggcgaguccucaccaaaucccacuaucgaagaggggcgaacacucagagugcugaagauggucgaaccuugguugaggggaaaccaauucuguauuaaaauccugaauccguacaugcccagcgugguugagacccucgagcagaugcagcggaagcaugguggcaugcuuguacgcaacccacugucgagaaauucuacgcacgaaauguauugggugaguugcgggaccggaaacauugucuccgcggugaauaugacaagcaggauguuacugaaccgauuuacuauggcucaccggaaaccuaccuacgagaaggauguugacuugggcgcagguacacgucauguggccgucgaacccgagguggcuaaccucgauaucauagggcagagaauugaaaauaucaaacacgagcauaagucaacuuggcacuaugacgaggauaacccuuacaagaccugggccuaucauggauccuacgaaguaaaaccaucuggcagcgcaaguuccauggugaauggcguugucaagcugcuaacaaaacccugggacgugaucccuauggugacccaaauugccaugacugauacgacaccauucgggcagcagcgcgucuuuaaggagaaaguugacaccaggacucccaaggcuaagcggggaaccgugcaaauaauggaaguaacagcgagauggcuuugggguuuccugagccgcaacaaaaagccgaggaucuguacgcgagaggaauuuacccggaaagugagaucuaaugccgcaauuggcgcugucuucguggacgagaaccaguggaacucagccaaggaggcaguugaagaugagagguuuugggaccucgugaaaaaggaacgcgagcugcacaagcaggggaaaugcgccacuugcgucuauaacaugaugggaaagcgugagaaaaaguugggcgaguucgguaaagcuaaggggagucgggccaucugguacauguggcugggagcgagauuucucgaguucgaagcacuuggcuuuaugaaugaggaucacugguucuccagggaaaacagccugucuggcguggagggggagggauuacauaaacuggguuacauuuugcgcgacaucucgaagauaccuggcgggaauauguaugccgaugacacagcuggaugggauacccgaaucacugaagacgaucuccagaacgaggccaagauuacagacaucauggaaccagagcacgcacugcuagcuaccucaauuuucaaacuuacauaccaaaauaagguaguucgggugcagagacccgccaaaaacggcacugucauggaugugaucagcaggcgcgaccagagagguuccggacaggugggaaccuauggccugaauacguuuaccaacauggaagcucaacucauacggcagauggagagugagggcauuuuccugccuucugaauuggagacaccaaacuuagccgaaagggucuuugauuggcuggagaaguacgggguugaacgucucaaacgaauggcaaucagcggagacgacugugugguaaagcccaucgaugaccgcuucgcgacugcccuuaccgcucugaaugauauggguaaggugagaaaagacauuccgcagugggagccuuccaagggcuggaacgauuggcagcaaguccccuuuugcucacaucacuuccaccagcuaauaaugaaagacgggcgggagaucgugguuccauguaggaaucaggaugaacuggugggacgcgccagagucagucagggcgcagguuggucucuccgggagacagcuugcuugggaaagagcuaugcccaaauguggcagcugauguacuuucauaggcgagaccuucgucuggcagccaacgcgauuuguuccgcugugccuguagauuggguucccacuucaagaaccacguggagcauccacgcccaucaccaguggaugacaaccgaagacaugcucucuguguggaaucgcgucuggauugaggaaaacccauggauggaggauaaaacucauguguccaguuggggagacguucccuauuuaggcaagcgggaggaccaauggugcggcagccugaucggguugacagcaagggccaccugggcuucgaauauacagguggccaucaaccaggucagacgccugauuggaaaugaaaacuaccucgauuacaugacuuccaugaagcgguucaaaaaugagggugacccugaaggcgcacuuugguga

SEQ ID NO: 13930 - RNA, 9879 nt, Artificial Sequence
  derived and/or modified CDS sequence (opt3) from DENV-1__GU131754__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagauaagccugucaacauagaggccgaaccacccuucggcgaguccuauauugugaucggugcuggggagaaagccuugaagcugucaugguuuaagaaaggcaguagcaucggaaagauguucgaagcaaccgccagaggcgcuaggcggauggccauucucggggacacugcaugggauuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgacucaggaugcgucguuaacuggaaaggccgcgagcugaagugugguagugggaucuuugugacaaaugaagugcacacuuggaccgagcaauauaaguuccaggcagacagcccgaaaagacuuuccgccgcuaucggaaaggccugggaagagggcguaugcgguauuaggucugcaacgcgguuggagaacauaauguggaaacagaucucgaacgaacugaaucauauucuccuggagaacgauaugaaguuuacagucgugguuggcgacguggcugggaucuuagcccagggaaaaaagaugauucgcccucaacccauggaauacaaauauagcuggaaguccuggggcaaggcgaaaaucauaggggccgauguccagaauaccacuuucaucauugacggaccaaacaccccugagugucccgaugaccagagagcuuggaauaucugggaaguggaggauuacggcuuugguauuuucacaacuaacaucuggcugaagcuuagggacucauauacccagguuugcgaucaccguuugaugagugcagccauaaaagacucuaaggcugugcacgccgauaugggguacuggauugagagcgaaaaaaaugagacauggaagcucgcacgggcguccuucaucgaaguaaagacguguauuuggccaaaaucacauacccuguggagcaacggaguccuagagucugaaaugaucauacccaagaucuauggcgguccuauuucccaacacaauuaccgaccaggcuacuuuacucagacagccgggccguggcaucugggaaaacucgagcuggacuucgaucuuugcgagggcaccacugugguggucgacgaacacugcgggaacagaggacccaguuugaggacaaccacgguuacuggcaagaucauucacgagugguguugccgcagcuguacccugccuccauuacgguuuaaaggugaagacgggugcugguauggaauggagaucagacccgugaaggagaaggaagagaaucucguaaaaucuaugguguccgcuggcucaggugaagucgauaguuucagccugggccuucuguguauaucgauuaugaucgaggaagugaugaggucccgcuggucucgaaagauguugaugacagggacccucgccguuuuuuuccugcuaaucaugggacagcugacuuggaacgaccucauucggcugugcaucauggugggcgcaaaugcuagcgaucguauggggaugggaacaaccuaccuugccuugauggcaacauuuaaaaugagaccuauguucgccgucggccuguuauuuaggcgccucacuucacgggaggugcugcuucugaccauuggucuaagucucguugcuuccguggagcugccaaacucuuuggaagagcugggggacggauuagcgaugggcauaaugauccucaagcugcuuacggauuuccaaagccaucagcugugggccacauugcucucccugaccuuuauuaaaacuaccuucucacuacacuaugcauggaagacaauggcuaugguccugagcaucguaagucuuuuuccccucuguaugucuacuaccucccagaagacgacauggcugccgguguugcugggcagcuuagggugcaaaccucucaccauguuccugauugccgaaaauaagaucuggggaagaaaaucguggccacuuaacgaggguauaauggccguuggcaucgugucaauucuguugucuagucuccugaagaacgacgucccccuagcugggccucugaucgcaggaggcaugcuuauugccuguuacgugaucuccgguagcucugcggaucucagccuggaaaaagcugccgagguauccugggaggaagaggcagaacauucaggggccagucacaauauauugguggagguccaggacgauggaacuaugaagauuaaagacgaagagagggaugacacauuaaccauccugcucaaggcuacucugcuugcaguuagcggcguguauccccugucuaucccagccacauuguucgugugguacuuuuggcaaaagaaaaagcagcgauccggcguccuaugggauaccccuucacccccagagguggaacgcgcgguucuggacgacgggauuuaucggauaaugcagagaggacuccuggguaggagucagguaggcgugggggucuuccaagagaacguguuucauacgauguggcacguuacucguggagcugugcuuauguaccagggcaaacgcuuagaaccgagcugggccuccgucaagaaagaucugaucucuuacggugggggauggcggcuccagggcucguggaauaccggcgaggaggugcagguaauugcagucgaaccugggaagaaccccaagaaugugcaaacagccccaggaaccuucaaaacaagcgagggugaaguuggcgcuaucgccuuggacuuuaagcccgggacuucaggauccccuauugugaacagagagggcaaaaucgucggucuguaugggaauggagugguuaccacgaguggcacauacgugucugcaauagcucaggccaaggcgagccaggaaggcccacuccccgagaucgaggaugaagucuucaggaaacgaaaccugacuauuauggaccuucacccuggguccggaaagacccggcgcuaucugccggccaucgugagagaggcaauuaagaggaaauugcggacacuaauccuggcuccaacccgaguaguggccucagaaauggcugaggcacucaaggguaugcccauaagauaccaaacuaccgccguuaaaucugaacauacaggcaaggagauugucgauuuaaugugccacgccacguuuacuaugcgccugcuuagcccugugagggugccaaauuauaacaugaucaucauggacgaggcucauuucaccgaucccaguuccauugcggcacguggguacaucagcacacgggucggaaugggcgaagccgcugccauauuuaugaccgcaacuccuccggguucuguagaggccuucccccagucaaaugcugugauucaggacgaagagagagauaucccagaaagguccuggaacaguggguaugaguggauuacagacuuuccuggaaaaaccguuugguucgugcccagcaucaagucgggcaaugauauagcgaacugucugcgcaagaauggcaaacgagucauucagcucucuagaaagacguucgacacugaguaccaaaaaacaaagaacaacgacugggauuacgugguuaccaccgacaucuccgaaaugggggccaauuuucgggcagauagggugaucgacccacgccguugcuugaaaccugucauucugaaggauggacccgagagagugauccucgcugguccaaugccgguaacuguggccagcgcagcccagcggaggggccgcauugggcgaaaccacaauaaggaaggagaccaguauguuuacaugggccagccucugaacaaugaugaggaccaugcucacuggacagaggccaaaaugcuucuagauaacauaaauacccccgaagguaucauuccagcgcuguucgagcccgaaagagagaagucagcagccaucgacggggaauaucgguugaggggcgaggcucgcaaaacauuugucgaguuaaugagaaggggagaucugccuguguggcucaguuacaagguggccucugaaggcuuccaauauuccgaccggcguuggugcuuugauggggagcgcaacaaucagguccuggaagagaacauggacguugaaaucuggacuaaagagggagagcgaaagaaacuuagaccaagguggcuggacgcucggacguacagcgauccccucgcauugcgcgaauucaaggaguuugccgcugguagaaggucagugaguggcgaccugauucuagaaauagggaagcugccucagcaccucacccagcgggcccaaaaugcacuugauaaccugguaauguuacauaauagcgagcagggaggccgagcguauagacacgccauggaagaguugccggacacaaucgagacucugaugcuccuggcucuuauugccgugcugaccgguggggucacacucuucuuuuuguccggccgcggacugggcaaaaccucuaucggguuacuaugugugauggcaagcuccgcucugcucuggauggccucaguugaaccacauuggauugcagccucuaucauacuugaguucuuucugaugguguugcugauccccgaaccugauaggcagcggacuccccaggacaaccaacucgcuuacgucguaauuggacugcuuuucaugauccucacgguggcggccaaugagaugggucuguuggagaccacaaagaaagaucugggcauugggcacguugcaguggaaaaccaccaucacgcugccauguuagacgucgaucuacauccagccagugcauggacucuguacgcuguggccaccacaaucauaaccccuaugaugcgucacacuauugagaacacaacggcgaauaucucgcucaccgcuauugccaaccaggcagccauccuuaugggacuggacaagggcuggcccauaagcaaaauggauaucggugucccauugcuggcucucgggugcuauucccaggugaauccucugacucuuacagcagccguuuuaaugcugguggcgcauuacgcuauuaucggcccgggacuccaagccaaggcaaccagagaagcccagaagaggaccgcugccggcauuaugaaaaaccccacaguagacgggaucguggcaauagauuuggacccagucguuuaugacgcuaaguuugagaaacagcugggacagauuaugcuacugauccucuguacuucucaaauccuucugaugcgcacgaccugggccuugugcgaaucaauuacacuggcgacuggcccucucaccacacugugggaggguagccccgggaaguucuggaauaccacuaucgccguguccauggcaaacauauuccggggaaguuacuuagcuggcgccggucuugcauuuucucugaugaaaagccucggcgggggacgaagaggcacgggggcucagggagagacacuaggcgaaaaguggaagaggcagcugaaucaguugucaaaauccgaguucaacaccuauaagcgcagugguauuauggaagucgaucggagcgaggccaaagaagggcugaagagaggagagacuaccaaacacgccgugucucguggcacagcgaagcucaggugguuuguagagcggaaucuugugaagccagaagguaaaguuaucgaccugggcugugggcgcggaggcugguccuacuauugcgcuggguugaagaaagugacugaggucaagggauacaccaaaggcgguccugggcacgaagagcccauuccgauggcaacauacggauggaaccuggugaagcuccauucaggcaaagaugucuucuuuaucccaccugaaaagugugacacguuacugugcgauauaggcgagagcucgcccaauccaaccaucgaggaagggcgaacucuuagagugcugaagaugguugagcccuggcuaaggggaaaccaauucuguauuaaaauccucaauccuuauaugccgucuguaguggaaacacuggagcagaugcagcggaagcacgguggcauguugguccgcaacccccugaguagaaauuccacccaugagauguacugggugagcugcgggacuggaaacauuguuucagccgugaauaugacauccaggaugcuccuuaaccgauuuaccauggcucaccggaaaccaacguaugaacgugacgucgaucugggcgccgguaccagacacguggcaguagagccugaaguggccaacuuagacaucauugggcagcgcaucgagaauauaaagcaugaacacaaaucuacauggcauuacgaugaggacaaccccuauaagacuugggcuuaccacggaagcuaugagguuaagccuaguggcuccgcgagcucuauggucaauggcguggugaaacuguugaccaagccaugggaugucauucccaugguuacacaaaucgccaugacugacaccacaccuuucgggcagcagaggguguuuaaagaaaagguagacacccggacuccaaaagcaaagagaggaacggcucaaaucauggaggugacagccaaguggcucugggguuuccugucacgcaacaaaaagcccaggauuuguacccgagaagaguuuacucggaaagucagaaguaaugcagccauaggcgcuguguucguugaugaaaaccaguggaauuccgccaaggaggcgguggaggacgaaagguuuugggaucuaguccaucgcgagcgugaacuucacaaacaggggaagugcgcaaccugcguguacaacaugaugggaaagcgggagaaaaagcugggcgaauucgguaaagccaaggggagcagagcuaucugguacauguggcucggagccagguuccuggaguuugaggcauugggcuucaugaaugaagaccacugguuuucucgcgagaacucgcugucaggcguagaaggggagggacuccauaaacuugguuauauucugcgagauaucagcaagauuccgggcgggaauauguacgcugacgauacagccggaugggacacgcggaucaccgaggaugacuuacagaacgaagcuaaaauaacugauaucauggagccugaacacgcccuguuggcaaaguccauuuucaagcucacauaucaaaauaaaguugugagaguccagaggccagcgaagaacggcaccgugauggacgugaucagucgcagagaucagcgggguucugggcaggucggaacuuacggccugaauacauuuaccaacauggaggcccaacuaauuaggcagauggaaagcgagggcaucuucucccccucagagcuugaaacaccuaaccuggcugggcguguucucgacuggcuggagaaacauggaguggaacgauugaagcgcauggccauaaguggugacgauuguguagugaaaccaauugacgauagauuugcaacugcuuuaaccgcccugaaugacaugggcaagguccggaaggauaucccccagugggagccgucuaaaggguggaacgacuggcagcaagugccuuucugcagccaccacuuucaucagcucaucaugaaggauggaagggaaauuguugugcccugucgcaaucaggacgagcuugucggcagagcacgggugucccagggugccggguggucacugagggagacggcgugccuaggaaaaagcuaugcucaaauguggcagcugauguacuuccaccgacgugaucucagauuggccgcaaacgccauauguucugcuguaccaguugacugggugccuaccucccgcacaacuuggaguauccaugcccaccaucaguggaugaccacagaagauaugcugagcgucuggaaucggguguggauugaggaaaaccccuggauggaggacaagacucacaucucguccuggggcgacguuccauaucuuggcaaaagggaagaucaauggugcgggucucugauuggacucaccgcaagagcuacgugggccacaaauauccagguggcgauaaaccagguccgccgguuaaucgguaaugagaacuaccuggacuacaugaccucaaugaagagguuuaagaaugagagcgaucccgaaggcgcuuugugguga

SEQ ID NO: 13931 - RNA, 9879 nt, Artificial Sequence
  derived and/or modified CDS sequence (opt3) from DENV-1__GU131755__SS-prME
agcgugaccaugcugcucaugcuuaugcccaccgcccuggcuuuccacuugacuacgagaggcggggaaccucauaugaucgucuccaagcaggaaaggggaaagucuuuacuguuuaagaccucagccgguguuaauaugugcacgcuaauugccauggaccucggcgaacugugugaagauacuaugaccuacaagugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucuccgcgggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuacuuggcucugauggccaccuucaaaauacgcccuauguuugcagugggcuuacucuuccggagacugacgagcagggagguccuucugcuaacaaucggucucucacugguggccaguguugaauugccaaacucccuggaggaauuaggggauggacucgcuaugggcauuaugauccugaaacuucugaccgacuuucaaucucaucaguugugggcgacucuccugagccuaaccuucauuaaaacaacuuuuucccugcacugugccuggaagaccauggcaauggugcuuucaaucgucagccucuucccccugugcuugaguacgacaucucagaaaaccacuuggcugccgguauuacucggcucccugggguguaagccucuuacaauguuucugauagcugagaauaagaucuggggacgacgcagcuggccauugaacgaagguauuauggccgugggcaucguuucgauucuccugucaucucuacugaaaaacgaugugccccuugccgggccucucaucgcuggaggcaugcugauagcaugcuaugucauuagugguuccagcgccgacuugucuuuagagaaggcggcugaggugagcugggaagaggaagccgagcauuccggggcaucacacaauauccugguagaagugcaggaugacggaaccaugaaaaucaaggaugaggagcgggacgauacucucacaauucugcuuaaagccacccuguuggcugucaguggcguuuacccccuaagcauaccagcaacgcuguucgugugguauuucuggcaaaagaaaaagcagagaucuggcgugcucugggacacuccuucacccccagaagucgagagggccgugcuggaugacgggaucuaccguauuaugcagcgcggacuuuuaggucggagccagguuggcguagggguguuucaagaaaacgucuuccauaccauguggcacgugacaagaggagcgguucugauguaucagggcaagaggcucgagccgaguugggcuagcgugaaaaaggacuugaucuccuacggugggggauggcgacugcagggcucuuggaauaccggcgaggaaguccaggugauugccguagagccugggaaaaaccccaagaauguccaaacagcaccaggaacuuuuaaaacccccgaaggugaggugggcgccaucgcucucgauuucaagccugggacgucgggaagcccaauaguuaaccgggaaggcaagaucgugggucuguacgggaauggagucgugacaacuucaggcaccuauguuuccgccauugcacaggcuaaagccagucaggagggcccccuuccugagaucgaagacgagguguuucgcaagagaaaccugacaauuauggauuugcacccggggucuggaaaaaccaggcgguaccuaccagcgaucguccgagaagccauaaagagaaaacugcgcacucucauuuuagcacccaccagggugguagcuagcgagauggccgaagcucugaaggguaugccuauccguuaucaaacaacggcagugaaguccgagcauacuggcaaagagaucguugaccuuaugugucacgccaccuucacaaugcggcugcucucaccagucagagugcccaauuacaacaugauuaucauggaugaagcccauuuuaccgacccuucuagcauagcugcgaggggguauauuaguacucgcgugggaaugggcgaggcagccgcuaucuucaugacagccaccccgcccgguuccgucgaagcauuuccacagagcaaugccguaauucaggaugaggaacgagacaucccugagagaucuuggaacucaggguacgaguggauaacggauuuccccggaaagacugugugguuuguuccauccauuaaaaguggcaaugacaucgcuaacugcuugcggaagaauggcaaaagggugauccagcugagccgcaagacauucgauaccgaauaucaaaagaccaaaaacaacgacugggacuacgucgugacuacagauauuucggagaugggggcgaauuuccgugccgacagaguuaucgauccucggaggugccucaagcccgugauucugaaagacggaccagaacgcgucauacuugcagguccgaugccugugaccguagcuucugccgcacagcgaagaggccggaucgggaggaaccacaauaaggagggagaucaguacauuuauaugggccagccccuaaacaaugacgaggaucaugcccacuggacagaagcuaaaaugcuguuggacaacaucaauacuccagaggguaucauucccgccuuauuugaaccugagcgcgaaaaguccgcggcaauagauggggaguacagacugaggggcgaggcccggaagacguucguggaacucaugcgucgcggagaccugccaguuuggcuuagcuauaaagucgcuucagagggcuuucaauacagugaucgaagaugguguuucgacggggaaaggaacaaucaggugcuggaggaaaacauggauguggagaucuggaccaaggagggagaacggaaaaagcuccgccccagaugguuggacgccaggacauauucugacccucuggcucuacgggaguuuaaagaguucgcagccggucgaagauccgucagcggcgaucugauucucgagaucgggaaacuuccgcagcaccugacucagcgcgcucaaaaugccuuagacaacuugguuaugcugcauaauucagaacagggaggcagggcauaccggcacgcgauggaggagcucccagauaccauugaaacacugaugcuucuggcccucaucgcuguguugaccggugggguaacucuguuuuucuuaaguggccguggacuaggcaaaacgagcauagggcugcucugcgugauggccuccucuguccuucuguggauggcaagcguggagccccauuggaucgcugccuccauuaucuuggaauuuuuccugaugguucuccugauuccugagcccgacaagcagagaaccccacaggauaaccaacuugcauauguggucaucggacuccuguuuaugauauugacaguagccgcuaaugagaugggucuguuagaaacuaccaagaaagaccuaggcauugggcacguggcgguugagaaccaccaucacgccgcaaugcuggauguggaccuccauccugcuucagccuggacacuuuacgccgucgcaaccacuaucauuacacccaugaugaggcacacgaucgaaaacaccacugcuaauauaucucugacagccaucgcgaaccaggcugccauuuugaugggacuggauaagggcuggccaaucaguaaaauggacauuggugugccucuccuggcacuuggguguuacucgcaggucaauccguuaacccugaccgccgcugugcucauguugguugcacauuaugccaucauaggccccggacugcaagcgaaggcuacacgcgaggcccagaaacggacugcagccggcauuaugaagaacccaacgguggaugggaucguagcuaucgaccuagauccuguggucuacgacgccaaguucgaaaaacagcugggacagauuaugcuccuuauccugugcaccagccaaauauugcugaugcgaacaacuugggcacucugugaguccauuacccuggcuacaggccccuuaaccacucuuugggaggguucuccagggaaguuuuggaauacgacaaucgccguuucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguggaccguuccgaagcaaaagaggggcuuaagaggggagagacaacuaaacacgcugucagucggggcaccgccaagcugcgcugguucguggaacgaaauuugguaaaaccugaggguaaggugauagaucugggcugcgggagaggaggcuggagcuauuacugugccgggcucaagaaaguuacagaagugaagggauauacgaaaggcggucccgggcacgaggaaccgaucccaauggcgaccuacggauggaacuuagucaagcugcauucuggcaaagacguguuuuucauuccucccgagaagugcgauacucuucugugugacaucggcgaguccucaccaaaucccacaauugaagaggggaggacccuacggguccucaaaaugguggaaccuuggcugcgcggaaaccaauuuugcaucaagauuuugaauccguacaugcccagcguuguagagacucuggagcagaugcagagaaagcacgguggcaugcucgugaggaacccacuuucgcgaaauucuacacaugaaauguauugggucaguugugggaccggaaacaucguguccgcuguuaauaugacgagccggaugcuguuaaaccguuucaccauggcacacagaaaaccuacauacgagcgcgauguggaccugggcgccgguacuaggcacgucgcuguggaacccgagguagccaacuuggauauaauugggcagcggaucgaaaauaucaagcaugagcacaaaucaaccuggcauuaugacgaggauaacccuuacaagacaugggcauaucacggauccuacgaagugaaaccaucuggcagcgccaguuccaugguuaauggcgucgugaagcuccugacuaagcccugggacgugauuccuauggucacccaaauagcuaugacagauaccacuccauuugggcagcagagaguuuucaaagagaagguggacacgcgcacacccaaagcgaagaggggaaccgcccaaaucauggaaguaacugcaaaauggcuaugggguuuucuuagccgaaacaagaagccgcggauuugcaccagagaggaguucacaaggaaagugcgcucuaaugcugccaucggcgcagucuuuauugacgagaaccaguggaacucagccaaggaggcuguggaagaugagcguuucugggaccugguucaucgggaaagagagcuccacaaacaggggaagugcgccacguguguguauaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcgucgagggggagggacugcauaaauuagguuacauacugagagacaucucgaagauuccuggcgggaauauguaugccgaugacaccgcaggaugggauacuaggaucacagaagacgauuugcagaacgaggcucgcauuaccgacaucauggaaccagagcacgcccuccuggcuaaaucaauauuuaagcuaacuuaccaaaauaaagugguaagaguucagcggcccgccaagaacggcacagugauggaugucauuagcaggcgugaccagcgagguuccggacaggugggaaccuauggccuuaauacauucacuaacauggaagcacaacugauccgccagauggagagugagggcaucuuuucuccuagcgaacucgagaccccaaaccuggcggaaagaguguuggauugguuagagaaguacggggucgaacggcugaaaaggauggccauuuccggagacgacugcguugugaagcccauagaugaccgcuucgcuacggcccucaccgcacuuaaugauauggguaaaguaagaaaggacaucccgcagugggagccuucaaaaggcuggaacgauuggcagcaagugcccuuuuguagucaucacuuccaccagcugauuaugaaggacgggcgggagaucgucgugccaugcaggaaucaggaugagcuaguuggacgagcucgugugucucagggcgccgguuggagccugagagagacagcaugucucgggaaguccuaugcccaaauguggcaguugauguacuuucaucgccgggaccugaggcuugcggcuaacgccauuugcucagcagucccuguggauuggauccccacuagcagaaccacauggucuauacacgcccaucaccaguggaugacuaccgaagacaugcuguccguauggaaucgcguuuggaucgaggaaaacccauggauggaggauaaaacgcauauuaguagcuggggagacgugcccuaucucggcaagcgggaggaccaaugguguggcucguuaaucgggcugacagcuagggccaccugggcaacuaauauucaggucgcuaucaaccaggugcgaagauugauuggaaaugaaaacuaccuggauuacaugacauccaugaaacgguucaagaaugagucugacccugaaggugcccucugguga

SEQ ID NO: 13932 - RNA, 9879 nt, Artificial Sequence
  derived and/or modified CDS sequence (opt3) from DENV-1__GU131756__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccgcauucuuucuacugauuaugggacagcucacuuggaacgaucugauccggcuuugcauuauggugggcgcuaaugccagcgaccguauggggaugggaacaaccuacuuggcacugauggccacauucaaaaugagaccuauguuugcuguuggcuuacucuucaggcgccugacuucacgggaggugcuucugcuaaccauaggucucagucuggucgcguccguggaauugccaaacucucuggaggaauuaggggauggacucgccaugggcaucaugauucugaagcuucugacggacuuucaaagccaucaguugugggcaacacuccugucccuaaccuucaucagaacuaccuuuucacugcacuaugcuuggaaaacaauggccaugguucuuagcauugugagucucuucccccuguguuugucuacuaccucccagaagacgacauggcugccggucuuacucggcagccuggggugcaagccucuuaccauguuucugaucgccgagaauaaaauauggggaaggaagucguggccauugaacgaagguaucauggcuguaggcauugugucaauccuccugucuagucuacugaaaaacgauguuccccuugcagggccucucauugccggaggcaugcugaucgcguguuacgugauauccgguagcucugcugacuugagcuuagagaaggccgcagucguguccugggaggaagaggccgaacauucaggggcuagucacaauauucugguagaggugcaggaugacggaacuaugaaaaucaaggaugaagagcgagacgauacacucaccauccugcuuaaagcaacucuguuggccgucagcggcguuuauccccuaucuauuccagcgacacuguucgugugguacuucuggcaaaagaagaaacagcgcuccggcgugcucugggacaccccuucacccccagaggucgaacgggcugugcuggaugacgggauauauagaaucaugcagaggggacuuuuaggucguagucagguuggcguagggguguuucaagagaacgucuuccauacgauguggcacgugacucgcggagccguucugauguaccagggcaagcggcucgaaccgagcugggcauccgugaaaaaggacuugauuucuuacggugggggauggagacugcagggcucguggaauaccggcgaggagguccaggugaucgccguagaaccugggaaaaaccccaagaauguccaaacagcuccaggaaccuuuaagacaagcgagggugaagugggcgccauugcacucgauuucaaacccgggacuucaggauccccuaucguuaacagggagggcaagauagugggucuguaugggaauggagucgugaccacgaguggcacauacguuucugcuaucgcccaggcgaaagccagccaggaaggcccacuucccgagauugaggacgaaguguuucgaaagcggaaccugacuaucauggauuugcacccuggguccggaaaaacccgcagauaucuaccggcaauugucagggaggcuaucaagcggaagcugcgaacacucauauuagccccaaccagagugguagcuucagaaauggcagaggcccugaaagguaugcccauucgcuaccaaacuaccgccgugaagucugaacauacaggcaaagagaucguugaccuuaugugccacgcuacguucacuaugaggcugcucagcccuguccgugugccaaauuauaacaugaucauuauggaugaggcgcauuuuaccgaccccaguuccaucgcagcccggggguacauaagcacaagagugggaaugggcgaagcugccgcaauuuucaugaccgccacuccuccggguucugucgaggcuuuuccccagucaaaugcgguaauccaggaugaagagagggacauuccagaacgcuccuggaacaguggguaugaguggaucacagauuucccuggaaagaccgugugguuuguucccagcauaaaaucgggcaaugacauugccaacuguuugcgaaagaauggcaagagagugauccagcugucucggaaaacguucgauacugaguaccaaaagacaaaaaacaacgacugggacuacgucgugaccaccgauaucuccgaaaugggggcaaauuucagggcugaccgcguuauugauccacguagaugccucaagccugugauccugaaagacggacccgagcgggucauucuugccgguccaaugccggugacuguagcaagcgccgcucagaggcgcggccgaauagggagaaaccacaauaaggaaggagaucaguauaucuacaugggccagccucuaaacaaugacgaggaucaugcccacuggacagaggcgaagaugcuguuggacaacauuaauacccccgaagguaucaucccagcauuauuugagcccgaacgggagaaaucagccgcuauugauggggaauauaggcugcgcggcgaggccagaaagacauucguggagcucaugaggcggggagaccugccuguuuggcuuaguuacaaagucgcuucugaaggcuuucaauauuccgaucgucgcuggugcuucgacggggagcgaaacaaucaggugcuggaagagaacauggauguggaaauauggacuaaggagggagagagaaaaaagcucaggccacggugguuggacgcacgcacguacagcgacccccuggcccuaagagaauuuaaagaguucgcugccgguaggcggucagucaguggcgaucugauccucgaaauugggaagcuuccucagcaccugacccagcgagcacaaaaugcguuagacaacuugguuaugcugcauaauagcgagcagggaggcagagccuaucgccacgcuauggaagagcucccggauacaaucgagacucugaugcuucuggcccucauugcaguguugaccggugggguaacacuguuuuucuuauccggcaggggacuaggcaagaccucuaucgggcugcucugugugauggcuagcuccguccuucuguggauggccucaguggaaccacauuggauagcagccucuaucauuuuggaguuuuuccugaugguucuccugauccccgaaccugaccggcagcguacuccccaggauaaccaacuugcuuacguggucauuggacuccuguuuaugaucuugacgguagcggccaaugagaugggucuguuagagaccacaaaaaaggaccuaggcauagggcacguggcaguugaaaaccaccaucacgcugccaugcuggauguggaccuccauccagccagugcauggacucuuuacgcugucgccaccacaauuaucaccccuaugaugagacacacuauugagaacacaacggcgaauaucucgcugaccgcuauagccaaccaggcagccaucuugaugggacuggauaaaggcuggcccauuagcaagauggacaucggugugccacuccuggcucuugggugcuauucccaggucaauccuuuaacucugacagcagccgugcucauguugguugcgcauuacgcuauuaucggcccgggacugcaagccaaagcaaccagggaagcccagaagcgcaccgcugccggcauaaugaagaaccccacaguggaugggauuguagcaaucgaccuagauccaguggucuaugacgcuaaauucgagaagcagcugggacagaucaugcuccuuauucuguguacuucucaaaucuugcugaugcggacgaccugggcccucugcgaaucaauaacacuggcgacuggcccuuuaaccacacuuugggaggguagccccgggaaauuuuggaauaccacuauugccguuuccauggcaaacaucuuccgaggaaguuaccuggcuggcgccggucucgcauucucucuaaugaagagccugggcgggggaagaaggggcacgggggcucagggagagacauugggcgaaaaauggaagcgccagcugaaucagcucucaaaguccgaguuuaacaccuauaaacggagugguauuauggaaguggacagaagcgaggccaaggaagggcuuaaacguggagagacuaccaagcacgccgucucuaggggcacagcgaaacugcggugguucguggagcgcaauuugguaaagccagaagguaaggugaucgaucugggcugugggcgaggaggcugguccuacuauugcgcugggcucaaaaagguuacugaggugaaaggauacaccaagggcgguccugggcacgaagagcccauaccgauggcaacauacggauggaacuuagucaaacugcauucaggcaaggacguguuuuucaucccaccugaaaaaugugauacgcuucugugcgacauuggcgagagcucgcccaauccaaccaucgaggaagggagaacucuaaggguccucaagaugguggagcccuggcugcggggaaaccaauuuuguauuaagaucuugaauccuuauaugccgucuguuguagaaacacuggagcagaugcagcgcaaacacgguggcaugcucgugagaaacccccuuaguaggaauuccacccaugagauguacugggucagcugcgggacuggaaacauugugucagccguuaauaugacaucccgaaugcuguuaaaccgguucaccauggcucaccguaagccaacguaugaaagagauguggaccugggcgccgguacccgccacgucgcaguggagccugaaguagccaacuuggauaucauagggcagaggauugagaauaucaaacaugaacacaagucuacauggcauuacgacgaggauaaccccuauaaaacuugggcuuaccacggaagcuaugaggugaagccuaguggcuccgcgagcucuaugguuaauggcgucgugaagcuccugaccaaaccaugggacgugauccccauggucacacaaauugccaugacugauaccacaccuuuugggcagcagcggguuuucaaggaaaaaguggacaccagaacuccaaaggcaaaacgcggaacggcucaaauaauggagguaacagccaaguggcuaugggguuuucuuucaaggaacaagaaaccccgaaucuguacccgggaagaguucacuagaaaggugaggaguaaugcagccauuggcgcugucuuuguggacgaaaaccaguggaauuccgccaaagaggcgguugaggaugaacgcuucugggaccuggugcaucgugagcgggaacuccacaagcaggggaaaugcgcaaccugcgucuacaacaugaugggaaagagagagaagaaacugggcgaauuugguaaggccaaagggagcagggcuaucugguacaugugguugggagcccgcuuccuggaguucgaggcacucggcuuuaugaaugaagaucacugguucucucgagagaacucgcuuucaggcguggaaggggagggacugcauaaguuagguuauauucugcgggacaucagcaaaauaccgggcgggaauauguacgcugaugacacagccggaugggauacgagaaucaccgaggacgauuugcagaacgaagcuaagauuacugacaucauggagccugaacacgcccuccuggcaaaauccauuuuuaagcuaacauaucaaaauaagguaguuagggugcagcgcccagcgaaaaacggcaccgucauggaugugaucaguagacgggaccagagggguucugggcaggugggaacuuacggccuuaauacauucaccaacauggaggcccaacugauacgucagauggaaagcgagggcauuuuuucccccucagagcucgaaacaccuaaccuggcugggcgagucuuggauugguuagagaagcauggaguugaacgccugaaaagaauggccaucaguggugacgacugugugguaaagccaaucgaugaccgguucgcaacugcucucaccgcccuuaaugauaugggcaaagugaggaaggacauuccccagugggagccgucuaagggguggaacgauuggcagcaagucccuuuuugcagccaccacuuccaucagcugauaaugaaagacggacgcgaaaucgugguucccuguagaaaucaggaugagcuagugggccgggcaagggucucccagggugccggguggucacugcgagagacggcgugccucggaaagagcuaugcucaaauguggcaguugauguacuuucaccguagagaccugcgccuugccgcaaacgccauuuguucugcugugccaguagauuggguuccuaccucccggacaacuuggaguauccaugcccaccaucaguggaugaccacagaagacaugcugagcguguggaauagggucuggauugaggaaaaccccuggauggaggauaaaacucacaucucguccuggggcgacgugccauaucucggcaagagagaagaccaauggugcgggucuuuaauaggacugaccgcacgcgcuacgugggccacaaauauccagguugcgauuaaccaggugcggagguugcuggguaaugagaacuaccucgauuacaugaccucaaugaaacgauucaagaaugagagcgaccccgaaggcgcucuuugguga

SEQ ID NO: 13933 - RNA, 9879 nt, Artificial Sequence
  derived and/or modified CDS sequence (opt3) from DENV-1__GU131758__SS-prME
agcgugaccaugcugcucaugcuuaugcccaccgcacuggcuuuccacuugacuacgagaggcggggaaccucauaugaucgucuccaagcaggaaaggggaaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgugccuugcaagauaccauuuucuacccaggaugaaaaagggguaacucaaaacggacgccuuaucacagcgaaucccauugucaccgacaaggagaaaccugugaacaucgaagcagagccacccuucggcgaguccuauauaguuauuggugccggggaaaaggcuuugaagcugucaugguuuaaaaagggcaguagcaucggaaaaauguucgaggccacugcaagaggcgccaggcggauggcuauccucggggauaccgccugggacuuuggauccauugguggcguguucacaucugucgggaagcuggugcaucagaucuuuggaacggcauacggcguacuuuucagcggugugucauggaccaugaaaauugggauaggcguucuguugacuuggcucggacugaauagucgauccacuagcuuaucuaugaccuguaucgcggucggccuggugacacuauaccucggggugaugguccaggcugauucaggaugcguuauuaacuggaagggccgcgaacugaagugugguagugggaucuuugugacuaaugaggugcacaccuggacggaacaguauaaauuccaagccgacagcccgaagagacuuuccgcagccaucggaaaggcuugggaggagggcguaugcgguauuaggucugccacacgguuggaaaacauaauguggaagcagaucucgaacgagcugaaucauauucuccuggaaaacgacaugaaauuuaccgucgugguuggcgauguggcagggaucuuagcucagggaaagaaaaugauucgcccucagcccauggaguacaaguauagcuggaaguccuggggcaaagccaagaucauaggggcggacguccaaaauacuaccuucaucauugauggaccaaacacaccugaaugucccgacgaucagagagccuggaauaucugggagguggaggacuacggcuuugguauuuucacuaccaacaucuggcugaaacuuagggauucauauacacagguuugcgaccaccguuugaugagugcugcaauaaaggauucuaaagccgugcacgcugacaugggguacuggauugaaagcgagaagaaugaaacguggaagcucgcccgggcauccuucaucgagguaaaaaccuguauuuggccaaagucacauacucuguggagcaacggaguccuagaaucugagaugaucauacccaaaaucuauggcgguccuauuucccagcacaauuaccgaccaggcuacuuuacacaaaccgcggggccguggcaucugggaaagcucgagcuggauuucgaccuuugcgaaggcacuacagugguggucgaugagcacugcgggaacagaggacccaguuugaggaccacgacuguuaccggcaaaaucauucacgaaugguguugccgcagcuguacacugccuccauuacgguuuaagggugaggacgggugcugguauggaauggagaucagacccgugaaggaaaaagaggaaaaucucguaaagucuaugguguccgccggcucaggugaggucgacaguuucagccugggccuucuguguauaucgauuaugaucgaagaggugaugaggucccgcuggucucgaaaaauguugaugaccgggacucucgcuguauuuuuccugcuaaucaugggacagcugacauggaacgaucucauucggcugugcaucauggugggcgccaaugcaagcgaccguauggggaugggaaccacauaccuugcuuugauggccacuuuuaagaugagaccuauguucgcagucggccuguuauuuaggcgccucaccucacgggaggugcugcuucugacgauuggucuaagucucguugccuccguggaacugccaaacucuuuggaggaacugggggauggauuagcuaugggcauaaugauccucaaacugcuuacagacuuccagagccaucaacugugggcgaccuugcucuccuuuacuuucauuaagaccacauuuucacugcacuaugccuggaagacuauggcaaugguccuaagcaucguaagucuguucccccuuugucucucuaccacgucccagaaaacaaccuggcugccgguguugcugggcagcuuagggugcaagccucucacuauguuccugauugcugagaauaaaguuuggggaagaaagucguggccacuuaacgaagguaucauggccgugggcauagucucaauccuguugucuagucuccugaaaaacgaugugccccuagccgggccucugauugcuggaggcaugcuuaucgcauguuacguaauuuccgguagcucugccgaccucagccuggagaaggcggcugagguguccugggaagaggaagccgagcauucaggggcaagucacaauaucuuggucgaaguucaggaugacggaacaaugaaaauaaaggaugaggagagggacgauaccuuaacuauucugcucaaggccacacugcuugcugugagcggcguguauccccugucuaucccagcaaccuuguuugucugguacuucuggcagaaaaagaaacaacgauccggcgugcuaugggacacgccuucacccccagaaguugagcgcgccguacuggaugacgggaucuaucggauuaugcagagaggacuccuggguaggagucaggugggcgucgggguguuucaggaaaacguuuuccauacuauguggcacgugacccguggagcgguccuuauguaccaaggcaagcgcuuagagccgagcugggcuuccgugaaaaaggaccugauaucuuacggugggggauggcggcuccagggcucguggaauacaggcgaggaaguacaggucaucgccguggagccugggaagaaccccaaaaauguucagaccgcaccaggaacauuuaagacuagcgaaggugaggugggcgccauugcuuuggauuucaaacccgggaccucaggauccccuaucgucaacagagaaggcaagauugugggucuguaugggaauggaguugugacgacaaguggcacuuacgucucugccaucgcacaagcuaaagccagccaggagggcccacuccccgagauagaagacgagguguuuaggaagcgaaaccugaccaucauggaucuucacccuggguccggaaagacacggcgcuaucugccggcgauuguaagagaagccaucaaaaggaaguugcggacccuaauucuggcaccaacucgagugguugcuucagagauggccgaagcucucaaagguaugcccaucagauaccagaccacagcagucaagucugagcauacgggcaaagagauaguggacuuaaugugccacgccacuuucaccaugcgccugcuuagcccugugagggucccaaauuauaacaugauuaucauggaugaagcccauuuuacagaccccaguuccaucgcugcgcguggguacauuagcacccggguaggaaugggcgaggcagccgcuaucuucaugacugccacaccuccggguucuguggaagcauuuccccaaucaaaugccguuauacaggaugaggaaagagacauuccagagagguccuggaacaguggguaugaguggaucaccgauuucccuggaaagacggugugguucguccccagcauuaagucgggcaaugacaucgcuaacugucugcgcaaaaauggcaagcgagugauacagcucucuagaaaaacuuuugauacagaauaccagaagaccaaaaacaacgacugggacuacguugugaccacugauauuuccgagaugggggcgaauuuccgggccgacagggucaucgauccacgccguugcuugaagccugugauccugaaggacggacccgaaagaguaauucucgcagguccaaugccggugacaguugcuagcgccgcacaacggaggggccgcaucgggcgaaaccacaauaaagagggagaucaguauauuuacaugggccagccucugaacaaugacgaggaucaugcccacuggaccgaagcuaagaugcuucuagacaacauaaauacacccgaggguaucauuccagcccuguuugaacccgagagagaaaaaucagcggcaaucgauggggaguaucgguugaggggcgaggcccgcaagacuuucgucgaauuaaugagaaggggagaccugccuguguggcucaguuacaaaguggcuucugagggcuuucaguauuccgaucggcguuggugcuucgacggggaacgcaacaaucaaguccuggaggaaaacauggauguugagaucuggacgaaggagggagaacgaaagaaacuuagaccaagguggcuggacgcccggaccuacagcgacccccucgcuuugcgcgaguuuaaagaguucgcagccgguagaaggucagugaguggcgaucugauucuagagauagggaaacugccucagcaccucacacagcgggcucagaaugcccuugacaaccugguaauguuacauaauagcgaacaaggaggccgagcauauagacacgcgauggaggaguugccggauacuaucgaaacccugaugcuccuggcccuuauugcugugcugacagguggggucacccucuuuuucuuguccggccgcggacugggcaagacuucuaucggguuacuaugugugauggccagcuccguucugcucuggauggcaucaguggagccacauuggauugcugccucuaucauacuugaauuuuuccugauggucuugcugauccccgagccugacaggcagcggacgccccaggauaaccagcucgcauacguagugauuggacugcuuuuuaugauccucaccguugccgcuaaugagaugggucuguuggaaacaacuaaaaaggaccugggcauugggcacgcggccguggagaaccaccaucacgcagcuauguuagaugucgaccuacauccagccagugccuggacccuguacgcaguggcuacaaccaucauaacuccuaugaugcgucacacaauugaaaacacgaccgccaauaucucgcucacugcgauugcuaaccaagccgcaauccuuaugggacuggauaaaggcuggcccauaagcaagauggacaucggugucccauugcuggcccucgggugcuauucccaggugaauccucugacacuuaccgcugcaguuuuaaugcugguggcccauuacgcgauuaucggcccgggacuccaggcuaaggccaccagagaggcacagaagaggacagccgcuggcauuaugaagaaccccacuguagaugggaucguggccauagacuuggauccagucguuuaugacgcaaaauucgaaaagcagcugggacagauuaugcuacugauccucuguacgucucagauccuucugaugcgcaccacaugggcuuugugcgagucaauuacucuggccaccggcccucucacaacccugugggaggguagccccgggaaauucuggaauacuacgaucgcgguguccauggccaacauauuucggggaaguuacuuagcaggcgcuggucuugccuucucucugaugaaaagccucggcgggggacgaagaggcacaggggcacaaggagaaacccuaggcgagaaguggaaaaggcagcugaaucaguugucaaaguccgaauuuaacacuuauaaacgcagugguauuauggaggucgaccggagcgaagcuaaggaggggcugaaaagaggagagaccacaaagcacgccgugucucguggcacugccaagcucaggugguucguagaacggaaucuugugaaaccagaggguaagguuaucgaucugggcugugggcgcggaggcugguccuacuauugcgcgggguugaaaaaggugaccgaagucaaaggauacacaaagggcgguccugggcacgaggaacccauuccgauggcuacguacggauggaaccuggugaaacuccauucaggcaaggacgucuuuuucaucccaccugagaagugugauaccuuacugugcgacauaggcgagagcucgcccaauccaacuaucgaagaggggcgaacacuuagagugcugaaaaugguugaacccuggcuaaggggaaaccaguuuuguauuaagauccucaauccuuauaugccgucuguaguggagacccuggagcaaaugcagcggaaacacgguggcauguugguccgcaacccccugaguagaaauuccacucaugaaauguacugggugagcugcgggacaggaaacauuguuucagcagugaauaugaccuccaggaugcuccuuaaccgauucacgauggcccaccggaagccaaccuaugagcgugaugucgaccugggcgcugguacaagacacguggccguagaaccugagguggcaaacuuagauaucauugggcagcgcaucgaaaauauaaaacaugagcacaagucuacuuggcauuacgacgaggauaaccccuauaagaccugggccuaccacggaagcuaugaaguuaaaccuaguggcuccgcuagcucuauggucaauggcguggugaagcuguugacaaaaccaugggacgucauucccaugguuacucagaucgcgaugaccgauacaaccccuuuugggcaacagaggguguucaaggagaaaguagacacucggacgccaaaggccaagagaggaacagcacagaucauggaagugaccgcuaaauggcucugggguuuucugucacgcaacaagaaacccaggauuuguacucgagaggaguucacccggaaggucagaaguaaugccgcaauaggcgccguguuuguugacgagaaccaauggaacuccgcuaaagaggccguggaagaugagagguucugggaccuaguccaucgcgaacgugagcuucacaagcaggggaagugcgcgacaugcguguacaacaugaugggaaaacgggaaaagaaacugggcgaguucgguaaggcaaaagggagcagagccaucugguacauguggcucggagcuagguuucuggaguucgaagccuugggcuuuaugaaugaggaucacugguucucucgcgaaaacucgcugucaggcguagagggggagggacuccauaaacuugguuauauucugcgagacaucagcaaaauuccgggcgggaauauguacgcagaugacacggcuggaugggauacccggaucacugaagacgauuuacagaacgaggccaagauaacagacaucauggaaccugagcacgcucuguuggccaaguccauuuuuaaacucaccuaucagaauaagguugugagaguccaaaggccagccaagaauggcacugugauggaugugaucagucgcagagaccagcgggguucugggcaggucggaacauacggccugaauaccuucacaaacauggaagcgcagcuaauuaggcaaauggagagcgagggcaucuuuucccccucagaacuugagacuccuaaccuggccgggcguguucucgauuggcuggaaaagcauggaguggagcgauugaaacgcauggcuauaaguggugacgacuguguagugaagccaauugaugacagauucgccaccgcauuaacggcucugaaugauaugggcaagguccggaaagacaucccccagugggaaccgucuaagggguggaacgauuggcaacaggugccuuuuugcagccaccacuuccaucaacucaucaugaaagacggaagggagauuguugugcccugucgcaaucaggaugagcuugucggcagagcccgggugucccagggugcaggguggucacugagggaaaccgccugccuaggaaagagcuaugcgcagauguggcaacugauguacuuucaccgacgugaccucagauuggcugccaacgcaauauguucugccguaccaguugauugggugccuacaucccgcacuaccuggaguauccaugcucaccaucaguggaugacaacugaggacaugcugagcgucuggaaucggguguggauugaagagaaccccuggauggaagauaaaacccacaucucguccuggggcgacguuccauaucuuggcaagagggaggaccaguggugcgggucucugauuggacucacggccagagcaacaugggcuaccaauauccaaguggccauaaaccagguccgccgguuaaucgguaaugagaacuaccuggauuacaugacuucaaugaagagguucaaaaaugaaagcgaccccgagggcgcguugugguga

SEQ ID NO: 13934 - RNA, 9879 nt, Artificial Sequence
  derived and/or modified CDS sequence (opt3) from DENV-1__GU131759__SS-prME
agcgugaccaugcugcucaugcuuaugcccaccgcacuggcuuuccacuugacuacgagaggcggggaaccucauaugaucgucuccaagcaggaaagggggaagucuuuacuguuuaagaccucagccgguguuaauaugugcacacuaauugccauggaccucggcgaguucugugaagauacuaugaccuacaagugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucuccuuuacuuucauuaagaccacauuuucacugcacuaugcauggaagacuauggcuauggugcuaagcaucgucagucuguucccccuuugucucucuaccacgucccagaaaacaaccuggcugccgguauugcugggcagcuuagggugcaagccucucacuauguuccugauugccgagaauaaaguguggggaagaaagucguggccacuuaacgaagguaucauggccguuggcauagugucaauccuguugucuagucuccugaaaaacgaugucccccuagcugggccucugauugcaggaggcaugcuuaucgccuguuacgugauuuccgguagcucugcggaccucagccuggagaaggcugccgagguauccugggaagaggaagcagagcauucaggggccagucacaauaucuugguggaaguccaggaugacggaacaaugaaaauaaaggaugaggagagggacgauaccuuaacuauucugcucaaggcuacacugcuugcaguuagcggcguguauccccugucuaucccagccaccuuguuugugugguacuucuggcagaaaaagaaacaacgauccggcguccuaugggacacgccuucacccccagaaguggagcgcgcgguucuggaugacgggaucuaucggauuaugcagagaggacuccuggguaggagucagguaggcgugggggucuuucaggaaaacguguuccauacuauguggcacguuacccguggagcugugcuuauguaccaaggcaagcgcuuagagccgagcugggccuccgucaaaaaggaccugauaucuuacggugggggauggcggcuccagggcucguggaauacaggcgaggaagugcagguaaucgcagucgagccugggaagaaccccaaaaaugugcagaccgccccaggaacauuuaagacuagcgaaggugagguuggcgcuauugccuuggauuucaaacccgggaccucaggauccccuaucgugaacagagaaggcaagauugucggucuguaugggaauggagugguuacgacaaguggcacuuacgugucugcaaucgcucaagccaaagcgagccaggagggcccacuccccgagauagaagacgaggucuuuaggaagcgaaaccugaccaucauggaucuucacccuggguccggaaagacacggcgcuaucugccggccauugugagagaagcaaucaaaaggaaguugcggacccuaauucuggcuccaacucgaguaguggccucagagauggcugaagcacucaaagguaugcccaucagauaccagaccacagccguuaagucugagcauacgggcaaagagauagucgacuuaaugugccacgccacuuucaccaugcgccugcuuagcccugugagggugccaaauuauaacaugauuaucauggaugaagcucauuuuacagaccccaguuccaucgcggcacguggguacauuagcacccgggucggaaugggcgaggccgcugccaucuucaugacugcaacaccuccggguucuguagaagccuuuccccaaucaaaugcugugauacaggaugaggaaagagacauuccagagagguccuggaacaguggguaugaguggaucaccgauuucccuggaaagacgguuugguucgugcccagcauuaagucgggcaaugacaucgcgaacugucugcgcaaaaauggcaagcgagucauacagcucucuagaaaaacuuuugauacagaauaccagaagaccaaaaacaacgacugggacuacgugguuaccacugauauuuccgagaugggggccaauuuccgggcagacagggugaucgauccacgccguugcuugaagccugucauccugaaggacggacccgaaagagugauucucgcugguccaaugccgguaacaguggccagcgcagcccaacggaggggccgcaucgggcgaaaccacaauaaagagggagaucaguauauuuacaugggccagccucugaacaaugacgaggaucaugcucacuggaccgaagccaagaugcuucuagacaacauaaauacacccgaggguaucauuccagcgcuguuugaacccgagagagaaaaaucagcagccaucgauggggaguaucgguugaggggcgaggcucgcaagacuuucguugaauuaaugagaaggggagaccugccugucuggcucagucacaaaguggccucugagggcuuucaguacuccgaucggcguuggugcuucgacggggaacgcaacaaucaagugcuggaggaaaacauggaugucgagaucuggacgaaggagggagaacgaaagaaacuuagaccaagguggcuggacgcucggaccuauagcgacccccucgcauugcgcgaguuuaaagaguucgccgcugguagaaggucaguuaguggcgaucugauucuagagauagggaaacugccucagcaucucacacagcgggcccagaaugcacuugacaaccuggugauguuacacaauagcgaacaaggaggccgagcguacagacaugccauggaggaguugccggauacuaucgaaacccugaugcuccuggcucuuauugccguacugacagguggggugacccucuuuuucuuguccggccgcggacugggcaagacuucuaucggguuacuaugugucauggcaagcuccgugcugcucuggauggcuucaguugagccacacuggauugccgcaucuaucauacuugaauuuuuccugaugguguugcugauccccgagccugacaggcagcggacgccccaggauaaccagcucgccuaugucguaauuggacugcuuuuuaugauccucaccguggcugcgaaugagaugggucuguuggaaacaacuaaaaaggaccugggcauugggcacgccgcaguugagaaccaucaccaugcugccauguuagauguggaccuacacccagccagugcauggacccuguacgcugucgccacaaccaucauaacuccuaugaugcgucauacaauugaaaacacgaccgcgaauaucucgcucacugcuauugccaaccaagcagccauccuuaugggacuggauaaaggcuggcccauaagcaagauggacaucggugugccauugcuggcucucgggugcuacucccaggucaauccucugacacuuaccgcagccguguuaaugcugguugcgcacuaugcuauuaucggcccgggacuccaggccaaggcaaccagagaggcccaaaagaggacagcugccggcauuaugaagaaccccacuguggaugggaucguagcaauagacuuggauccaguggucuacgacgcuaaauucgaaaagcagcugggacagauuaugcuacugauccucuguacgucucagauccuucugaugcgcaccacaugggccuugugcgagucaauuacucuggcgaccggcccucucacaacccugugggaggguagccccgggaaauucuggaauacuacgaucgccguuuccauggcaaacauauuucggggaaguuauuuagcuggcgccggucuugcauucucucugaugaaaagccucggcgggggacgaagaggcacaggggcucaaggagaaacccuaggcgagaaguggaaaaggcagcugaaucaguugucaaaguccgaauuuaacacuuacaaacgcagugguauuauggagguggaccggagcgaagccaaggaggggcugaaaagaggagagaccacaaagcacgccgucucucguggcacugcgaagcucaggugguucguggaacggaaucuuguaaaaccagaggguaaggugaucgaucugggcugugggcgcggaggcugguccuauuacugcgcuggguugaaaaagguuaccgaagugaaaggauauacaaagggcgguccugggcaugaggaacccauuccgauggcaacguacggauggaaccuggucaaacuccacucaggcaaggacguguuuuucaucccaccugagaagugugauaccuuacugugcgacauaggcgagagcucgcccaauccaacuaucgaagaggggcgaacacuuagaguccugaaaaugguggaacccuggcuaaggggaaaccaguuuuguauuaagauccucaauccuuacaugccgucuguuguagagacccuggagcaaaugcagcggaaacaugguggcauguuggugcgcaacccccugaguagaaauuccacucacgaaauguauugggucagcugcgggacaggaaacauugugucagccguuaauaugaccuccaggaugcuccuuaaccgauucacgauggcucaccggaagccaaccuacgagcgugauguggaccugggcgccgguacaagacaugucgcaguggaaccugagguagccaacuuagauaucauugggcagcgcaucgaaaauauaaaacacgagcauaagucuacuuggcacuaugacgaggauaaccccuacaagaccugggcuuaucauggaagcuacgaagugaaaccuaguggcuccgcgagcucuaugguuaauggcgucgugaagcuguugacaaaaccaugggacgugauucccauggucacucagaucgccaugaccgauacaaccccuuuugggcaacagaggguuuucaaggagaaaguggacacucggacgccaaaggcaaagagaggaacagcucagaucauggaaguaaccgccaaauggcucugggguuuucugucacgcaacaagaaacccaggauuuguacucgagaggaguucacccggaaggugagaaguaaugcagccauaggcgcugucuuuguggacgagaaccaauggaacuccgccaaagaggcgguugaagaugagagguucugggaccuagugcaccgcgaacgugagcuucacaagcaggggaagugcgcaacaugcgucuauaacaugaugggaaaacgggaaaagaaacugggcgaguucgguaaggccaaagggagcagagcuaucugguacauguggcucggagccagguuucuggaguucgaagcauugggcuuuaugaaugaggaucauugguucucucgcgaaaacucgcugucaggcguggagggggagggacuccacaaacuugguuacauucugcgagacaucagcaaaauuccgggcgggaauauguaugcugaugacacggccggaugggauacccggaucacugaagacgauuuacagaacgaggcuaagauaacagacaucauggaaccugagcaugcccuguuggcaaaguccauuuuuaaacucaccuaccagaauaagguaguuagagugcaaaggccagcgaaaaacggcacugucauggaugugaucagucgcagagaccagcgggguucuggacaggugggaacauauggccugaauaccuucacaaacauggaagcccagcuaauuaggcaaauggagagcgagggcaucuuuucccccucagaacuugagacuccuaaccuggcugggcguguccucgauuggcuggaaaagcacggaguugagcgauugaaacgcauggccauaaguggugacgacugugugguaaagccaauugaugacagauucgcaaccgcuuuaacggcccugaaugauaugggcaaggugcggaaagacaucccccagugggaaccgucuaagggguggaacgauuggcagcaggucccuuuuugcagccaccauuuccaccaacucaucaugaaagacggaagggagauugugguucccugucgcaaucaggaugagcuugugggcagagcacgggucucccagggugccggguggucacugagggaaaccgcgugccuaggaaagagcuacgcucagauguggcaacugauguauuuucaucgacgugaccucagauuggccgcaaacgccauauguucugcugugccaguagauuggguuccuacaucccgcacuaccuggaguauccacgcccaucaccaguggaugacaacugaggacaugcugagcguguggaaucgggucuggauugaagagaaccccuggauggaagauaaaacccacaucucguccuggggcgacgugccauaccuuggcaagagggaggaccaguggugcgggucucugauuggacucacggcaagagcuacaugggccaccaauauccaaguugcgauaaaccaggugcgccgguuaaucgguaaugagaacuaucuggauuacaugacuucaaugaagagguucaaaaaugaaagcgaccccgagggcgcuuugugguga

SEQ ID NO: 13935 - RNA, 9879 nt, Artificial Sequence
  derived and/or modified CDS sequence (opt3) from DENV-1__GU131761__SS-prME
agcgugaccaugcugcucaugcuuaugcccaccgcccuggcuuuccacuugacuacgagaggaggggaaccucauaugaucgucuccaagcaggaaaggggaaaaucuuuacuguuuaagaccucagccgguguuaauaugugcacgcugauugccauggaccucggcgaacugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaacuugccgagacgcagcacggaacagucuuggugcagauaaaguacgagggcaccgacgcuccuugcaaaaucccauucucgacucaagaugaaaaggggguuacacagaacggacgccugauuaccgcgaaucccaucgugacugacaaagagaagccuguaaacauagaagcagagccacccuuuggcgagucuuauauugucaucggugccggggaaaaagcucucaagcuguccugguucaagaaaggcucaaguaucggaaagauguuugaggccaccgcaagaggcgccaggcggauggcuauucuuggggauacagccugggacuucggaagcaucgguggcguguuuacguccguugggaaacuggugcaucagauuuucggaaccgcauacggcgucuuguuuucuggugugagcuggacuaugaagauagggaucggcguacuccugacaugguuaggacuaaauucacgaaguaccucccuaagcaugacauguauugcggugggccucguuacucuguaccuuggggucauggugcaggcugauucuggaugcgugaucaacuggaaaggccgcgaauugaagugugguucagggaucuucgucaccaaugagguucacacguggacagaacaauauaaguuucaggccgacaguccgaaaagacugagcgcagccauuggaaaggcuugggaggagggcgugugcgguauaagguccgccacccggcucgaaaacaucauguggaaacagauuucuaacgagcugaaucauaucuuacuggaaaacgacaugaaguucacugugguagucggcgauguggcagggauucuugcucagggcaaaaagaugauccgcccucaacccauggaguacaaauauucguggaaaagcuggggcaaggccaagauaaucggggcggacguucagaauaccacauuuauuaucgauggaccaaacacuccugaaugucccgacgaucagagagccuggaauauuugggagguggaggacuacggcuucgguaucuuuaccacaaacauaugguugaagcucagggauuccuauacgcaggucugcgaccaccgucugaugucagcugcaauuaaagauaguaaggccgugcacgcugacaugggguacuggaucgaaucugagaaaaaugaaaccuggaagcuagcccgggcauccuucauugagguuaagacuuguaucuggccaaaaucccauacacuguggucaaacggagugcucgaaagcgagaugauaauccccaagauuuauggcgguccuaucucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagauuauccacgaaugguguugccgcaguuguacccucccuccacugcgguucagaggugaggacgggugcugguauggaauggagauaaggcccgucaaagaaaaggaggaaaaucuuguuaagagcauggugucugccggcuccggugagguagacucauuuagucugggcuugcucuguauuagcaucaugaucgaagaggugaugcgcucgcgauggucccggaaaaugcugaugacugggacacuagcugucuucuuucugcucauuaugggacagcugaccuggaacgaucuuauccguuugugcauuauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaauaggucugucauuggucgccaguguggaacugccaaacuccuuagaggaacucggggauggacuggcuaugggcaucaugauucuuaaacuguugaccgacuuucaaucucaucagcucugggcgacucugcuaagccugaccuucaucaagacaacuuuuucccuucacuaugccuggaaaaccauggcaaugauucucucaaucguuagccuguuccccuugugucugaguacgacaucucagaagaccacuugguuaccggugcuccugggcucccuugggugcaagccucugacaauguuuuugauagcugagaauaaaaucuggggaaggcgaagcuggccacucaacgaagguauuauggccgucggcaucguaucgauucugcuaucaucucugcuuaagaacgaugugccccucgccgggccucugaucgcuggaggcauguugauagcauguuacguuauuagugguuccagcgccgacuuaucucuggagaaagcggcugaggugagcugggaagaggaagccgagcauuccggggcaucacacaauauccucgucgaagugcaggaugacggaaccaugaagauccaagaugaggagcgcgacgauacucugacaauucuucugaaagccaccuugcuagcuguaaguggcguguauccccugagcauaccagcaacacucuucgucugguacuucuggcagaagaaaaagcagcggucuggcguucugugggacacuccuucacccccagaaguggagagagccgugcuugaugacgggaucuauaggauuaugcagcguggauuacugggucgcagccaagucggcguggggguuuuucaggaaaacguauuccauaccauguggcacgugacacggggagcgguccucauguaccagggcaagagauuggagccgaguugggcuagcgugaaaaaggaccugaucuccuacggugggggauggaggcuccagggcucuuggaauaccggcgaggaaguucaagugauugccgucgagccugggaaaaaccccaagaaugugcagacagcaccaggaacuuuuaaaacccccgaaggugagguaggcgccaucgcucuggauuucaagccugggacgucgggaagcccaauagucaaccgagaaggcaagaucgugggucuuuaugggaauggaguugugacaacuucaggcaccuacgucuccgccauugcacaggcuaaagccagucaagagggcccccugccugagaucgaagacgagguguuucggaagcgcaacuugacaauuauggaucuacacccggggucuggaaaaaccagaagguaucugccagcgaucguucgggaagccauaaagcgaaaacucagaacuuuaauucuggcacccacccgcguggucgcuagcgagauggccgaagcucuuaaggguaugccuaucagguaccagacaacggcagugaaguccgagcauacuggcaaagagaucguagaccugaugugccacgccaccuucacaaugcgucucuugucaccagugcggguucccaauuauaacaugauuaucauggaugaagcccauuuuaccgacccuucuagcauagcugcgagaggguacauuaguacuagggucggaaugggcgaggcagccgcuaucuucaugacagccaccccgcccgguuccguggaagcauuuccacagagcaaugccgugauucaggaugaggaacgcgacaucccugagcgaucuuggaacucaggguaugaguggauaacggauuuccccggaaagacugucugguuuguaccauccauuaaaaguggcaaugacaucgcuaacugucugagaaagaauggcaaacgggugauccaacucagcaggaagacauucgauaccgaauaccagaagaccaaaaacaacgacugggacuacguugugacuacagauauuucggagaugggggcgaauuuccgcgccgaccgugucaucgauccuagacggugccugaagcccgugauucuuaaagacggaccagaaaggguuauacuagcagguccgaugccugugaccgucgcuucugccgcacagcgccgaggcagaaucgggcggaaccacaauaaggagggagaucaguauauuuacaugggccaaccccugaacaaugacgaggaucaugcccacuggacagaagcuaaaauguuguuagacaacaucaauacuccagaggguaucauucccgcccuguuugaaccugagagggaaaaguccgcggcaauagauggggaguaucgccucagaggcgaggccaggaagacguucguggaacugaugcggcguggagaccuuccaguauggcugagcuacaaaguggcuucagagggcuuucaguauagugaucgccgauggugcuucgacggggaaagaaacaaucagguucucgaggaaaacauggaugucgagaucuggaccaaggagggagaaaggaaaaaguugcggccccgcuggcuggacgccagaacauacucugacccucuagcucugagggaguuuaaagaguucgcagccggucggcgauccgugagcggcgaucucauucuugagaucgggaagcugccgcagcacuuaacucaaagagcucagaaugccuuggacaaccuggugaugcuccauaauucagaacagggaggccgcgcauauaggcacgcgauggaggagcugccagauaccauugaaacacuuaugcugcucgccuugaucgcuguccugaccggugggguuacuuuauuuuuccuaaguggccggggacugggcaaaacgagcauagggcuccuuugugugauggccuccucuguacuguuguggauggcaagcguggagccccauuggaucgcugccuccauuauccuggaauuuuuccucaugguccugcuuauuccugagcccgaccgucagagaaccccacaagauaaccagcucgcauacgugguuaucggacuguuguuuaugauacugacaguggccgcuaaugagauggguuuacuagaaacuaccaagaaggaccugggcauugggcacgucgcgguagagaaccaccaucacgccgcaaugcucgauguggaccuucauccugcuucagccuggacacuguacgccguugcaaccacuaucauuacacccaugaugaggcacacgaucgaaaacaccacugcuaauauaucuuugacagccaucgcgaaccaggcugccauucugaugggacucgauaaaggcuggccaaucaguaagauggacauuggugugccucugcuugcauuagggugcuauucgcaagucaauccgcugacccucaccgccgcuguguugaugcuggucgcacauuacgccaucauaggccccggacuacaggcgaaagcuacacgcgaggcccagaagcggacugcagccggcauuaugaaaaacccaacgguggaugggaucguugcuaucgaccuggauccugugguauaugacgccaaguucgaaaagcagcucggacaaauuaugcuucugaucuuguguaccagccagauacugcucaugcgaacaacuugggcacugugcgaguccauuaccuuagcuacaggcccccuuaccacucugugggaggguucuccagggaaauuuuggaauacgacaaucgccgugucaauggcgaacauuuucagaggaagcuaccucgccggcgcaggucuagcuuucucccugaugaagaguuugggcgggggaaggcgcggcaccggggcccagggagaaacucugggcgagaaauggaagcggcagcucaaucaacuuucuaaaagcgaauuuaacaccuauaagagaucagguaucauggaggucgaccguuccgaagcaaaggaggggcugaaaaggggagagacaacuaagcacgcuguuagucggggcaccgccaaauugcgcugguucguggaacgaaaucuggucaagccugaggguaaagugauagaucucggcugugggagaggaggcuggagcuacuauugcgccggguuaaagaagguaacagaagugaaaggauacacgaagggcggucccgggcacgaggaaccgaucccaauggcgaccuacggauggaaccugguuaaacuucauucuggcaaggacguguuuuucauuccucccgagaaaugugauacucugcuaugcgacaucggcgaguccucaccaaaucccacaauugaagaggggaggacccuccggguccugaagaugguggaaccuugguugcgcggaaaccaguuuuguaucaaaauucugaauccguauaugcccagcgucguggagacucucgagcagaugcagagaaagcacgguggcaugcuuguuaggaacccacugucgcgaaauucuacacaugaaauguacuggguaaguugcgggaccggaaacaucguguccgcugucaauaugacgagccggauguuacugaaccguuucaccauggcacacagaaagccuacauaugagcgcgauguggacuugggcgccgguacuaggcacguugcuguggaacccgaggucgccaaccucgauauaauugggcaacggaucgaaaauaucaaacaugagcacaagucaaccuggcauuacgacgaggauaacccuuauaaaacaugggcauaccacggauccuaugaagugaagccaucuggcagcgccaguuccaugguaaauggcgugguuaaacugcuaacuaagcccugggacgucauuccuauggugacccagauagcuaugacagauaccacuccauuugggcagcaaagaguguucaaggagaaagucgacacgcgcacacccaaggcgaaaaggggaaccgcccagaucauggaaguuacugcaaaguggcuuugggguuuucugagccgaaacaaaaagccgcggauuuguaccagagaggaguucacaaggaaggugcgcucuaaugcugccaucggcgcaguauuuguggacgagaaccaguggaacucagccaaagaggcugucgaagaugagcguuucugggaccucgugcaucgggaaagagagcugcacaagcaggggaaaugcgccacgugcguuuacaacaugaugggaaagagggagaaaaaguugggcgaguuugguaaggcgaaagggagucgcgcaauuugguacauguggcugggagcccgauuccucgaguucgaagcucuuggcuuuaugaaugaggaucacugguucucccgggaaaacagccugucuggcguggagggggagggauuacauaagcuggguuauaucuugagagacauaucgaaaaucccuggcgggaauauguacgccgaugacaccgcaggaugggauacuaggauuacagaagacgaucuccaaaacgaggcucgcaucaccgacauuauggaaccagagcacgcccugcuagcuaagucaaucuuuaaacuuacuuaucagaauaaggucgugagaguacagcggcccgccaaaaacggcacaguuauggaugugauaagcaggcgugaccagcgagguuccgggcaagucggaaccuacggccugaauacauucacuaacauggaagcacagcucauucgccagauggagagugagggcaucuuuucuccuagcgaacuggagaccccaaacuuggcggaaagaguguuagauuggcuggagaaguaugggguggaacggcucaagaggauggccaucuccggagacgacugugucguuaaacccauugaugaccgcuucgcuacggcccuuaccgcacugaaugauauggguaaggugagaaaagacauaccgcagugggagccuucaaagggcuggaacgauuggcaacagguacccuuuugcagucaucacuuccaccagcuaaucaugaaagacgggcgggagauuguggucccauguaggaaucaggaugaacuggugggacgagcucguguuucucaaggcgccgguuggagccucagagagacagcaugcuuggggaaguccuacgcccagauguggcagcugauguauuuucaucgccgggaccuuaggcuggcggcuaacgccaucuguucagcagugccugucgauuggauucccacuagcagaaccacauggucuauccacgcccaucaccaauggaugacuaccgaagacaugcucuccguguggaaucgcguauggauagaggaaaacccauggauggaggauaagacgcauaucaguagcuggggagacguucccuacuuaggcaaacgggaggaccaguggugcggcucgcugauuggguugacagcuagggccaccugggcaacuaauauccagguggcuauuaaccagguccgaagacugaucggaaaugaaaacuaccucgauuauaugacauccaugaagcgguucaaaaaugagucugacccugaaggugcccuuugguga

SEQ ID NO: 13936 - RNA, 9879 nt, Artificial Sequence
  derived and/or modified CDS sequence (opt3) from DENV-1__GU131762__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccaugagcuuaucuaugacuuguauugcuguuggccuggucacacuauaccucggggugauggugcaggccgauucaggaugcgucaucaacuggaaaggccgcgaacugaagugugguagugggaucuuuguuaccaaugaggugcacacauggacugaacaauauaaguuccaggcagacagcccgaaaagacuuuccgccgcuauuggaaaggccugggaggagggcgugugcgguauaaggucugcaacccgguuggaaaacaucauguggaaacagauuucgaacgagcugaaucauauccuccuggaaaacgacaugaaguuuacgguagucgugggcgauguugcugggauuuuagcccagggcaagaagaugauccgcccucaacccauggaguacaaauauagcuggaaguccuggggcaaggcgaaaauaaucggggccgacgugcagaauacaaccuucauuaucgauggaccaaacacuccugaaugucccgacgaucagagagcuuggaauauuugggaggucgaggacuacggcuuugguaucuucaccacaaacauauggcugaaacuuagggauucauauacucaggugugcgaccaccguuugaugagugcagccauuaaagauucuaaggcuguucacgccgacaugggguacuggaucgaaagcgagaaaaaugaaaccuggaagcucgcacgggcguccuucauugaggugaagacauguaucuggccaaaaucacauacgcuguggagcaacggaguacuagaaucugagaugauaauccccaagauuuauggcgguccuaucucccaacacaauuaccgaccaggcuacuuuacccagacugccgggccguggcaucugggaaaacucgagcuggauuucgaccuuugcgaaggcacaaccgucgugguggaugagcacugcgggaacagaggacccaguuugaggacuacaaccgucacgggcaagauuauccacgaaugguguugccgcagcuguacucugccuccauuacgguuuaaaggugaggacgggugcugguauggaauggagauaagacccguuaaggaaaaggaggaaaaucucgugaaaucuaugguauccgcuggcucaggugagguggacaguuucagccugggccuucuguguauuucgaucaugaucgaagaggucaugaggucccgcuggucucgaaagauguugaugaccgggacacucgccguguuuuuccugcuaauuaugggacagcugaccuggaacgaucucauccggcugugcauuaugguuggcgcaaaugcuagcgaccguauggggaugggaacuacauaccuugccuugauggcaaccuuuaaaaugagaccuauguucgccgugggccuguuauuuaggcgccucacaucacgggagguccugcuucugacuauaggucuaagucucguggcuuccguugaacugccaaacucuuuggaggaacugggggauggauuagcgaugggcaucaugauucucaagcugcuuaccgacuuccaaagccaucagcugugggccacguugcucucccugacauuuaucaaaaccacuuucucacuacacuaugcauggaagaccauggcuauggugcugagcauugucagucuuuuuccccucugucugucuacaacuucccagaagaccacgugguugccgguacuguuaggcagccucgggugcaaaccucugacaauguuccuuaucgccgagaauaagauauggggaagaaaaucguggccacugaacgaagguaucauggccgugggcauuguuucaaucuugcucucuagucugcuaaagaacgaugugccccuggcugggccucuuauugcaggaggcaugcucaucgccuguuacgucauauccgguagcucugcggaccugagcuuggagaaagcugccgagguguccugggaagaggaagcagagcauucaggggccagucacaauauuuuaguagaagugcaggaugacggaaccaugaagaucaaagaugaggagagggacgauacucugacaauccuccugaaggcuacccuucuggcagucagcggcguuuaucccuugucuauuccagccacucuauuccugugguacuuuuggcaaaagaaaaagcagcgauccggcgugcucugggacacaccuucacccccagaaguggagcgcgcgguccuggaugacgggauauaucggaucaugcagagaggacuuuuagguaggagucaggugggcguugggguauuccaagaaaacguguuucauaccauguggcacgucacgcguggagcugugcugauguaccagggcaaacgccucgagccgagcugggccuccguuaagaaagacuugauuucuuacggugggggauggcggcugcagggcucguggaauacuggcgaggaagugcaggucaucgcaguggagccugggaagaaccccaagaauguacaaaccgccccaggaacauucaaaaccagcgaaggugaggucggcgcuauugcccucgauuuuaagcccgggacaucaggauccccuaucgugaacagagaaggcaaaauaguuggucuguaugggaauggaguggucacuaccaguggcacguacgugucugcaaucgcucaggccaaggcgagccaggagggcccacuucccgagauugaagacgagguuuucaggaaacgaaaccugacaaucauggauuugcacccuggguccggaaagacucggcgcuaucuaccggccauugugagagaagcaaucaagaggaaacugcggacccucauauuagcuccaacacgagucguggccucagagauggcugaagcacugaaggguaugcccauuagauaccaaaccacugccguaaaaucugagcauaccggcaaggagaucguggaccuuaugugccacgccacauuuacgaugcgccugcucagcccuguuagggucccaaauuauaacaugaucauuauggaugaagcucauuucacugaccccaguuccaucgcggcacguggguacauaagcacccgggugggaaugggcgaggccgcugccauuuuuaugacagcaaccccuccggguucuguggaagccuucccccagucaaaugcugucauccaggaugaggaaagagacauuccagagagguccuggaacaguggguaugaguggaucacugauuuuccuggaaaaacaguaugguucgugcccagcauaaagucgggcaaugacauugcgaacuguuugcgcaagaauggcaaacgaguuauccagcugucuagaaagaccuucgauacggaauaccagaagacuaagaacaacgacugggacuacguggucacaaccgauaucuccgagaugggggccaauuuucgggcagacagggugauugauccacgccguugccucaaaccuguuauccugaaggacggacccgaaagagugauucuugcugguccaaugccggucaccguggccagcgcagcccagcggaggggccgcauagggcgaaaccacaauaaggagggagaucaguauaucuacaugggccagccucuaaacaaugacgaggaucaugcucacuggacugaagccaaaaugcuguuggacaacauuaauacacccgaggguaucaucccagcguuauucgaacccgagagagaaaagucagcagccauugauggggaguaucggcugaggggcgaggcucgcaaaaccuuuguagaacucaugagaaggggagaccugccuguguggcuuaguuacaagguugccucugagggcuuccaauauuccgaucggcguuggugcuuugacggggaacgcaacaaucagguccuggaggaaaacauggauguggagauauggacaaaagagggagaacgaaagaaacucagaccaaggugguuggacgcucggguguacagcgacccccuggcacuacgcgaguucaaggaauuugccgcugguagaaggucagucaguggcgaucugauccucgagauugggaaacuuccucagcaccugacucagcgggcccaaaaugcauuagacaacuugguuaugcugcauaauagcgaacagggaggccgagcguauagacacgccauggaggagcucccggauacgaucgaaacccugaugcuucuggcucucauugccguguugacaggugggguaacucuguucuuuuuauccggccgcggacuaggcaaaaccucuaucgggcugcucugugugauggcaagcuccguccuucuguggauggcuucaguggagccacauuggauagccgcaucuaucauuuuggaguucuuucugaugguucuccugauccccgagccugacaggcagcggacaccccaggauaaccaacuugccuacguggucauuggacuccuguucaugaucuugaccguagcugcgaaugagaugggucuguuagaaacuacgaagaaagaccuaggcauagggcacguggccguugagaaccaccaucacgcagcuaugcuggauguggaccuccauccagccagugccuggacccuuuacgcagucgcuacaacuauuaucaccccuaugaugcgucacacaauugaaaacaccacugccaauaucucgcugacagcgauagcuaaccaggccgcaaucuugaugggacuggauaagggcuggcccauuagcaaaauggacaucggugugccacuccuggcccuugggugcuauucccaggucaauccuuuaacgcugaccgcugcagugcucauguugguugcccauuacgcgauuaucggcccgggacugcaagcuaaggccacuagagaggcacagaagaggacagccgcuggcauaaugaaaaaccccaccguggaugggauuguagccaucgaccuagauccaguggucuaugacgcaaaguuugaaaaacagcugggacagaucaugcuccuuauucuguguaccucucaaaucuugcugaugcgcacaacuugggcucucugcgagucaauaacgcuggccaccggcccuuuaacaacucuuugggaggguagccccgggaaguucuggaauaccacaauugcgguuuccauggccaacaucuuccggggaaguuaccuggcaggcgcuggucucgccuuuucucuaaugaaaagccugggcgggggacgaagaggcaccggggcacagggagaaacuuugggcgagaaguggaagaggcagcugaaucagcucucaaaauccgaguucaacacguauaagcgcagugguauuauggagguggaccggagcgaagcuaaagaggggcuuaagagaggagagacaaccaaacacgccgucucucguggcacugccaagcugaggugguuuguggaacggaauuugguaaagccagaggguaaagugaucgaucugggcugugggcgcggaggcugguccuacuauugcgcggggcucaagaaaguuaccgaagugaagggauacacaaaaggcgguccugggcacgaggaacccauaccgauggcuacuuacggauggaacuuagucaagcugcauucaggcaaagacguguucuuuaucccaccugagaagugugauacccuucugugcgacauuggcgagagcucgcccaauccaacaaucgaagaggggcgaacgcuaagaguccucaagaugguggaacccuggcugaggggaaaccaauucuguauuaaaaucuugaauccuuauaugccgucuguuguagagacccuggagcagaugcagcggaagcacgguggcaugcucgugcgcaacccccuuaguagaaauuccacucaugaaauguacugggucagcugcgggacaggaaacauugugucagcaguuaauaugaccuccaggaugcuguuaaaccgauuuacuauggcccaccggaaaccaacauaugagcgugauguggaccugggcgcugguaccagacacgucgccguggaaccugagguagcaaacuuggauaucauagggcagcgcauugaaaauaucaagcaugagcacaaaucuacguggcauuacgacgaggauaaccccuauaagaccugggccuaccacggaagcuaugaagugaagccuaguggcuccgcuagcucuaugguuaauggcgucgugaaacuccugacaaagccaugggacgugauccccauggucacucaaauugcgaugaccgauacaacuccuuucgggcagcagaggguuuuuaaagagaagguggacacccggacaccaaaagccaagagaggaaccgcacaaauaauggaaguaacugcuaaguggcuaugggguuuccuuucacgcaacaaaaagcccaggaucuguacgcgagaggaauuuacacggaaagugagaaguaaugccgcaauuggcgccgucuucguggacgagaaccaguggaacuccgcuaaggaggccguugaagaugagagguuuugggaccuggugcaucgcgaacgugagcuccacaaacaggggaagugcgcgaccugcgucuacaacaugaugggaaagcgggagaaaaagcugggcgaguucgguaaagcaaaggggagcagagccaucugguacaugugguugggagcuagguuccuggaguuugaagcccucggcuucaugaaugaggaucacugguuuucucgcgaaaacucgcuuucaggcguggagggggagggacugcauaaauuagguuauauucugcgagacaucagcaagauaccgggcgggaauauguacgcagaugacacugcuggaugggauacccggaucacagaagacgauuugcagaacgaggccaaaauuacggacaucauggaaccugagcacgcucuccuggccaaguccauuuucaagcuaaccuaucaaaauaaaguaguuagagugcagaggccagcaaagaacggcacugucauggaugugaucagucgcagagaccagcgggguucuggacaggugggaacauacggccuuaauaccuuuacuaacauggaagcgcaacugauaaggcagauggagagcgagggcauuuucucccccucagaacucgagacaccuaaccuggccgggcgugucuuggauugguuagaaaaacauggaguugagcgacugaagcgcauggcuaucaguggugacgacugugugguaaaaccaaucgaugacagauuugccaccgcacucacagcucuuaaugauaugggcaaggugcggaaggacauuccccagugggaaccgucuaaaggguggaacgauuggcagcaagucccuuucugcagccaccacuuucaucagcugauaaugaaggacggaagggagaucgugguucccugucgcaaucaggaugagcuagugggcagagcccgggucucccagggugcaggguggucacugagggaaacugccugccucggaaaaagcuaugcgcaaauguggcaguugauguacuuccaccgacgugaccugagacuugcugccaacgcaauuuguucugccgugccaguagauuggguuccuaccucccgcacgaccuggaguauccaugcucaccaucaguggaugacaacugaggacaugcugagcguguggaaucgggucuggauugaagagaaccccuggauggaagauaagacccacaucucguccuggggcgacgugccauaucucggcaaaagggaggaccaauggugcgggucuuuaauaggacugacagccagagcaacuugggcuaccaauauccagguugccauuaaccaggugcgccgguugaucgguaaugagaacuaccuggauuacaugacgucaaugaagagguuuaagaaugaaagcgaccccgagggcgcgcucugguga

SEQ ID NO: 13937 - RNA, 9879 nt, Artificial Sequence
  derived and/or modified CDS sequence (opt3) from DENV-1__GU131763__SS-prME
agcgugaccaugcugcucaugcuuaugcccacagcacuggcuuuccacuugacuacgagaggaggggaaccucauaugaucgucaccaagcaggaaaggggaaaauccuuacuguuuaagacaucugccgguguuaauaugugcacucuaauugcaauggaccucggagaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggccagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggccuuggugagguggacuccuuuucacugggcuugcucuguauuaguaucaugaucgaagaggucaugaggagccgcuggucgcgaaagaugcugauggcugggacccuagccguguuccugcuccugauuaugggacagcuuacuuggaacgauuugauccggcugugcauuaugguuggcgcaaaugcuuccgaccguauggggaugggaacaaccuauuuagcccucauggcaacauuuaaaaugagaccuauguucgccgugggccugcuuuuuaggcgccugacuucucgggagguccuacuccugaccauagguuugagccugguggcuucaguugaauuaccaaacagucucgaggaacugggggauggacuugcgaugggcaucaugauucugaaguugcucacggacuuccaaucccaccagcugugggccacacuacugucucuuaccuuuaucaaaacuacccucagccugcauuacgcauggaagacaauggcuaugguguuguccauugucucacuguuccccuuaugucucagcacuaccagucagaagacgacauggcugccgguacuucugggcucuuuggggugcaaaccucucaccauguuucugaucgccgagaauaagauauggggaagaaaauccuggccacuaaacgaagguaucauggccgugggcguugugagcauucugcuuucgucacuccugaagaacgauguccccuuggcugggccuuuaaucgcaggaggcaugcugauugccuguuaugugaucucugguaguuccgcggaccucagccuggagaaagcugccgagguaucuugggaagaggaagcagagcacagcggggccucccauaauauacuuguggaaguccaggaugacggaacuaugaagauuaaagaugaggagagggacgauacacugaccaucuugcuaaaggcuacucugcucgcaaucucaggcguuuacccccugaguauuccagccacacuuuucgugugguauuuuuggcaaaagaaaaagcagcgaagcggcguguuaugggacaccccuucucccccagaagucgagcgcgcggugcuggaugacgggauauaccggaucaugcagagaggacucuuggguaggucccagguuggcguagggguguuccaagaaaacgucuuccacacgauguggcacgugacucguggagcuguucugauguaucagggcaaacgccucgagccgucaugggccagugugaagaaagaccugauuagcuacggugggggauggcggcuucagggcuccuggaauaccggcgaggaaguccaggugaucgcaguagagccugggaagaaccccaagaauguccaaacagccccaggaaccuuuaaaacacccgaaggugaggugggcgcuauugcccuggauuucaagccugggacuucuggaucgccaaucguuaacagagaaggcaaaauaguggguuuguacgggaauggagucgugaccacgagcggcacauauguuucagcaaucgcucaggccaaggcgucccaggagggcccccuaccugagauugaagacgagguguuuaggaaacgaaaccugacuaucauggaucuccauccggggaguggaaagacccggcgcuacuuaccagccauugucagagaagcaaucaagaggaaacugcggacacuuauacuggcucccacccgagugguagccucugagauggcugaagcacucaaggguaugccuauuagauaucaaacuaccgccgugaaaagcgagcacacaggcaaggagaucguugacuugaugugccaugccacguucacuaugcgccugcucuccccagucagggugcccaauuacaacaugaucauuauggaugaagcucacuuuaccgacccuucaucuaucgcggcacguggguauauaagcacacgggugggaaugggcgaggccgcugccauuuucaugaccgcaacuccgcccgguagugucgaagccuuuccacaguccaaugcuguaauccaggaugaggaaagagacauuccugagaggagcuggaacucuggguacgaguggaucacagauuuccccggaaaaaccgugugguuuguuccaucaauaaaguccggcaaugacauugcgaacugucugcgcaagaauggcaaacgagugauccagcuuaguagaaagacguucgauacugaauaucagaaaaccaagaacaacgacugggacuacgucgugaccaccgauaucagcgagaugggggccaauuuucgggcagacaggguuauugauccucgccguugccuaaaacccgugauccugaaggacggaccagaaagagucauuuuggcugguccgaugccugugacuguagccucggcagcccagcggaggggccgcauagggcgaaaccauaauaaggagggagaucaguacaucuauaugggccagcccuuaaacaaugacgaggaucacgcucacuggacagaagccaaaaugcugcucgacaacauuaauaccccagaggguaucauccccgcgcuguucgaaccugagagagaaaagucugcagccauugauggggaguaccggcuuaggggcgaggcucgcaaaacauucguggaacugaugagaaggggagaccucccaguuugguuguccuauaaggucgccagcgagggcuuucaauacucagaucggcguuggugcuucgacggggaacgcaacaaucaggugcuggaggaaaacauggauguggagauauggacuaaagagggagaacgaaagaaacuaagacccagguggcuggacgcucggacguauagugacccucucgcacuucgcgaguuuaaggaguucgccgcugguagaaggucugucuccggcgaucugaucuuagagauugggaaguugccgcagcaucugacccagcgggcccaaaaugcacucgacaaccugguuaugcuucacaauagcgaacagggaggccgagcguacagacaugccauggaggagcugccagauacaaucgaaacucucauguugcuggcuuuaauugccgugcuaaccggugggguaacacuguuuuuccucucaggccgcggacuuggcaaaaccaguaucgggcuguugugugugauggcaagcuccguccugcucuggauggcuucuguggagccccacuggauagccgcaagcaucauucuggaauuuuuccuuaugguucuccugaucccugagcccgacaggcagcggacuccacaggauaaccaauuggccuauguggucauuggacuguuauuuaugauccuaacgguagcugcgaaugagaugggucugcucgaaaccacaaagaaagaccuuggcauagggcacguggccguugagaaccaucaccaugcaacuaugcuggauguggacuugcacccugcuuccgccuggacccuguacgccgucgcaacaaccauuaucacucccaugaugcgucauacaauugaaaacacgaccgcuaauaucucacucacugccauagcgaaccaggcugccauccugaugggacuugauaagggcuggccaauuucuaaaauggacaucggugugccuuuacuggcacucgggugcuacagucaggucaauccguugacacugaccgccgcugugcuaaugcugguugcacacuaugccauuaucggccccggacuccaagcgaaggcuaccagagaggcccagaagaggacagcagccggcauaaugaaaaacccaacuguggaugggauuguagcuaucgaccuugauccuguggucuacgacgccaaguucgaaaaacagcugggacagaucauguugcugauucucuguacgucgcaaauccuguuaaugcgcaccacaugggcacuuugcgagagcauaacucuggcuaccggcccccucacaacccuaugggaggguuccccagggaaguuuuggaauacuacgauugccguuucuauggcgaacaucuuccggggaucauaucuggccggcgcagguuuggcuuuuagccugaugaaaucccucggcgggggacgaagaggcacaggggcccagggagaaacccuuggcgagaaguggaagaggcagcugaaucaguugaguaaaucugaguucaacauuuacaagcgcagcgguaucauggagguggaccggucagaagcaaaagaggggcugaagagaggagagacuacccgucacgcugucuccaggggcacagccaaacuccggugguucguggaacgcaauuuaguaaagccugaggguaaggugauagaucugggcugugggcgaggaggcuggaguuauuacugcgccgggcuuaaaaagguuacugaagugaaaggauauaccaagggcggucccgggcaugaggaaccgaucccaauggcgacauacggauggaaccuggucaaacuacacagcggcaaggacguguuuuucacgccucccgagagaugugauacccuccugugcgacauuggcgagucuuccccaaaucccacuaucgaagaggggaggacauugcggguccugaaaaugguggaaccuuggcuccgcggaaaccaauuuuguauuaagauccuuaauccguacaugcccucaguuguagagacccuggagcagaugcagagaaagcaugguggcauguuagugaggaacccacugagccgaaauucgacucacgaaauguauugggucucuugcgggacaggaaacauugugagugcuguuaauaugaccucccggauguugcucaaccguuucacgauggcacacagaaaaccuaccuacgagcgcgauguggaccugggcgccgguacaaggcaugucgcuguggaacccgagguagccaaccuagauaucauagggcagcggauugaaaauaucaagcacgagcauaaaagcacuuggcacuaugacgaggauaacccuuacaagaccugggcauaucauggaucauacgaagugaaaccauccggcucugccagcaguaugguuaauggcgucgugaaacuucugacaaagcccugggacgugaucccuauggucacucaaauugcuaugaccgauacaaccccauuugggcagcagagaguuuucaaagagaagguggacacucgcacgcccaaagcgaagaggggaacagcccaaauaauggaaguaaccgcacgauggcucugggguuuucugucccggaacaaaaagccgagaaucuguacuagggaggaguucacccgcaaggugcguagcaaugcugccauuggcgcagucuuuguggacgagaaccaguggaacucugccaaagaggcuguugaagaugagcgguucugggacuuggugcagaaggaaagagagcugcacaaacaggggaagugcgccacaugcgucuauaacaugaugggaaaaagggaaaagaagcucggcgaguuugguaaagcgaaggggucacgcgcaaucugguacauguggcuuggagcccgauuccuggaguuugaggcuuuaggcuucaugaaugaggaucacugguucagucgggaaaacucccugagcggcguggagggggagggauugcauaaacucgguuacauucugagagacaucucuaagauaccuggcgggaauauguaugccgaugacacggcaggaugggauaccaggaucacugaagacgaucuacaaaacgaggcuaaaauuacagacaucauggaaccagagcacgcccuucuggcuaccucgauuuuuaagcucacuuaccagaauaaaguaguucgcgugcagagacccgccaagaacggcacagucauggaugugaucucacggagggaccagcgugguagcgggcaagugggaaccuauggccugaauacauucacuaacauggaagcacaguugauacgacagauggaguccgagggcauauuuuuaccuagugaacuggagaccccaaaccucgcggaacgcguccuugauuggcuggagaagcaugggguugaaagacuaaaacggauggccaucucuggagacgacugugugguaaagcccaucgaugacagguucgcuacggcccugaccgcacucaaugauauggguaaagugcgcaaggacauuccgcagugggagccuagcaaaggcuggaacgauuggcaacagguccccuuuugcucccaccacuuccaucaguugauaaugaaggacgggagagagaucgugguuccaugucggaaucaggaugaacuggugggaagggcucgagucucacaaggcgccgguuggagucuucgugagacagcaugccuggggaagucuuacgcccagauguggcagcucauguauuuucacagacgcgacuuacggcuggcggcuaacgccauuuguagcgcagugccuguagauuggguucccacuuccaggaccacauggucaauccaugcccaccaucaauggaugacuaccgaagacauguugagcguguggaauaaagucuggauugaggaaaacccauggauggaggauaagacgcacgugucuuccuggggagacguucccuaccugggcaaaagagaggaccaguggugcggcagucucaucgggcuuacagcucgcgccaccugggcaagcaauauacagguggcuaucaaccagguccggaggcugauuggaaaugaaaacuaucuagauuacaugacuucgaugaagcgauucaaaaaugagggugacccugaaggcgcccugugguga

SEQ ID NO: 13938 - RNA, 9879 nt, Artificial Sequence
  derived and/or modified CDS sequence (opt3) from DENV-1__GU131766__SS-prME
agcgugaccaugcugcucaugcuuaugcccacagcccuggcuuuccacuugacuacgagaggaggggagccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaauugaacacggcacgacagccaccaucacuccccaggcgccuaccagugagauccagcugacagacuacggggcccucacccuugauuguagcccaaggacuggacuggacuucaacgaaaugguguugcuaacaaugaaggagaaaucuuggcugguccauaagcagugguuucucgaucugccgcuucccuggacguccggcgcaucaaccagccaagagacuuggaaucggcaggaccuguuggugacauucaaaaccgcucacgccaagaagcaggaaguaguugugcucgguagucaagagggggcuaugcacacagcccugacuggcgcaaccgaaauucagacgucuggaaccacaacuauauuugccggccauuuaaaaugccgucugaagauggauaaacuaacccucaaggggauguccuaugucauguguacagguagcuucaaacuggagaaggaaguggcugagacucagcacggaaccguccuugugcagaucaaguacgagggcacggacgcgccuugcaaaauuccauucucgacacaagaugaaaaggggguuacccagaacggacgcuugaucacugcaaaucccauagugauugacaaagagaagccuguaaacaucgaagccgagccacccuuuggcgagucuuauaucgucauuggugcuggggaaaaagcccugaagcucuccugguucaagaaaggcucaaguaucggaaagauguuugaggcaacagccagaggcgcuaggcggauggccauucugggggauaccgcaugggacuucggaagcauagguggcguguuuacuuccaucgggaaacuuguucaucagauuuucggaaccgcguacggcgugcuguuuucuggugucagcuggacaaugaagaucgggaucggcguguugcucacguggcugggauuaaauucacgaaguaccucccugagcaugacuuguauugcuguaggccuagugacacucuaccuggggguuaugguccaggccgauucuggaugcgugauaaacuggaaaggccgcgaacuuaagugugguucagggaucuucgugaccaaugagguccacacauggacugaacaauauaaguuucaggcagacaguccgaaaagauugagcgccgcuauuggaaaggccugggaggagggcguuugcgguaucagguccgcaacccggcuggaaaacauuauguggaaacagaucucuaacgagcucaaucauauacuguuagaaaacgacaugaaguucacgguggugguaggcgaugucguggggauccuggcucagggcaagaagaugauucgcccucaacccauggagcacaaauacucguggaaaagcuggggcaaggccaaaaucauuggggcggacguucagaauacaaccuuuaucauagauggaccaaacacuccugaaugucccgacgaucagagagccuggaauauuugggagguggaggacuauggcuucgguaucuuuaccacaaacauuuggcuuaagaugagggauuccuacacucaggucugcgaccaccguuugaugucagcugcaaucaaagauaguaaggccgugcaugcugacaugggguauuggauagaaucugagaaaaaugaaaccuggaagcucgcccgggcauccuucaucgagguuaagacauguauuuggccaaaaucccacacgcuguggucaaacggagugcuagaaagcgagaugaucauucccaagaucuacggcgguccuauaucucaacauaauuaucgaccaggcuacuucacccagacugcggggccguggcaccugggaaaacucgagcuggauuuugaccuuugcgaaggcacaaccguagucguggaugagcacugcgggaacagaggacccuccuugaggacuacaaccgugacgggcaagauuauccaugaaugguguugccgcaguuguacucugccuccauuacgguucaaaggugaggacgggugcugguacggaauggagaucagacccgucaaggaaaaggaggaaaaucucguuaaaagcauggugucugccggcuccggugagguagacucauuuagucugggccuucuguguauuagcaucaugauugaagaggugaugaggucgcgcuggucccgaaagauguugaugaccgggacacucgcugucuuccugcuacugauaaugggacagcucaccuggaacgaucugauccggcuuugcauuauggugggcgccaaugcaucugaccguauggggaugggaacuacauauuuggcucugauggccaccuuuaaaaugagaccuauguucgcaguuggcuuacucuuuaggcgccugacaagccgggaggugcuucugcuaacuaucggucucucacuggucgccaguguggaauugccaaacucccuggaggaauuaggggauggacucgcuaugggcauuaugauccugaaacuucugaccgacuuccaaucucaccaguugugugcgacgcuccugagccuaacauuuauaaaaaccacucugucccuucauuacgccuggaagaccauggcaaugguucucucaaucgugagccugauucccuugugccugaguacaacuucucagaagaccacgugguuaccgguccuccugggcucccuuggguguaaaccucugacaauguucuugaucgcugagaauaagauuuggggaagaaaaagcuggccacucaacgaagguaucauggccguaggcgugguuucgauacugcuaucaucucugcuuaagaacgaugugccccucgccgggccucugauugcuggaggcauguugaucgcaugcuaugucaucagugguuccagcgccgacuuaucucuggagaaagcggcugaggugagcugggaagaggaagccgagcacuccggggcaucacauaauauucucguagaagugcaggaugacggaaccaugaagauaaaagaugaggagagggacgauacucugacaauccuucugaaggccaccuugcuagcugucaguggcguuuacccccugagcauuccagcaacucucuuugugugguauuucuggcaaaagaaaaagcagcgaucuggcgugcugugggacacaccuucacccccagaagucgagcgcgccgugcuugaugacgggaucuaccggauuaugcagagaggauuacuggguaggagccagguuggcguagggguguuucaagaaaacgucuuccacaccauguggcacgugacgcguggagcgguucucauguaucagggcaaacgcuuggagccgaguugggcuagcgugaagaaagaccugaucuccuacggugggggauggcggcuccagggcucuuggaauacuggcgaggaaguccaggugauagccguagagccugggaagaaccccaagaauguccaaaccgcaccaggaacauucaaaacccccgaaggugaggugggcgccaucgcucuggauuuuaagccugggacaucgggaagcccaauuguuaacagagaaggcaaaaucgugggucuuuacgggaauggagucgugacuaccucaggcacguauguuuccgccauugcacaggcuaaggccagucaggagggcccccugccugagaucgaagacgagguguucaggaaacgaaacuugacaauaauggaucuacauccggggucuggaaagacucggcgcuaccugccagcgauugucagagaagccaucaagaggaaacuccggaccuuaauccuggcacccacacgagugguagcuagcgagauggccgaagcucuuaaggguaugccuauuagauaucaaaccacugcagugaaauccgagcacaccggcaaggagaucguugaccugaugugucaugccacauuuacgaugcgccucuugucaccagucagggugcccaauuacaacaugauaauuauggaugaagcccacuucacugacccuucuagcaucgcugcgcguggguauauuaguacccgggugggaaugggcgaggcagccgcuaucuuuaugacagccaccccgcccgguuccgucgaagcauucccacagagcaaugccguaauacaggaugaggaaagagacauuccugagaggucuuggaacucaggguacgaguggaucacugauuuucccggaaaaacagugugguucguuccauccaucaagaguggcaaugacauugcuaacugccugcgcaagaauggcaaacgagugauccagcucagcagaaagaccuuugauacggaauaucagaagacuaagaacaacgacugggacuacgucgugacaaccgauauuucggagaugggggcgaauuuccgggccgacaggguuauagauccucgccguugccugaaacccgugauccuuaaggacggaccagaaagagucauucuagcagguccgaugccugugaccguagcuucugccgcacagcggaggggccgcaucgggcgaaaccauaauaaggagggagaucaguacaucuauaugggccagccccugaacaaugacgaggaucacgcccacuggacugaagcuaaaauguuguuagacaacauuaauacaccagaggguauaauccccgcccuguuugaaccugagagagaaaaguccgcggcaauugauggggaguaccggcucaggggcgaggcccgcaaaaccuucguggaacugaugagaaggggagaccuuccaguuuggcugagcuauaaggucgcuucagagggcuuccaauacagugaucggcguugguguuuugacggggaacgcaacaaucaggugcucgaggaaaacauggauguggagaucuggacaaaagagggagaacgaaagaaauugagacccagguggcuggacgcccggacuuauucugacccucuagcucugcgcgaguucaaggaauuugcagccgguagaagguccgucagcggcgaucucauucuugagaucgggaagcugccgcagcauuuaacgcagcgggcucaaaaugccuuggacaaccugguuaugcuccacaauucagaacagggaggccgagcauacagacaugcgauggaggagcugccagauaccauagaaacacuuaugcugcucgccuugaucgcugugcugacuggugggguaaccuuauucuuucuaaguggccgcggacugggcaaaacaagcauugggcuccuuugcgugauggccuccucuguccuguuguggauggcaagcguggagccccacuggaucgcugccuccauuauccuggaguucuuucucaugguucugcuuauaccugagcccgacaggcagcggaccccacaggauaaccaacucgcauauguggucauuggacuguuguucaugauccugacuguagccgcuaaugagauggguuuacuagaaacgaccaagaaagaccugggcauugggcacguggcgguugagaaccaucaccaugccacaaugcucgauguggaccuucacccugcaucagcuuggacucuguacgccgucgccaccacaaucauaacccccaugaugcgucauacuaucgaaaacacaacggcaaauauuucuuugaccgcuaucgccaaccaggcggcuauucugaugggacucgauaagggcuggccaaucaguaaaauggacauaggugugccucugcuugccuuaggguguuacucgcaggucaauccgcugacucucacagcagccguguugaugcugguugcucacuaugcaauuaucggccccggacuacaagccaaggcgaccagagaggcucagaagaggaccgccgcaggcaucaugaaaaacccaacaguggaugggauuguagccaucgaccuggauccuguggucuacgacgcuaaguuugaaaaacagcucggacagauaaugcuucugauuuugugcacuagccaaauccugcucaugcgcacgaccugggcccugugugaguccauuacauuagcaacuggcccccuuaccacacugugggaggguucuccagggaaguucuggaauaccacuaucgcuguuucaauggccaacauauuucggggaagcuaucucgcgggcgccggucuagcauucucccugaugaaaaguuugggcgggggacgaagaggcacgggggcucagggagaaacacugggcgagaaguggaagaggcagcucaaucagcuuucuaaaagcgaauuuaacaucuacaagcgcucagguauuauggagguggaccgguccgaagccaaagaggggcugaagagaggagagaccacucgucacgcagucaguaggggcaccgcuaaauugcggugguucguggaacgcaaucugguaaagccugaggguaaggugaucgaucucggcugcgggcgaggaggcuggagcuauuacugugccgggcuaaagaagguuacagaagugaaaggauauacuaagggcggucccgggcaugaggaaccgauuccaauggccaccuacggauggaaccuggucaaacuucacucuggcaaggacguguucuuuacaccucccgagaaaugcgauacgcugcuaugugacaucggcgaguccucaccaaaucccaccauugaagaggggagaacucucaggguccugaagaugguggaaccuugguugcggggaaaccaauucugcaucaagauacugaauccguacaugcccagcguuguagagacacucgagcagaugcagcgcaaacaugguggcaugcuugugagaaacccacugucgagaaauucuacccacgaaauguauugggucaguugugggacuggaaacauuguguccgcgguuaauaugacaagccgaauguuacugaaccgguuuaccauggcucaccguaagccuacguacgagaaagauguggacuugggcgcagguaccagacaugucgccguggaacccgagguagcuaaccucgauaucaucgggcagcgcauugaaaauauaaagcacgagcauaaaucaacauggcacuaugacgaggauaacccuuacaagacuugggccuaucauggauccuacgaagugaagccaucuggcagcgcaaguuccaugguuaauggcgucgugaaacugcuaaccaagcccugggacgugaucccuauggucacacaaauugccaugacugauaccacaccauucgggcagcagaggguuuuuaaagagaagguggacacccggacucccaaagcuaagagaggaacgguacaaaucauggaagugacagcgcgcuggcuuugggguuuccugagcaggaacaagaaaccgcgaauuugcacccgggaggaauuuacuagaaaggucaggucuaaugccgcaaucggcgcuguguucguugacgagaaccaguggaacucagccaaagaggcaguggaagaugagcgcuuuugggaccucgucaagaaagaacgugagcugcacaagcaggggaagugcgccaccuguguguauaacaugaugggaaaacgggaaaagaaauugggcgaguucgguaaggcuaaagggaguagagccauaugguacauguggcugggagcgagguuucucgaguucgaagcacuuggcuuuaugaaugaggaucacugguucucccgcgaaaacagccugucuggcguagagggggagggauuacauaagcuggguuacaucuugcgagacauuucgaaaaucccuggcgggaauauguaugccgaugacacagcuggaugggauacgcggauuaccgaagacgaucuccagaacgaggccaagaucacugacauaauggaaccagagcacgcacugcuagcuacaucaauuuucaaacuuaccuaccaaaauaaaguugugagaguccagaggcccgccaagaacggcacugugauggaugugaucagccgcagagaccagcgggguuccgggcaggucggaacauauggccugaauaccuuuacaaacauggaagcucaacucaucaggcagauggagagugagggcauuuuccugccuucugaauuggagacuccaaacuuagccgaacguguucuggauuggcucgagaaauacgggguggaacgacuuaagcgcauggcaauaagcggagacgacugcguagugaaacccaucgaugacagauuugcgaccgcccugacggcucuaaaugauauggguaagguccggaaggacauuccgcagugggagccuuccaaaggcuggaacgauuggcagcaagugcccuucuguucacaucacuuucaccagcugaucaugaaggacgggagggagauuguugugccaugccgcaaucaggaugaacucgucggaagggcacgggugagucagggcgcagguuggucuuugagggagaccgcuugucuggggaaaagcuaugcccaaauguggcagcuuauguacuuccaucgacgugaccugagacucgcagccaacgcgaucugcuccgcuguaccuguugauugggugcccacaucacgcacuaccuggagcauacacgcccaucaccaguggaugacaacugaagacauguuaucugucuggaaucggguguggaucgaggaaaacccauggauggaggauaagacccauguuuccaguuggggagacgugcccuaucugggcaaaagggaggaccaaugguguggcagcuugauugggcugacggcaagagccacaugggcuucgaauauccaggucgccauuaaccaggugcgccggcucaucggaaaugaaaacuaccuugauuacaugaccuccaugaagagguuuaagaaugagggugacccugaaggcgcacugugguga

SEQ ID NO: 13939 - RNA, 9879 nt, Artificial Sequence
  derived and/or modified CDS sequence (opt3) from DENV-1__GU131767__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucaguuggugugaacaugugcacacuaauugcaauggaccucggcgaguucugugaagauacuaugaccuacaaaugcccacggauaacagaggccgaaccggacgauguagacuguuggugcaaugcgaccgauacuugggugacauaugggaccuguagucaaacgggagagcaccgccgagacaagcguagcgucgcucuggccccccaugugggccuuggucuggagacuagaaccgaaacauggauguccucugagggggcauggaaacagauccagaggguugaaacuugggccuugcggcacccuggauuuaccgugauugcucucuuccuggcacaugccaucggcacaucgauuacccagaagggcaucauauuuauccugcucauguuagucacgccaucaauggcuaugcgcugcguggggauuggaagcagagauuucguagagggucugaguggcgccacuuggguugacgugguccuugagcacggguccugugugacaaccauggcgaaggauaaacccacuuuggacaucgaacugcuaaagacagaggugaccaacccugcaguccucaggaaacugugcauugaagccaagaucucuaauacgaccacagauagccgguguccaacucaaggagaggcuacccuuguugaagagcaggacgccaacuuugugugccgccgaacauucguagauagaggcugggguaauggguguggacuguuuggcaaaggcuccuugauaacuugcgcaaaguucaagugcgugaccaaacucgaggggaagauuguccaguacgaaaaccugaaauauucagugaucguuacagugcacaccggagaccagcaucaagucgguaaugagaguacugaacacggcacgacagcuaccauuacuccccaggccccuagcaccgagauccaguuaacagacuacggggcgcugacccucgauuguucuccaaggacuggacuugacuuuaacgaaauggugcuguugacaaugaaggagaaauccuggcuaguacauaagcagugguuccuggaucucccgcugcccuggacgucaggcgccagcaccagucaagagacuuggaaucggcaggaccuucugguuacauuuaaaaccgcacacgcuaagaagcaggaaguggucguguuggguucucaagagggggccaugcacacagcucucacuggcgccaccgaaauccagacguccggaaccacaacuauuuucgcaggccaucugaaaugccguuuaaagauggauaaacugacccuaaaggggaugagcuaugucauguguacaggaucguucaaacucgagaaggaaguggccgagacucagcacgguaccguucuggugcagauaaaguacgagggcacggacgcuccuugcaaaaucccauuuucuacacaagaugaaaaggggguaacccagaacggacgccuuauuacugcgaaucccaucgucacagacaaagagaagccugugaacauagaagcagagccacccuucggcgaguccuauauuguuaucggugccggggaaaaagcuuugaagcugucaugguuuaagaaaggcaguagcaucggaaagauguucgaggccaccgcaagaggcgccaggcggauggcuauucucggggauacugccugggacuuuggauccaucgguggcguguucaccucugucgggaaacuggugcaucagauuuuuggaacagcauacggcguacuuuucagcggugugucauggacgaugaagauagggaucggcguucuguugaccuggcucggacugaauagucgauccacuagcuuaucuaugacauguauugcggucggccuggugacccuauaccucggggugaugguccgcgcugauucaggaugcguuaucaacuggaaaggcagagaacugaagugugguagugggaucuuugugacaaaugaggugcacacuuggaccgaacaguauaaguuccaagccgacagcccgaaaaggcuuuccgcagccauuggaaaggcuugggaggagggcguaugcgguauacggucugccacgcgcuuggaaaacaucauguggaaacagauuucgaacgagcugaaucauauccuccuggaaaacgacaugaaguuaacagucgugguuggcgauguggcagggauucuggcucagggaaaaaagaugaucagaccucagcccauggaguacaaauauagcuggaaguccuggggcaaggccaaaauaaucggggcggacguccaaaauaccacuuuuauuaucgauggaccaaacaccccugaaugucccgacgaucagagggccuggaauauuugggagguggaggacuacggcuucgguaucuuuacaacuaacauauggcuuaaguugcgugauucauauacccagguuugcgaccaccggcucaugagugcugcaauuaaagauucuaaggccgugcacgcugacaugggguacuggaucgaaagcgagaaaaaugaaacauggaagcuggcccgagcauccuucauugagguaaagacguguaucuggccaaaaucacauacccuauggagcaacggaguccuggaaucugagaugauaauccccaagauuuauggcgguccuaucucccagcacaauuacagaccaggcuacuucacucaaacagcggggccguggcaucucggaaaacuggagcuugauuuugacuugugcgaaggcaccacugugguggucgaugagcacugcgggaacaggggacccagucugcgcacaaccacgguuacuggcaagauuauccacgaaugguguugccggagcuguaccuuaccuccacucagauucaaaggugaggacgggugcugguauggaauggagauaaggcccgugaaggaaaaggaggaaaaucugguaaaaucuaugguguccgccggcucaggugaggucgacaguuuuagccuuggccuguuguguauuucgaucaugaucgaagaggugaugcgcucccgauggucucggaagaugcucaugacagggacccuggcuguuuucuuucuacugauuaugggacagcucacuuggaacgaucugauccgucuuugcauuauggugggcgccaaugcaagcgacagaauggggaugggaacaaccuacuuggcucugauggccacauucaaaaugaggccuauguuugcagucggcuuacucuuccgccggcugacuucaagagaggugcuucugcuaaccauaggucucagucugguugccuccguggaauugccaaacucucuggaggaauuaggggauggacucgcuaugggcaucaugauucugaagcuucugacggacuuucagagccaucaauugugggcgacacuccugucccuaaccuucaucaggacuaccuuuucacugcacuaugccuggaaaacaauggcaaugguccuuagcauuguaagucucuucccccuguguuugucuacuaccucccagaagacgacauggcugccgguguuacucggcagccuggggugcaagccucuuaccauguuucugaucgcugagaauaaaauauggggacgaaagucguggccauugaacgaagguaucauggccguuggcauugugucaauccuccugucuagucuacugaaaaacgaugucccccuugccgggccucucauugcuggaggcaugcugaucgcauguuacgugauauccgguagcucugccgacuugagcuuagagaaggcggcuguaguguccugggaggaagaggccgaacauucaggggcaagucacaauauucuggucgagguucaggaugacggaacuaugaaaaucaaggaugaagagcgcgacgauacacucaccauccugcuuaaagccacucuguuggcugugagcggcguguauccccuaucuauuccagcaacacuguucgucugguacuucuggcagaagaagaaacaacgguccggcgugcucugggacaccccuucacccccagagguugaaagagccguacuggaugacgggauauauaggaucaugcagcguggacuuuuaggucgcagucaggugggcgucgggguguuucaggagaacguuuuccauacgauguggcacgugacucggggagcgguccugauguaccaaggcaagagacucgaaccgagcugggcuuccgugaaaaaggacuugauuucuuacggugggggauggaggcugcagggcucguggaauaccggcgaggagguacaggucaucgccguggaaccugggaaaaaccccaagaauguucagacagcaccaggaaccuuuaagacaagcgagggugaagugggcgccauugcucucgauuucaaacccgggacuucaggauccccuaucgucaaccgagagggcaagauagugggucuguaugggaauggaguugugaccacgaguggcacauacgucucugccaucgcacaagcuaaagccagccaggaaggcccacuucccgagauugaggacgaaguguuucggaagcgcaaccugacuaucauggauuugcacccuggguccggaaaaaccagaagguaucuaccggcgauuguacgggaggccaucaagcgaaagcugagaacacucauauuagcaccaacccgcgugguugcuucagaaauggccgaggcucugaaagguaugcccauuagguaccagacuaccgcagucaagucugaacauacaggcaaagagaucguggaccuuaugugccacgccacguucacuaugcgucugcucagcccugugcgggucccaaauuauaacaugaucauuauggaugaggcccauuuuaccgaccccaguuccaucgcugcgagaggguacauaagcacaaggguaggaaugggcgaagcagccgcuauuuucaugaccgccacuccuccggguucuguggaggcauuuccccaaucaaaugccguuauccaggaugaagagcgcgacauuccagaacgauccuggaacaguggguaugaguggaucacagauuucccuggaaagaccgugugguuuguccccagcauaaaaucgggcaaugacauugcuaacuguuugagaaagaauggcaagcgggugauccagcugucuaggaaaacguucgauacugaguaccagaagacaaaaaacaacgacugggacuacguugugaccaccgauaucuccgaaaugggggcgaauuuccgcgccgaccgugucauugauccaagacggugccucaagccugugauccugaaagacggacccgagaggguaauucuugcagguccaaugccggugacuguugcuagcgccgcacaacgccgaggcagaauagggcggaaccacaauaaggaaggagaucaguauaucuacaugggccagccucuaaacaaugacgaggaucaugcccacuggacagaggcuaagaugcuguuggacaacauuaauacccccgaagguaucaucccagccuuauuugagcccgaaagggagaaaucagcggcaauugauggggaauaucgccugagaggcgaggccaggaagacauucgucgagcucaugcggcguggagaccugccuguguggcuuaguuacaaaguggcuucugaaggcuuucaguauuccgaucgccgauggugcuucgacggggagagaaacaaucaaguccuggaagagaacauggauguugaaauauggacuaaggagggagagaggaaaaagcuccggccacgcugguuggacgccagaacguacagcgacccccuggcucuaagggaauuuaaagaguucgcagccggucggcgaucagugaguggcgaucugauccucgaaauugggaagcuuccucagcaccugacccagagagcucagaaugccuuagacaacuugguaaugcugcauaauagcgagcaaggaggccgcgcauauaggcacgcgauggaagagcucccggauacaaucgagacucugaugcuucuggcccucauugcuguguugaccgguggggucacacuguuuuucuuauccggccggggacuaggcaagaccucuaucgggcugcucugugugauggccagcuccguucuucuguggauggcaucaguggaaccacauuggauagcugccucuaucauuuuggaguuuuuccugaugguccuccugauccccgaaccugaccgucagagaacuccccaggauaaccagcuugcauacguagugauuggacuccuguuuaugaucuugacgguugccgcuaaugagaugggucuguuagagaccacaaaaaaggaccuaggcauagggcacguggcggucgaaaaccaccaucacgccgcaaugcuggauguggaccuccauccagcuagugccuggacucuuuacgccgucgcaaccacaauuaucaccccuaugaugaggcacacuauugagaacacaacggcuaauaucucgcugaccgccauagcgaaccaagcugccaucuugaugggacuggauaaaggcuggcccauuagcaagauggacaucggugugccacuccuggcacuugggugcuauucccagguuaauccuuuaacucugacagccgcugugcucauguugguagcacauuacgccauuaucggcccgggacugcaggcgaaagcuacccgcgaagcccaaaagcggaccgcagccggcauaaugaagaaccccacaguggaugggauugucgcuaucgaccuagauccaguuguguaugacgccaaauucgagaagcagcugggacagaucaugcuccuuauucuguguacuucucagaucuugcugaugcgaacgaccugggcacucugcgaaucaauaacacuggcuacuggcccuuuaaccacacuuugggaggguagccccgggaaauuuuggaauaccacuauugccgucuccauggcgaacaucuucagaggaaguuaccuggccggcgcaggucucgcuuucucucuaaugaagagccugggcgggggaaggcgcggcacgggggcccaaggagagacauugggcgaaaaauggaagcggcagcugaaucagcucucaaaguccgaguuuaacaccuauaaaagaagugguauuauggaaguggaccguagcgaggcaaaggaagggcuuaaaaggggagagacuaccaagcacgcuguaucucggggcacagccaaacugcgcugguucguggagcgaaauuugguuaagccagaagguaaggugaucgaucugggcugugggagaggaggcugguccuacuauugcgccgggcucaaaaaggucacugaggugaaaggauacaccaagggcgguccugggcacgaagagcccauaccgauggcgacauacggauggaacuuagucaaacugcauucaggcaaggacguguuuuucaucccaccugaaaaaugugauacgcuucugugcgacauuggcgagagcucgcccaauccaaccaucgaggaagggaggacucuacggguucucaagaugguagagcccuggcugcgcggaaaccaguuuuguauuaagaucuugaauccuuauaugccgucuguggucgaaacacuggagcaaaugcagagaaaacacgguggcaugcucgugaggaacccccuuagucgaaauuccacccaugagauguacuggguuagcugcgggacuggaaacauugugucagcugucaauaugacaucccggaugcuguuaaaccguuucaccauggcacacagaaagccaacguaugaacgcgauguggaccugggcgccgguaccaggcacguagcuguggagccugaaguugccaacuuggauaucauagggcagcggauugagaauaucaaacaugaacacaagucuacauggcauuacgacgaggauaaccccuauaaaacuugggcauaccacggaagcuaugaggucaagccuaguggcuccgccagcucuauggugaauggcguggucaagcuccugaccaaaccaugggacguuauccccauggugacacagauugcuaugacugauaccacaccuuuugggcaacagagaguauucaaggaaaaaguggacacccgcacuccaaaggcgaaaaggggaacggcccagauaauggaggucacagcaaaguggcuaugggguuuucuuucacgaaacaagaaaccccggaucuguaccagagaagaguucacuaggaaggugcgcaguaaugcugccauuggcgcaguuuuuguggacgaaaaccaauggaauuccgccaaagaggcugucgaggaugaacguuucugggaccuggugcaucgggagagagaacuccacaagcaggggaaaugcgccaccugcguauacaacaugaugggaaagagggagaagaaacugggcgaauuugguaaggcgaaagggagccgcgcaaucugguacaugugguugggagcccgauuccuggaguucgaggcucucggcuuuaugaaugaagaucacugguucucucgggagaacucgcuuucaggcguugaaggggagggacugcauaaguuagguuauauucugagagacaucagcaaaauaccgggcgggaauauguacgccgaugacacagcaggaugggauacgaggaucaccgaggacgauuugcagaacgaagcuaagauuacugacaucauggagccugaacacgcccuccuggcuaaauccauuuuuaagcuaacauaucagaauaaggugguccgcgugcaaagaccagccaaaaacggcaccgugauggaugucaucagucggagggaccagcgugguucugggcagguuggaacuuacggccuuaauacauucaccaacauggaggcacagcugauacgacaaauggaaagcgagggcauuuuuucccccucagagcucgaaacaccuaaccuggcggggcgcguguuggauugguuagagaagcauggaguagaaagacugaaacggauggccaucaguggugacgacuguguggucaagccaaucgaugacagguucgcuacugcccucaccgcacuuaaugauaugggcaaagugcgcaaggacauuccccagugggagccgucuaagggguggaacgauuggcagcagguuccuuuuugcagccaccacuuccaucaacugauaaugaaagacggaagagaaaucgugguccccugucggaaucaggaugagcuagugggcagggcucgaguaucccagggugccggguggucacugcgugagacggcaugccucggaaagagcuaugcccagauguggcaauugauguacuuucacagacgcgaccugcggcuugcggcuaacgccauuuguucugcaguuccaguggauugggucccuaccuccaggacaacuuggaguauccaugcccaccaucaguggaugaccacagaagacaugcugagcguguggaauagaguuuggauugaggaaaaccccuggauggaggauaaaacucacaucucguccuggggcgacgugccauaucucggcaagcgcgaagaccaguggugcgggucuuuaauaggacugaccgcucgggccacgugggcaacaaauauccaagucgcuauuaaccaggugaggcgauugcuggguaaugagaacuaccucgauuacaugaccucaaugaaaagauucaagaaugagagcgaccccgaaggcgcccuuugguga

SEQ ID NO: 13940 - RNA, 9879 nt, Artificial Sequence
  derived and/or modified CDS sequence (opt3) from DENV-1__HM181967__SS-prME
agcgugaccaugcugcucaugcuuaugcccaccgcacuggcuuuccacuugacuacgcggggaggggaaccucauaugaucgucuccaagcaggaaaggggaaaaucuuuacuguuuaagaccucagccgguguuaacaugugcacgcuaauugccauggaccucggcgaacugugugaagauacuaugaccuacaaaugcccacggauuacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggaacaaugaaaaucaaggaugaggagcgggacgauacccucacuauccugcuuaaagcuacacuguuggcagucaguggcguuuauccccuaagcauuccagccacccuguucgugugguacuucuggcaaaagaaaaagcagagaucuggcgugcucugggacacgccuucacccccagaagucgagagggcggugcuggaugacgggauauaucguaucaugcagcgcggacuuuuaggucggagccagguuggcguagggguguuucaagaaaacgucuuccauacuauguggcacgugaccagaggagcuguucugauguaccagggcaagaggcucgagccgaguugggccagcgugaaaaaggacuugauuuccuacggugggggauggcgacugcagggcucuuggaauacaggcgaggaaguccaggugaucgcaguagagccugggaaaaaccccaagaauguccaaaccgccccaggaacauuuaaaacucccgaaggugaggugggcgcuauugcccucgauuucaagccugggaccucgggaagcccaaucguuaaccgggaaggcaagauagugggucuguaugggaauggagucgugacgacaucaggcacuuacguuuccgcaaucgcucaggccaaagcgagucaggagggcccccuuccugagauugaagacgagguguuucgcaagagaaaccugaccaucauggauuugcacccggggucuggaaaaacaaggcgguaucuaccagccauuguccgagaagcaaucaagagaaaacugcgcacccucauauuagcucccacuagggugguagccagcgagauggcugaagcacugaaggguaugccuauucguuaccaaaccacagccgugaaguccgagcauacgggcaaagagaucguugaccuuaugugccacgccacuuucaccaugcggcugcucucaccagucagagugcccaauuauaacaugaucauuauggaugaagcucauuuuacagacccuucuagcaucgcggcaaggggguacauaaguacccgcgugggaaugggcgaggccgcugccauuuucaugacugcaacaccgcccgguuccgucgaagccuuuccacagagcaaugcuguaauccaggaugaggaacgagacauuccugagagaucuuggaacucaggguaugaguggaucaccgauuuccccggaaagacggugugguuuguuccauccauaaaaaguggcaaugacauugcgaacuguuugcggaagaauggcaaaagggugauccagcugagccgcaagacuuucgauacagaauaccaaaagaccaaaaacaacgacugggacuacgucgugaccacugauaucucggagaugggggccaauuuccgugcagacagaguuauugauccucggaggugccucaagcccgugauccugaaagacggaccagaacgcgucauucuugcugguccgaugccugugacaguagccucugcagcccagcgaagaggccggauagggaggaaccacaauaaggagggagaucaguauaucuacaugggccagccccuaaacaaugacgaggaucaugcucacuggaccgaagccaaaaugcuguuggacaacauuaauacaccagaggguaucauccccgcguuauuugaaccugagcgcgaaaaguccgcagccauugauggggaguauagacugaggggcgaggcucggaagacuuucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauauggacgaaggagggagaacggaaaaagcuccgccccagaugguuggacgcuaggaccuacucugacccucuggcacuacgggaguuuaaagaguucgccgcuggucgaagauccgucagcggcgaucugauccucgagauugggaaacuuccgcagcaccugacacagcgcgcccaaaaugcauuagacaacuugguuaugcugcauaauucagaacagggaggcagggcguaucggcacgccauggaggagcucccagauacuaucgaaacccugaugcuucuggcucucauugccguguugacaggugggguaacccuguuuuucuuaaguggccguggacuaggcaaaacuagcaucgggcugcucugugugauggcauccucuguccuucuguggauggcuagcguggagccccauuggauagccgcauccaucauuuuggaauuuuuccugaugguucuccugaucccugagcccgacagacagaggacgccacaggauaaccaacuugccuacguggucauuggacuccuguuuaugaucuugaccguagcugcgaaugagaugggucuguuagaaacaacuaagaaggaccuaggcauagggcacauggccguggagaaccaccaucacgcagcuaugcuggauguugaccuccauccugccucagccuggacccuuuacgcaguggcuacaaccauuaucacucccaugaugcgccacacaauugaaaacacgaccgccaauaucucucugacugcgauagcuaaccaggccgcaaucuugaugggacuggauaaaggcuggccaauuaguaagauggacaucggugucccucuccuggcccuugggugcuauagccaggugaauccguuaacacugaccgcugcaguccucauguugguggcccauuacgcgauuaucggccccggacugcaagcuaaagccacccgggaggcacagaagcgaacagccgcuggcauaaugaaaaacccaacuguugaugggauuguggccaucgaccuagauccuguaguguaugacgcaaaguucgaaaagcagcugggacagaucaugcuccuuauucuguguacgagccaaaucuugcugaugagaaccacaugggcucucugcgaguccauaacucuggccaccggccccuuaacaacccuuugggaggguucuccagggaaauuuuggaauacuacgauugcggucucaauggccaacaucuucaggggaagcuaccuggcaggcgcuggucucgccuucucccuaaugaagagucugggcgggggacgccggggcacaggggcacagggagaaaccuugggcgagaaauggaagagacagcugaaucagcucucuaaaagcgaauuuaacacuuauaagcguucagguauuauggagguugacagguccgaagcuaaggaggggcuuaaacggggagagaccacaaagcacgccgugagucgcggcacugccaaacugcgaugguucgucgaaagaaauuuggugaagccugaggguaaaguaaucgaucugggcugugggaggggaggcuggagcuacuauugcgcggggcucaagaaggugaccgaaguuaaaggauacacaaagggcggucccgggcacgaggaaccgauaccaauggcuacguacggauggaacuuagugaaacugcauucuggcaaggacgucuuuuucaucccucccgagaaaugugauacccuucugugcgacauuggcgaguccucaccaaaucccacuaucgaagaggggcggacacuacgcgugcucaagauggucgaaccuuggcugagaggaaaccaauuuuguauuaaaaucuugaauccguauaugcccagcgugguugagacccuggagcagaugcagaggaagcacgguggcaugcucguacgaaacccacuuucgagaaauucuacucaugaaauguacugggugaguugcgggacaggaaacauugucuccgcagugaauaugaccagccguaugcuguuaaacagauucacgauggcccaccgcaagccuaccuaugagagggauguugaccugggcgcugguacacggcacguggccgucgaacccgagguggcaaacuuggauaucauagggcagagaauugaaaauaucaaacaugagcacaagucaacuuggcauuacgacgaggauaacccuuauaaaaccugggccuaccacggauccuaugaaguaaagccaucuggcagcgcuaguuccauggugaauggcguugucaaacuccugacaaagcccugggacgugaucccuauggugacucaaauugcgaugaccgauacaaccccauuugggcagcagcgcgucuucaaggagaaaguugacacuaggacgcccaaggccaaacgaggaacagcacaaauaauggaagugaccgcuaaguggcuaugggguuuucuuagccggaacaaaaagccgagaaucuguacuagggaggaguucacccgcaagguacguucuaaugccgcaauuggcgccguguuugucgacgagaaccaguggaacucagcuaaagaggccguggaagaugagcgguucugggaccugguucauagagaaagggagcuccacaagcaggggaaaugcgcgacaugcguguacaacaugaugggaaagcgcgagaagaagcugggcgaguuugguaaggcaaaagggagucgagccaucugguacaugugguugggagcucgguuccuggaguucgaagcccucggcuuuaugaaugaggaucacugguucuccagagaaaacagccuuucuggcgucgagggggagggacugcauaaguuagguuauauucugagggacaucucgaaaauaccuggcgggaauauguacgcagaugacacggcuggaugggauacccgcaucacugaagacgauuugcagaacgaggccagaauuacagacaucauggaaccagagcacgcucuccuggccaagucaauuuuuaaacuaaccuaucaaaauaaggugguacggguucagaggcccgccaaaaauggcacugugauggaugucaucagccgucgagaccagcgcgguuccggacaggugggaacauacggccuuaauaccuucacaaacauggaagcgcaacugauaagacagauggagagugagggcauauuuucuccuagcgaacucgagacuccaaaccuggccgaacggguguuggauugguuagagaaguauggggucgaaaggcugaagcgcauggcuaucuccggagacgacuguguugugaaacccaucgaugacagauucgccaccgcacucacggcucuuaaugauauggguaagguacggaaagacauuccgcagugggagccuucaaagggcuggaacgauuggcagcaagugcccuuuugcagucaucacuuccaccagcugauaaugaaagacgggagggagaucgucgugccaugucgaaaucaggaugagcuaguuggacgugccagagugucucagggcgcagguuggagccugcgcgagaccgccugccucgggaaguccuacgcgcaaauguggcaguugauguauuuucaucggagggaccugagacuugcugccaacgcaauuuguucagccgucccuguggauuggauccccacaagccgcacuaccuggucuauucacgcucaucaccaguggaugacaacugaagacaugcuguccguauggaaucggguuuggaucgaggaaaacccauggauggaggauaagacccauauaaguagcuggggagacgugcccuaccucggcaaaagggaggaccaauggugcggcucguuaaucgggcugacggcccgagcaacaugggcuaccaauauucaggucgccaucaaccaggugagacgguugauuggaaaugaaaacuaccuggauuauaugacuuccaugaagagguucaaaaaugagucugacccugaaggugcgcucugguga

SEQ ID NO: 13941 - RNA, 9879 nt, Artificial Sequence
  derived and/or modified CDS sequence (opt3) from DENV-1__GU131768__SS-prME
agcgugaccaugcugcucaugcuuaugcccaccgcccuggcuuuccacuugacuacgagaggaggggaaccucauaugaucguaaccaagcaggaaaggggaaaauccuuacuguuuaagacaucugccgguguuaauaugugcacucuaauugccauggaccucggcgaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugggagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguaacuggccaaaaucccacacucuauggucaaauggaguccuggaaagcgagaugauuauccccaagauauacggcgguccuaucucucaacauaacuaucgaccaggcuacuucacacagaccgcggggccguggcaccucggaaaacuggagcuugauuuugacuugugcgaaggcacuacagugguggucgaugagcacugcgggaauagaggacccucccugaggaccacgacuguuaccggcaagauuauccaugaaugguguugccgcaguuguacauuaccuccacuccgguucaaaggugaggacgggugcugguacggaauggagauuagacccgugaaggaaaaggaggaaaaccugguaaaaagcauggugucugccggcuccggugaggucgacucauuuagucuuggccuguuguguaucagcauaaugauugaagaggugaugaggucgcgcuggucccgaaagaugcucaugaccgggacucuggcuguuuuccuacugcucaucaugggacagcugacauggaaugaucuuauccgguugugcauuauggugggcgccaacgcaucugaccguauggggaugggaaccacauaucuggcuuuaauggccacuuuuaaaaugagaccuauguucgcagucggccuccuguuuaggcgccuuaccagccgggaggugcugcuacucacgaucggucugucauugguugccaguguggaacugccaaauuccuuagaggaacucggggauggacuggcuaugggcauuaugauacuuaagcuguugacagacuuccaaucucaccagcucugggcgacccugcuaagccugacuuuuaucaaaaccacacuuucccuccauuacgccuggaagacuauggcaaugguccugucaauugucagcuuguucccccuguguuuaaguaccacgucucagaagacaaccuggcucccggugcugcuuggcucccuggggugcaaaccuuugacuauguuucucaucacagagaacaagauuuggggaagaaaaagcuggccacugaacgaagguaucauggcuguuggcguggucucgauacuacugucaucucuucucaagaaugaugugccccuggccgggccuuugaucgccggaggcauguuaauugcuuguuauguaaucagugguuccagcgcagaccugucucucgagaaagccgcggaggugagcugggaagaggaagcugagcacuccggggccucacauaacauucuggucgaaguucaggaugacggaaccaugaagaucaaagaugaggagagggacgauacucuuacaauacuguugaaggcaacccuacuggccgugaguggcguguacccccucagcauuccagcuacgcuguucgucugguauuuuuggcaaaagaaaaagcagcgaucuggcgugcuuugggacacuccuucacccccagaaguugagcgcgcaguauuagaugacgggaucuaccggaucaugcagagaggacugcucgguaggagccaggugggcgucgggguguuccaagaaaauguuuuccacaccauguggcacgugacacguggagccgucuugauguaucagggcaaacgccuggagccgaguugggcgagcgugaagaaagaccucauuuccuacggugggggauggcggcugcagggcucuuggaacaccggcgaggaaguacaggucauagcuguggagccugggaagaaucccaagaacguucaaacagccccaggaacuuuuaaaacccccgaaggugaggugggcgcaaucgcccuugauuucaagccugggacgucgggaagcccaauugucaauagagaaggcaaaaucgugggucuguacgggaacggaguugugacaacuucaggcaccuaugucuccgcuauugcccaggcaaaggcuagucaggagggccccuugccugagaucgaagacgagguguuuaggaaacgaaaucuaacaauaauggaucugcauccggggucuggaaagacccggcgcuaccucccagccaucguaagagaagcgauuaagaggaaauuacggacucugauccuugcccccacccgagugguugcaagcgagauggcugaagcccugaaggguaugccuauuagauaucaaacaacggcugucaaauccgagcacacuggcaaggagaucguggaccucaugugccaugcaaccuucacaaugcgcuugcugucaccagugaggguccccaacuacaauaugauaauuauggaugaagcccacuuuaccgacccuucuagcaucgccgcucguggguauaucaguacucggguaggaaugggcgaggcggcagccauuuucaugacagcuaccccgcccgguuccguggaagccuuuccacagagcaacgcaguuauccaggaugaggaaagagacauaccugagaggucuuggaacucaggguacgaguggauuacggauuuccccggaaaaacugugugguuugucccauccaucaagaguggcaacgacauugccaauugucuccgcaagaacggcaaacgagugauccagcugagcagaaagacauucgauaccgaauaucagaaaaccaagaacaaugacugggacuacguugugacuacagauauaucggagaugggggcuaacuuucgggcggacagggucauugauccucgccguugccuuaaacccgugauccuaaaggacggaccagaaagaguaauccuggccgguccgaugccugugaccguugcaucugcugcccagcggaggggccgcauugggcgaaaucauaacaaggagggagaucaguacaucuauaugggccagcccuugaauaacgacgaggaucacgcacacuggacagaagccaaaauguuacuggacaauauuaacacuccagaggguauaauccccgcucucuucgaaccugagagagaaaaguccgccgcgauugauggggaguaccggcugaggggcgaggcacgcaaaacguucgucgaacuuaugagaaggggagaccugccaguguggcucagcuauaagguggccucagagggcuuucaauacagugaucggcguuggugcuucgacggggaacgcaauaaccaggucuuggaggaaaauauggauguugagaucuggaccaaagagggagaacgaaagaaacugagacccagguggcuagacgcucggacauauucugacccucuggcccuccgcgaguuuaaggaguucgcugcagguagaagguccgugagcggcgaucuuauccuggagauugggaaguuaccgcagcauuugacucagcgggcccaaaacgcucuggacaaucucguaaugcugcacaacucagaacagggaggccgagccuacagacaugcaauggaggagcuuccagauaccauagaaacacugaugcucuuggcgcugaucgccguguuaaccgguggggucacucuauuuuuccugaguggccgcggacucggcaaaacgagcauugggcuucugugugugauggcuuccucuguuuugcuguggauggccagcguggagccccacuggaucgcagcuuccauuauccucgaauuuuuccugaugguccuucucauaccugagcccgacaggcagcggaccccacaggauaaucaacuggccuauguagugaucggauugcuguuuaugauuuuaacaguugcagccaacgagaugggucuacuggaaacuaccaagaaagaccucggcaucgggcacguggcugucgagaaccaucaccaugcgacaaugcuugauguggaccugcacccugccucagcauggaccuuguacgcugucgccacuacaauuaucacgcccaugaugcgucauaccauagaaaauacuacagccaacauuucucugaccgcaaucgcuaaucaggccgcgauucucaugggacuggauaagggcuggccaaucaguaaaauggacauaggugugccucuuuuagcucuggggugcuacucgcagguuaacccgcucaccuugacagccgcagugcugaugcuaguagcccacuaugcuaucauuggccccggacugcaagcaaaggccacuagagaggcgcagaagaggacggcugccggcaucaugaaaaauccaaccguggaugggauugucgcaaucgaccucgauccuguuguguacgacgccaaguucgaaaaacagcuuggacagauaaugcuguugauucuguguacaagccaaauccuccugaugcgcacuaccugggcuuuaugcgaguccaucacacuugccaccggcccccugacuacgcucugggaggguucuccagggaaguuuuggaacacaaccauugcagucucaauggcuaauaucuuccggggaagcuaucuagccggcgcgggucuggccuuuuccuugaugaaaagucugggcgggggacgaagaggcacuggggcacagggagaaacccucggcgagaaguggaagaggcagcuuaaccagcugucuaaaagcgaguucaauauauacaagcgcucagguauuauggagguggaccgguccgaagcuaaagagggguugaagagaggagagacaacucgucacgccguaaguaggggcaccgcaaaacugcggugguucguggaacgcaaccucguuaagccugaggguaaggugaucgauuuaggcugugggcgaggaggcuggagcuauuacugcgcugggcugaaaaaggucacagaagugaaaggauauacgaagggcggucccgggcaugaggaaccgauuccaauggccaccuacggauggaaucuugucaaacugcacucuggcaaggacguguuuuucacuccucccgagaaaugugauacacuacucugcgacaucggcgaguccucaccaaaccccaccauagaagaggggagaacucugaggguuuugaagaugguagaaccuuggcugcggggaaaucaauuuuguaucaagauucucaacccguacaugcccagcguggucgagacacuugagcagaugcagcgcaaacaugguggcaugcuggugagaaauccauuaucgaggaacucuacccacgaaauguauuggguuaguugcgggacgggaaauaucguguccgccgucaacaugaccagccgaaugcuguugaaccgguucacaauggcgcaccguaagccuacuuacgagagagauguggaccucggcgcugguacccgccauguagcaguggaacccgagguugccaaucuggauauuaucgggcagaggauugaaaacaucaaacacgagcauaagucaacauggcacuaugacgaggauaauccuuacaaaacuugggcuuaucauggauccuacgaagucaagccaucuggcagcgccaguuccauggugaacggcguggucaagcuacuuaccaaacccugggacguuauaccuauggugacacaaauugcaaugaccgauacuacgccauuugggcagcagcggguauucaaggagaaaguggacacaagaacccccaaggccaaacgcggaacugcucaaaucauggaagucaccgcgagguggcugugggguuuucucagccgaaauaagaagccgcggaucuguacaagagaggaguucacgaggaaagugcgcucuaacgccgcaauuggcgcuguuuuuguggacgagaaucaguggaacucagccaaggaggcagucgaagaugagcguuucugggaccuggugaaaaaggaacgggaguugcacaaacaggggaagugcgcaaccugcguauauaauaugaugggaaagagagagaaaaagcugggcgaguuugguaaagcuaaggggaguagggccauaugguacauguggcucggagcgcgcuuccuugaguuugaagcacugggcuucaugaacgaggaucacugguucucccgagaaaauagcuuaucuggcguugagggggagggacugcauaaauuggguuacauccuccgggacauuucgaagaucccuggcgggaacauguaugccgaugacacugcuggaugggauacaagaauuaccgccgacgaucugcagaaugaagcaaaaaucacugacauaauggagccagaacacgcucuacuugccacaucaaucuuuaagcugaccuaccaaaacaagguggucagggugcagcgccccgcuaaaaauggcacagugauggaugucauuagcagacgggaccagagggguuccgggcagguuggaacuuauggccucaacaccuucacgaacauggaggcccaacugauccgucagauggaaagugagggcauauuuuugccuucugaguuagaaaccccaaaucuggcagagcgagugcucgauuggcuugaaaaguacgggguagagcgccugaaaagaauggcgaucagcggagacgacuguguggucaagcccauagaugaccgguucgccacagcucuaacugcccugaacgauauggguaaagugaggaaggacauuccgcagugggaaccuuccaagggcuggaaugauuggcagcaaguucccuuuugcucacaucacuuccaccagcucaucaugaaagacgggcgcgagaucguggucccauguagaaaccaggaugaguuggugggacgggcaaggguaagucagggcgcugguuggucucugcgagaaaccgccugccuuggaaagagcuaugcacaaauguggcagcugauguacuuucaucguagagaccuccgcuuagccgcgaaugcuauuuguuccgccguuccuguggauuggguccccacaucacggacuaccuggagcauacacgcacaucaccaguggaugacgacagaggacaugcugucuguguggaacaggguuuggaucgaagagaauccauggauggaagauaaaacccauguguccaguuggggagacguccccuauuugggcaagagagaggaccaauggugcggcagccugauugggcucacugcccgcgcuacaugggccucgaacauccagguggcaauuaaucagguacggaggcuuaucggaaacgagaauuaccuggauuacaugaccuccaugaaacgauucaagaacgaaggugacccugagggcgcucuaugguga

SEQ ID NO: 13942 - RNA, 9879 nt, Artificial Sequence
  derived and/or modified CDS sequence (opt3) from DENV-1__GU131770__SS-prME
agcgugaccaugcugcucaugcuuaugcccaccgcccuggcuuuccacuugacuacgagaggcggggaaccucauaugaucgucuccaagcaggaaaggggaaagucuuuacuguuuaagaccucagccgguguuaauaugugcacgcuaauugccauggaccucggcgaacugugugaagauacuaugaccuacaagugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucuccgcgggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuacuuggcucugauggccaccuucaaaauacgcccuauguuugcagugggcuuacucuuccggagacugacgagcagggagguccuucugcuaacaaucggucucucacugguggccaguguugaauugccaaacucccuggaggaauuaggggauggacucgcuaugggcauuaugauccugaaacuucugaccgacuuucaaucucaucaguugugggcgacucuccugagccuaaccuucauuaaaacaacuuuuucccugcacugugccuggaagaccauggcaauggugcuuucaaucgucagccucuucccccugugcuugaguacgacaucucagaaaaccacuuggcugccgguauuacucggcucccugggguguaagccucuuacaauguuucugauagcugagaauaagaucuggggacgacgcagcuggccauugaacgaagguauuauggccgugggcaucguuucgauucuccugucaucucuacugaaaaacgaugugccccuugccgggccucucaucgcuggaggcaugcugauagcaugcuaugucauuagugguuccagcgccgacuugucuuuagagaaggcggcugaggugagcugggaagaggaagccgagcauuccggggcaucacacaauauccugguagaagugcaggaugacggaaccaugaaaaucaaggaugaggagcgggacgauacucucacaauucugcuuaaagccacccuguuggcugucaguggcguuuacccccuaagcauaccagcaacgcuguucgugugguauuucuggcaaaagaaaaagcagagaucuggcgugcucugggacacuccuucacccccagaagucgagagggccgugcuggaugacgggaucuaccguauuaugcagcgcggacuuuuaggucggagccagguuggcguagggguguuucaagaaaacgucuuccauaccauguggcacgugacaagaggagcgguucugauguaucagggcaagaggcucgagccgaguugggcuagcgugaaaaaggacuugaucuccuacggugggggauggcgacugcagggcucuuggaauaccggcgaggaaguccaggugauugccguagagccugggaaaaaccccaagaauguccaaacagcaccaggaacuuuuaaaacccccgaaggugaggugggcgccaucgcucucgauuucaagccugggacgucgggaagcccaauaguuaaccgggaaggcaagaucgugggucuguacgggaauggagucgugacaacuucaggcaccuauguuuccgccauugcacaggcuaaagccagucaggagggcccccuuccugagaucgaagacgagguguuucgcaagagaaaccugacaauuauggauuugcacccggggucuggaaaaaccaggcgguaccuaccagcgaucguccgagaagccauaaagagaaaacugcgcacucucauuuuagcacccaccagggugguagcuagcgagauggccgaagcucugaaggguaugccuauccguuaucaaacaacggcagugaaguccgagcauacuggcaaagagaucguugaccuuaugugucacgccaccuucacaaugcggcugcucucaccagucagagugcccaauuacaacaugauuaucauggaugaagcccauuuuaccgacccuucuagcauagcugcgaggggguauauuaguacucgcgugggaaugggcgaggcagccgcuaucuucaugacagccaccccgcccgguuccgucgaagcauuuccacagagcaaugccguaauucaggaugaggaacgagacaucccugagagaucuuggaacucaggguacgaguggauaacggauuuccccggaaagacugugugguuuguuccauccauuaaaaguggcaaugacaucgcuaacugcuugcggaagaauggcaaaagggugauccagcugagccgcaagacauucgauaccgaauaucaaaagaccaaaaacaacgacugggacuacgucgugacuacagauauuucggagaugggggcgaauuuccgugccgacagaguuaucgauccucggaggugccucaagcccgugauucugaaagacggaccagaacgcgucauacuugcagguccgaugccugugaccguagcuucugccgcacagcgaagaggccggaucgggaggaaccacaauaaggagggagaucaguacauuuauaugggccagccccuaaacaaugacgaggaucaugcccacuggacagaagcuaaaaugcuguuggacaacaucaauacuccagaggguaucauucccgccuuauuugaaccugagcgcgaaaaguccgcggcaauagauggggaguacagacugaggggcgaggcccggaagacguucguggaacucaugcgucgcggagaccugccaguuuggcuuagcuauaaagucgcuucagagggcuuucaauacagugaucgaagaugguguuucgacggggaaaggaacaaucaggugcuggaggaaaacauggauguggagaucuggaccaaggagggagaacggaaaaagcuccgccccagaugguuggacgccaggacauauucugacccucuggcucuacgggaguuuaaagaguucgcagccggucgaagauccgucagcggcgaucugauucucgagaucgggaaacuuccgcagcaccugacucagcgcgcucaaaaugccuuagacaacuugguuaugcugcauaauucagaacagggaggcagggcauaccggcacgcgauggaggagcucccagauaccauugaaacacugaugcuucuggcccucaucgcuguguugaccggugggguaacucuguuuuucuuaaguggccguggacuaggcaaaacgagcauagggcugcucugcgugauggccuccucuguccuucuguggauggcaagcguggagccccauuggaucgcugccuccauuaucuuggaauuuuuccugaugguucuccugauuccugagcccgacaagcagagaaccccacaggauaaccaacuugcauauguggucaucggacuccuguuuaugauauugacaguagccgcuaaugagaugggucuguuagaaacuaccaagaaagaccuaggcauugggcacguggcgguugagaaccaccaucacgccgcaaugcuggauguggaccuccauccugcuucagccuggacacuuuacgccgucgcaaccacuaucauuacacccaugaugaggcacacgaucgaaaacaccacugcuaauauaucucugacagccaucgcgaaccaggcugccauuuugaugggacuggauaagggcuggccaaucaguaaaauggacauuggugugccucuccuggcacuuggguguuacucgcaggucaauccguuaacccugaccgccgcugugcucauguugguugcacauuaugccaucauaggccccggacugcaagcgaaggcuacacgcgaggcccagaaacggacugcagccggcauuaugaagaacccaacgguggaugggaucguagcuaucgaccuagauccuguggucuacgacgccaaguucgaaaaacagcugggacagauuaugcuccuuauccugugcaccagccaaauauugcugaugcgaacaacuugggcacucugugaguccauuacccuggcuacaggccccuuaaccacucuuugggaggguucuccagggaaguuuuggaauacgacaaucgccguuucaauggcgaacauuuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguaucauggagguggaccguuccgaagcaaaagaggggcuuaagaggggagagacaacuaaacacgcugucagucggggcaccgccaagcugcgcugguucguggaacgaaauuugguaaaaccugaggguaaggugauagaucugggcugcgggagaggaggcuggagcuauuacugugccgggcucaagaaaguuacagaagugaagggauauacgaaaggcggucccgggcacgaggaaccgaucccaauggcgaccuacggauggaacuuagucaagcugcauucuggcaaagacguguuuuucauuccucccgagaagugcgauacucuucugugugacaucggcgaguccucaccaaaucccacaauugaagaggggaggacccuacggguccucaaaaugguggaaccuuggcugcgcggaaaccaauuuugcaucaagauuuugaauccguacaugcccagcguuguagagacucuggagcagaugcagagaaagcacgguggcaugcucgugaggaacccacuuucgcgaaauucuacacaugaaauguauugggucaguugugggaccggaaacaucguguccgcuguuaauaugacgagccggaugcuguuaaaccguuucaccauggcacacagaaaaccuacauacgagcgcgauguggaccugggcgccgguacuaggcacgucgcuguggaacccgagguagccaacuuggauauaauugggcagcggaucgaaaauaucaagcaugagcacaaaucaaccuggcauuaugacgaggauaacccuuacaagacaugggcauaucacggauccuacgaagugaaaccaucuggcagcgccaguuccaugguuaauggcgucgugaagcuccugacuaagcccugggacgugauuccuauggucacccaaauagcuaugacagauaccacuccauuugggcagcagagaguuuucaaagagaagguggacacgcgcacacccaaagcgaagaggggaaccgcccaaaucauggaaguaacugcaaaauggcuaugggguuuucuuagccgaaacaagaagccgcggauuugcaccagagaggaguucacaaggaaagugcgcucuaaugcugccaucggcgcagucuuuguggacgagaaccaguggaacucagccaaggaggcuguugaagaugagcguuucugggaccuggugcaucgggaaagagagcuccacaaacaggggaagugcgccacgugugucuauaacaugaugggaaaaagggaaaagaagcugggcgaguuugguaaagcgaaggggagucgcgcaauuugguacaugugguugggagcccgauuccuggaguucgaagcucucggcuuuaugaaugaggaucacugguucucccgggaaaacagccuuucuggcguggagggggagggacugcauaaauuagguuacauccugagagacauaucgaagaucccuggcgggaauauguaugccgaugacaccgcaggaugggauacuaggauuacagaagacgauuugcagaacgaggcucgcaucaccgacauuauggaaccagagcacgcccuccuggcuaaaucaaucuuuaagcuaacuuaccaaaauaaaguaguuagagugcagcggcccgccaagaacggcacagucauggaugugauaagcaggcgugaccagcgagguuccggacaggugggaaccuauggccuuaauacauucacuaacauggaagcacaacugauucgccagauggagagugagggcaucuuuucuccuagcgaacucgagaccccaaaccuggcggaaagagucuuggauugguuagagaaguacgggguugaacggcugaaaaggauggccaucuccggagacgacugcgugguaaagcccauugaugaccgcuucgcuacggcccucaccgcacuuaaugauauggguaaagugagaaaggacauaccgcagugggagccuucaaaaggcuggaacgauuggcagcaaguccccuuuuguagucaucacuuccaccagcugaucaugaaggacgggcgggagauugugguuccaugcaggaaucaggaugagcuagugggacgagcucgugucucucagggcgccgguuggagccugagagagacagcaugucucgggaaguccuaugcccaaauguggcaguugauguacuuucaucgccgggaccugaggcuugcggcuaacgccaucugcucagcagugccuguagauuggauucccacuagcagaaccacauggucuauccacgcccaucaccaguggaugacuaccgaagacaugcuguccguuuggaaucgcguguggauagaggaaaacccauggauggaggauaaaacgcauaucaguagcuggggagacguccccuaucucggcaagcgggaggaccaaugguguggcucguuaauugggcugacagcuagggccaccugggcaacuaauauccagguggcuauuaaccagguucgaagauugaucggaaaugaaaacuaccuggauuacaugacauccaugaaacgguucaagaaugagucugacccugaaggugcccucugguga

SEQ ID NO: 13943 - RNA, 9879 nt, Artificial Sequence
  derived and/or modified CDS sequence (opt3) from DENV-1__GU131773__SS-prME
agcgugacaaugcugcucaugcuuaugcccacagcacuggcuuuccacuugacuacgagaggaggggagccucauaugaucgucuccaagcaggaaaggggaaaaucuuuacuguuuaagaccucagccgguguuaacaugugcacacugauugcaauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcaugaccaaauuagaagggaagauaguacaguacgagaaccugaaauauucagugauugucacagugcacaccggagaucagcaucaaguugguaaugaaaguacugagcacggcacgacagccaccaucacuccccaggcgccuaccacagaaauucagcucaccgacuacggggcccuuacucuggacuguagcccaaggacaggauuggauuucaacgagauggugcuacugacgaugaaggagaaaucuuggcucguccauaagcagugguuucuggaccuuccgcugcccuggaccuccggcgcaucaacuagccaagaaacauggaaucggcaggauuugcucgugaccuucaaaacagcucacgccaagaagcaggagguaguugugcuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugucauguguacugguagcuucaaacuugaaaaggagguggcugagacccagcacggaacggucuuggugcagauuaaguacgaaggcacagaugcgccuugcaaaauaccauucucgacccaagacgagaaggggguuacucagaacggacgccugaucacagcaaaucccauugugaccgauaaagaaaagccuguaaacaucgaggccgagccacccuuuggcgaaucuuauauagucauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguguuuacauccguugggaaacuggugcaucagaucuucggaacggcguacggcgucuuguuuucuggugugagcuggaccaugaagauugggauaggcguacuccugacuugguuaggacuaaauucacgaaguacaucccuaagcaugaccuguaucgcugugggccucguuacacuguaccuuggggucauggugcaggccgacucuggaugcgugauuaacuggaaaggccgcgaguugaagugugguucagggaucuucgucacuaaugaaguucacaccuggacggagcaauauaaguuucaggcagauaguccgaaaagacugagcgccgcuaucggaaaggccugggaggaaggcgugugcgguauuagguccgcaacacggcucgagaacauaauguggaaacagaucucuaacgaacugaaucauauuuuacuggagaacgacaugaaguucaccgugguagucggcgacguggcugggauccuuguucagggcaagaagaugauucgcccucaacccauggaauacaaauauucguggaaguccuggggcaaggccaaaaucauaggggcggaugugcaaaauuccacuuuuaucauugacggaccaaacaccccugagugucccgaugaccagagagccuggaauaucugggaggucgaagauuacggcuucgguauuuuuacaacuaacaucugguugaagcucagggacucauauacccaggugugcgaucaccgucugaugagugcugcaauaaaagacucuaaggccguucacgcugauaugggguacuggauugagagcgagaagaaugagacauggaagcuagcccgggcauccuucaucgaagugaagacguguauuuggccaaaaucacauacccuguggagcaacggaguacucgagucugagaugaucauacccaagauccacggcgguccuauuucccaacauaauuaucgaccaggcuacuucacucagacagcggggccguggcaccugggaaaacuugaauuggacuuugaucugugcgagggcaccacugucgugguggacgaacacugcgggaacagaggacccaguuuaaggacaaccacggucacuggcaagaucauucaugagugguguugccgcagcuguacccucccuccacugcgguucagaggugaggaugggugcugguacggaauggaaaucaggcccguuaaagagaaggaagagaaucuugugaagucuaugguauccgccggcucaggugaaguggacaguuuucuguugggccuccuguguauaagcauuaugaucgaggaggucaugcgcucgcgauggucccggaaaaugcuaaugacagggacccuggcuguguucuuucuccugaucaugggacagcuuacuuggaacgacuugauucgucugugcaucaugguuggcgccaaugcaucugauagaauggggaugggaacaaccuauuuagcucucauggccacauucaagaugaggccuauguuugcagugggccugcuuuuccgccggcugacuagcagagaaguccuacuccugaccauugguuugucacugguggccaguguugaguuaccaaacucccucgaagaacugggggacggacuugcuaugggcauaaugauccugaaauugcucacggauuuucaaucuuaccagcugugggcgacacuacugagccuuaccuucauuaagacuaccuuuucccuccacuaugccuggaaaacaauggcaauggugcugucaaucgucagcuuguucccccuguguuuaaguacuaccucucagaagacgacauggcucccgguacugcuuggcucccuggggugcaagccuuugaccauguuucucauugcugaaaauaaaaucuggggaagaaagagcuggccacugaacgaggguauaauggccgugggcaucguuucgauucuacugucaucucuucucaaaaacgacgugccccuggccgggccuuugaucgcuggaggcauguuaauugcauguuacgucaucagugguuccagcgccgaucugucucucgagaaggcggcugaagugagcugggaggaagaggccgaacauuccggggcaucacacaauauacugguagaggugcaggacgauggaacuaugaaaauuaaggacgaggaacgagaugacacacuuaccauccuguugaaagccacucuacuggcugucaguggcguuuauccccucagcaucccagcaacacuguucguguggcauuucuggcaaaagaagaaacagcgcucuggcgugcuuugggauaccccuucacccccagaggucgaacgggccguguuagacgaugggauuuacagaauaaugcagaggggacugcucggucguagccagguuggcguagggguguuucaagagaacgucuuccacacgauguggcacgugacucgcggagcgguuuugauguaucagggcaagcggcuggagccgaguugggcuagcgugaaaaaggaccucaucuccuacggugggggauggagauuucagggcucuuggaauaccggcgaagagguccaggugauugccguagaaccugggaaaaaccccaagaauguccaaacagcaccaggaaccuucaagacacccgagggugaagugggcgccaucgcucuggacuuuaaaccugggacuucgggaagcccaauuguuaacagggagggcaagaucgugggucuuuacgggaauggagucgugaccacgucaggcacauauguuuccgccauagcacaggcuaaagccagucaggagggcccccugccugaaaucgaggaugaaguguuccgaaagcggaacuugacuauuauggaccuacauccggggucuggaaaaacccgcagauaccugccagcgaucgucagggaggccauuaagcggaagcuccgaacauuaauccuggcacccaccagagugguagcuagcgaaauggccgaggcucuuaaagguaugccuauacgcuaucaaacuaccgcagugaaguccgagcacacaggcaaagaaauuguugaucugaugugccaugccacguuuacuaugaggcucuugucaccaguccgugugcccaauuacaacaugaucaucauggacgaggcccacuucaccgauccuucuagcauugcugcgcggggguauaucaguacaagagugggaaugggcgaagcagccgcuauauuuaugaccgccacuccgcccgguuccauggaggcauucccacagagcaaugccgucauucaggacgaagagagggauaucccugagcgcucuuggaacucaggguacgaauggauuacagacuuucccggaaagaccguaugguucgugccauccaucaaagcuggcaaugauauagcgaacugucugcgaaagaauggcaagagaguuauucagcucagucggaaaacguucgacacugaguaucaaaagaccaaaaauaacgauugggacuacguggucaccaccgacaucagcgaaaugggggccaauuuuagggcagaucgcgugaucgacccucguagaugccugaagcccguuauucuuaaagauggaccagagcgggugauccuagcugguccgaugccugucacuguggccucggcagcccagaggcgcggccgaauugggagaaaccauaauaaggagggagaccaguacauauauaugggccagccccugaacaaugaugaagaccacgcucacuggacagaggccaagauguuguuagauaacaucaauaccccagaagguauuauccccgcgcuguucgagccugaacgggagaaaucugcagccaucgacggggaguacaggcuccgcggcgaagcuagaaagacauuuguagagcugaugaggcggggagaucuuccaguguggcuguccuauaaaguugccagcgaaggcuuccaauacucagaccgucgcuggugcuuugauggggagcgaaacaaucagguccucgaagagaacauggacguggagauuuggacuaaggaaggagagaggaaaaaguugaggccccgguggcuggaugcucgcacguauagugacccucuagcacugagagaguucaaagaguuugccgcugguaggcggucuguguccggcgaccucauacuugaaaucgggaagcugccgcagcauuuaacccagcgagcccaaaaugcauuggauaaccuggucaugcuccacaauagcgagcagggaggcagagcguaccgccaugccauggaggaacugccagacacaauugagacucuuaugcugcucgcuuugaucgccguucugaccgguggggugacauuauucuuucuaucaggcaagggacugggcaaaaccaguauugggcuccuuuguguaauggcaagcuccgugcuguuguggauggcuucugucgaaccccacuggaucgccgcaagcauaauccuggaguucuuucucauggugcugcuuauuccugagcccgauaggcagcggacuccacaggacaaccaacucgccuauguugugaucggacuguuguucaugauucugacggucgcugcgaaugaaauggguuuacuagagaccacaaagaaagaucugggcaucgggcacguagccguggaaaaccaucaccaugcagcuaugcucgacguugaucuucacccugccuccgccuggacucuguacgcaguggcuaccacaauaauuacccccaugaugcgucauacuaucgagaacacaacggccaauauuucauugaccgcgaucgcuaaccaggccgcaauacugaugggacucgacaagggcuggccaaucucuaaaauggauauuggugucccucugcuugccuuagggugcuacagucaggugaauccgcugacucucacagcugcagucuugaugcugguggcccacuaugcgaucauuggccccggacuacaagcuaaggccaccagagaagcacagaagaggaccgccgcuggcaucaugaaaaacccaacaauagacgggauuguugccaucgaucuggacccugugguauacgaugcaaaguuugagaaacagcucggacagaucaugcuucugauuuuguguacuucgcaaauccugcucaugcgcacgaccugggcucugugcgagagcauaacauuagccacuggcccccuuaccacacugugggaagguuccccagggaaguucuggaauaccacuauugcggugucuauggccaacaucuuccggggaucauaucucgcaggcgcuggucuagccuuuagccugaugaaauccuugggcgggggacgaagaggcacgggggcacagggagagacacugggcgaaaaguggaagaggcagcucaaucagcuuaguaaaucugaguucaacaccuacaagcgcagcgguauuauggaagucgaccggucagaggcuaaagaggggcugaagagaggagaaacuaccaaacacgccguuucccguggcacagccaaguugaggugguuuguggagcggaaucuggucaagccugaagguaaagugaucgaccucggcugugggcgcggaggcuggaguuauuacugcgcgggguuaaagaaaguaacugaggugaagggauauaccaaaggcggucccgggcaugaagaaccgauaccaauggcuacauacggauggaaccugguuaaacuucacagcggcaaagauguguucuuuaucccucccgagaagugugacacgcugcuaugcgauauuggcgaaucuuccccaaaucccaccaucgaggaagggcgaacucucagaguccugaagaugguggagccuugguugaggggaaaccaauucuguauuaaaauccugaauccguacaugcccucagucguggagacacucgaacagaugcagcggaagcaugguggcaugcuuguucgcaacccacugagcagaaauucgacccacgagauguauuggguaucuugcgggacuggaaacauugugagugcagucaauaugacauccaggauguuacugaaccgauuuaccauggcccaccggaaaccuacguacgaacgugacguggauuugggcgcugguaccagacauguugccguggagcccgaagucgcaaaccucgacaucauagggcagcgcauugagaauaucaagcacgagcauaaaagcacauggcacuaugaugaagacaacccuuacaagacuugggccuaucauggaucauacgaggugaagccauccggcucugcuagcaguaugguaaauggcgugguuaaacugcuaaccaagcccugggaugucaucccuauggugacacaaauugcgaugacugacaccacaccauucgggcagcagaggguguuuaaagaaaaggucgauacccggacucccaaagccaagagaggaacggcacaaauaauggagguuacagcucgcuggcuuugggguuuccuguccaggaacaagaaaccgcgaaucuguacccgggaagaguuuacuagaaaggugaggagcaaugccgcaauuggcgccguauucguggacgagaaccaguggaacucugcuaaagaagccgucgaggacgaucgcuuuugggaccucgugcaccgugaacgggagcugcacaagcaggggaaaugcgcgaccugcguuuauaacaugaugggaaagagagaaaagaaauugggcgaguucgguaaggcaaaagggucaagggccaucugguacauguggcugggagcucgcuuccucgaguuugaagcccuuggcuucaugaaugaggaucauugguuuagucgagaaaacucccugagcggcguggagggggagggauuacacaagcuggguuacauuuugcgggacaucucuaaaauaccuggcgggaauauguaugcagaugacacagcuggaugggauacgagaaucaccgaagacgaucuccagaacgaggccaagauuacugacaucauggaaccagagcaugcucugcuagccaaaucgauuuucaaacuuacauaccaaaauaaggucgugaggguacagcgccccgccaaaaacggcaccguuauggaugugaucucaagacgggaccagagggguagcgggcaggucggaacuuauggccugaauacauuuaccaacauggaagcgcaacucauacgucagauggaguccgagggcauuuuccugccuaacgaauuggagacaccaaauuuagccgggcgagugcuggauuggcucgaaaaguacggaguggagcgccuuaaaagaauggcuaucaguggugacgacugugucguuaagcccaucgaugaccgguuugccacugcacugaccgcucuaaacgauaugggcaaagugaggaaggacauuccgcagugggaaccuucuaagggguggaaugauuggcagcaaguacccuucugcagccaccacuuucaucagcugauaaugaaagacggacgcgagaucguggucccauguagaaaccaggaugagcucgugggccgggccaggguuucccagggugcaggguggucauugcgagaaacggccugccugggaaagaguuaugcgcaaauguggcagcuuauguacuuccaccguagagaccugcgccucgcugccaaugcaauuuguucugccgugccugucgauugggugcccaccagccggacaacuugguccauccaugcucaccaucaguggaugaccacagaggacauguuaucaguauggaacaggguuuggauugaagagaauccauggauggaagauaaaacuagaaucagcucuugggaggacgugcccuaucugggcaagcgcgaggaccaauggugcggcuccuugauagggcugaccgcccgggcaacgugggcuacaaacauccaggucgccauuaaucaggugaggcgacucaucggaaacgaaaauuacagugauuacaugaccagcaugaaaagauuuaagaacgagucggaaccugagggugcgcuuugguga

SEQ ID NO: 13944 - RNA, 9879 nt, Artificial Sequence
  derived and/or modified CDS sequence (opt3) from DENV-1__GU131775__SS-prME
agcgugaccaugcugcucaugcuuaugcccaccgcccuggcuuuccacuugacuacgaggggaggggagccucauaugaucgucaccaagcaggaaaggggaaaauccuuacuguuuaagacaucugccgguguuaauaugugcacucugauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguugacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccguggucgugaccguucacacuggagaccagcaucaaguggguaaugagucaacggaacacggcacaaccgccacuaucacaccccaggcgccuacaagugagauucagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccaucuuugccggccauuuaaaaugccgucugaagauggauaaacuaacacucaaggggauguccuaugugauguguacuggaucguucaaacuggagaaggaagucgcugagacccagcacgguacggugcuuguucagauuaaguacgagggcacagacgcgccuugcaaaauaccauucucgacccaagaugaaaagggggugacucagaacggacgcuugaucacagcaaaucccauuguaaccgacaaagagaagccugucaacaucgaagccgagccacccuuuggcgagucuuauauagugauuggugcugggggcaaagcccugaagcucuccugguucaagaaaggaucaaguaucggcaagauguuugaagcaacugccagaggggcuaggcggauggccauccugggagauaccgcaugggacuucgguagcguuggcgggguguuuacauccgucggaaaacuugugcaucagauuuucggcacggcguacgguguacuguuuucuggggugagcuggaccaugaagaucggcauuggaguuuugcucacuuggcugggcuuaaauucacgaaguacaucccugagcaugaccuguauagcugucgggcuagugacacucuaccugggagugaugguccaggccgauucuggcugcguuaucaacuggaaaggucgcgagcuuaagugugggucaggaauuuucgugacuaaugaagugcacaccuggacggagcaauauaaguuucaggcagacaguccgaaaagauugagcgccgcuaucggcaaggccugggaagaggguguaugcggcaucagguccgcaacacggcuggagaacauuauguggaaacagauaucuaacgaacucaaucauauccuguuagagaacgacaugaaguucaccgucgugguuggggauguggucggcauucuggcucagggcaaaaagaugauccgcccucaacccauggaacacaaauacucguggaaaagcugggggaaggccaagauuaucggagcggacgugcagaauacuaccuuuauaaucgauggcccaaacacaccugagugucccgacgaucagagagccuggaauauuugggaaguugaggacuaugguuucgggaucuuuacuaccaacauuuggcuuaaguugagggauuccuacacacaggugugcgaccaccgucucaugucagcugcaaucaaagauaguaaggccguacaugcugacaugggauauuggauagagucugagaaaaaugagacguggaagcuggcccgggcauccuucauugaagucaagaccuguaucuggccaaaaucccacacucuauggucaaacggcgugcuggagagcgaaaugauuauccccaagauauacgguggcccuaucucucaacauaauuaucgaccaggguacuucacacagaccgcgggaccguggcaccucggcaaacuggagcuugauuuugacuugugcgaggggacuacaguggucguugaugaacacugcggaaacagaggccccucccugaggaccacgacugugaccgguaagauuauccaugagugguguugccgcaguuguacauuaccuccacuccgguucaaaggggaagacggaugcugguacggcauggagauuagacccguaaaggagaaggaagagaaucuggugaaaagcauggucucugccgguuccggcgaaguggacucauuuagucuugggcuguuguguaucagcauaaugauugaggaaguuaugaggucgcgcuggucccgaaagaugcucaugaccggaacucuggcuguguuccuacugcucaucaugggccagcugacauggaacgaucuuauccgguugugcauuauggucggggccaaugcaucugaccguaugggaaugggcaccacauaucuggcuuuaauggccacuuuuaaaaugagaccuauguucgcagugggucuccuguuuaggcgccuuaccagccgggagguucugcuacucacgaucgggcugucauugguggccagugucgagcugccaaacuccuuagaagaacucggagauggccuggcuaugggcauuaugauacuuaagcuguugacagacuuccaaucucaccagcucugggcgacccugcuaagccugacuuuuaucaaaaccacacuuucccuccauuacgccuggaagacuauggcaaugguacugucaauugugagcuuguucccccuguguuuaaguaccacgucucagaagacaaccuggcucccgguucugcuugggucccugggaugcaaaccuuugacuauguuucucaucacagaaaauaagauuugggguagaaaaagcuggccacugaacgagggcaucauggcugugggggucgugucgauacuacugucaucucuucucaagaacgauguaccccuggccggaccuuugaucgccggcgguauguuaauugcuuguuaugugaucaguggguccagcgcagaccugucucucgaaaaagccgcggaggucagcugggaggaagaggcugaacacuccggagccucacauaauauucugguugaggugcaggaugacggcaccaugaagaucaaagaugaagagagggacgauacucuuacaauacuguugaaggcaacccuacuggccgugaguggcgucuacccccucagcauuccagcuacgcuguucgugugguauuuuuggcaaaagaaaaagcagcgaucugggguucuuugggacacuccuucacccccagagguagaacgcgcaguguuagaugacggaaucuaccggaucaugcagagaggucugcucggcaggagccaggucggggugggaguuuuccaagagaacguguuccacaccauguggcacgucacacguggcgccguguugauguaucaggguaaacgccuggaaccgaguugggcgagcguaaagaaagaccucauuuccuacgggggaggcuggcggcugcagggcucuuggaauaccggggaggagguccaggugauagcuguugaaccuggaaagaaccccaagaaugugcaaacagccccagguacuuuuaaaacccccgagggcgaagucggggcaaucgcccuugauuucaagccuggaacgucgggcagcccaauugugaacagagaggguaaaaucguugggcuguacggaaauggcguggucacaacuucaggcaccuauguguccgcuauugcccaggcaaaggcuagucaggaagggcccuugccugagaucgaggacgaaguauuuaggaaacgaaaccuaacaauaauggaucugcauccgggaucugguaagacccggcgcuaccucccagccaucgugagagaggcgauuaagaggaaauuacggacucugauccuugcccccacccgaguugucgcaagcgaaauggcugaggcccugaagggcaugccuauuagauaucaaacaacggcugugaaauccgaacacacugggaaggagaucguggaccucaugugccaugcaaccuucacaaugcgcuugcugucaccagucaggguacccaauuacaacaugauaauuauggaugaggcccacuuuaccgacccuucuagcaucgccgcucguggauauaucaguacucgggugggcaugggugaagcggcagccauuuucaugacagcuaccccgcccggguccguugaggccuuuccacagagcaaugcagugauccaggaugaagagagagacauaccugaaaggucuuggaacucaggauacgaguggauuacggauuuccccggcaaaacugucugguuugugccauccaucaagaguggcaaugacauugccaacugucuccgcaagaaugggaaacgaguuauccagcugagcagaaagacauucgauaccgaguaucagaaaaccaagaacaacgacugggacuacguggucacuacagauauaucggaaaugggagcuaauuuucgggcggacagggugauugauccucgccguugccuuaaacccguaauccuaaaggacgguccagagagagugauccuggccggcccgaugccuguuaccgucgcaucugcugcccagcggagggggcgcauuggacgaaaccauaauaaggaaggcgaucaguacaucuauaugggucagcccuugaacaaugacgaggaucacgcacacuggacagaggccaaaauguuacuggacaacauuaauacuccagaagggauaauccccgcucucuucgagccugaaagagagaaguccgccgcgauugauggcgaauaccggcugaggggagaggcacgcaaaacguucguggagcuuaugagaaggggcgaccugccaguguggcucagcuauaaggucgccucagaaggguuucaauacagugaucggcguuggugcuucgacggagagcgcaacaaucagguuuuggaagagaacauggauguggaaaucuggaccaaagagggugagcgaaagaaacugagacccagguggcuagacgcucggacauauucugacccucuggcccuccgcgaauuuaaggaguucgcugcaggcagaagguccguaagcggggaucuuauccuggaaauuggaaaguuaccgcagcauuugacucagcgggcccaaaaugcucuggacaaccucgugaugcugcacaauucagagcagggcggucgagccuacagacaugcaauggaggaacuuccagauaccauagagacacugaugcucuuggcgcugaucgccgucuuaaccgggggcgugacucuauuuuuccugaguggacgcggccucgggaaaacgagcauuggacuucuguguguuauggcuuccucuguguugcuguggauggccagcgucgaaccccacuggaucgcagcuuccauuauccucgaguuuuuccugaugguacuucucauaccugaacccgacaggcagcggaccccacaggauaaccaacuggccuaugugguuaucgguuugcuguuuaugauuuuaacaguggcagccaaugagaugggccuacuggagacuaccaagaaagaccucgggaucggacacgucgcuguggaaaaccaucaccaugcgacaaugcuugaugucgaccugcacccugccucagcauggaccuuguacgcuguggccacuacaauuaucacgcccaugaugcgucauaccauagagaacacuacagccaauauuucucugaccgcaaucgcuaaccaggccgcgauucucaugggccuggauaaggguuggccaaucaguaaaauggacauagggguuccucuuuuagcucugggcugcuacagccaggugaauccgcucaccuugacagccgcaguacugaugcuaguggcccacuaugcuaucauuggacccggccugcaagcaaaggccacuagagaagcgcagaagaggacggcugccgggaucaugaaaaacccaaccgucgauggaauuguugcaaucgaccucgauccuguggucuacgacgccaaguucgagaaacagcuuggccagauaaugcuguugauucuguguacaagccaaauccuccugaugcgcacuaccugggcuuuaugcgaauccaucacacuugccaccgguccccugacuacgcucugggaggggucuccaggaaaguuuuggaauacaaccauugcagugucaauggcuaacaucuuccggggcagcuaucuagccggugcgggccuggccuuuuccuugaugaaaagucuagggggaggccgaagagggacuggagcacagggcgagacccucggugaaaaguggaagaggcagcuuaaucagcugucuaaaagcgaguucaacauauacaagcgcucagggauuauggaaguagaccgguccgaggcuaaagaaggauugaagagaggcgagacaacucgucacgccgugaguagggguaccgcaaaacugcggugguucguugagcgcaaucucgugaagccugaaggcaaggucaucgauuuaggguguggacgaggcggguggagcuauuacugcgcuggacugaaaaaggugacagaggucaaaggcuauacgaagggugggcccggacaugaggagccgauuccaauggccaccuacggcuggaaccuugugaaacugcacucuggcaaggacguauuuuucacuccucccgaaaaaugugauacacuacucugcgacaucggggaguccucaccaaaucccaccauagaggaaggaagaacucugaggguauugaagaugguggagccuuggcugcgggguaaccaauuuuguaucaagauucucaauccguacaugcccagcgucguggaaacacuugagcagaugcagcgcaaacauggcgggaugcugguuagaaacccauuaucgagaaauucuacccacgagauguauugggugaguugcggaacgggcaacaucgucuccgccgugaauaugaccagccgaaugcuguugaaccgguucacaauggcgcaccguaagccuacuuacgaaagagauguagaccucggugcugggacccgccauguggcaguugagcccgaagucgccaaccuggauauuaucggacagaggauugagaauaucaaacacgaacauaagucaacauggcacuaugacgaggauaacccuuacaaaacuugggcuuaucauggcuccuacgaggugaagccaucuggcagcgccaguuccauggugaauggggucguuaagcuacuuaccaaacccugggacgugauaccuaugguaacacaaauugcaaugaccgauacuacgccauuuggacagcagcggguguucaaggaaaaagucgacacaagaacccccaaggccaaacgcgguacugcucaaaucauggaggugaccgcgagguggcuguggggcuuucucagccgaaacaagaagccgcggaucuguacaagagaagaguucacgaggaaaguucgcucuaaugccgcaauuggggcuguguuugucgacgaaaaccaguggaacucagccaaggaggcaguggaggaugaacguuucugggaccugguacagaaagagcgggaauugcacaagcagggaaaaugcgcaaccugcguuuauaacaugaugggcaagagagagaagaaacugggugaauuugggaaggcuaaaggaaguagggccauaugguacauguggcucggcgcgcgcuuccuugaguuugaggcacugggcuucaugaaugaagaucacugguucucccgagagaacagcuuaucugggguggaaggagagggucugcauaaguugggcuacauccuccgggacauuucgaaaaucccugggggaaauauguaugccgaugacacugcuggcugggauacaagaauuaccgaggacgaucugcaaaacgaagccaagaucacugacauaauggagccagaacacgcacuacuugcuacaucaaucuuuaaacugaccuaccagaauaaggucgugagggugcagcgccccgccaagaacgguacagucauggauguuauuagcagacgggaccagaggggguccggacaagugggcacuuauggccucaauaccuucacgaacauggaggcucagcugauccgucagauggaaagugaggggauauuuuugccuucugaguuagaaaccccaaaccuggccgagcgaguacucgauuggcuugaaaaauacggaguggagcgccugaagagaauggcaaucagcggugacgacugugucgugaaacccauagaugaccgguucgcgacagcccuaacugcucugaaugauaugggcaagguuaggaaagacauuccgcagugggaaccuuccaagggguggaacgauuggcaacaggugcccuuuugcucacaucacuuccaccagcucaucaugaaggacggacgcgagaucgucgugccauguagaaaucaggaugaguugguaggccgggccaggguuagucaaggugcaggguggucucugcgagaaaccgcuugccuuggaaaaagcuaugcccagauguggcagcugauguacuuucaucguagagaccuccgcuuagcagccaacgcgauuuguuccgcugugccugucgauugggugcccacaucacggacuaccuggagcauacacgcccaucaccaauggaugacgacagaggacaugcugucuguuuggaauaggguguggaucgaagagaacccauggauggaagauaagacccaugucuccaguuggggcgacgugcccuauuugggcaaaagagaggaccaguggugcgggagccugauuggacucacugcacgcgccacaugggcuucgaauauccagguagccauuaaccaggugcggaggcuuaucgguaaugagaacuaccuggauuacaugaccuccaugaagcgauucaaaaaugaaggcgacccugagggggcacuaugguga

SEQ ID NO: 13945 - RNA, 9879 nt, Artificial Sequence
  derived and/or modified CDS sequence (opt3) from DENV-1__GU131777__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccgguagcuucaaacuggagaaggaaguggccgagacgcagcacggaacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcuauaaguggcguguauccccugagcaucccagcaacgcucuuugucugguacuucuggcagaagaagaagcagcggucuggcguucugugggacacuccuucacccccagaaguggagagagccgugcuugaugacgggauuuauaggaucaugcagcguggauuacugggucgcagccaggucggcguggggguuuuccaagaaaacguauuucauaccauguggcacgugacacggggagcgguccucauguaccagggcaaaagauuggagccgaguugggcuagcgugaagaaagaccugauuuccuacggugggggauggaggcuccagggcucuuggaauaccggcgaggaaguucaggugaucgccgucgagccugggaagaaccccaaaaaugugcaaacaacuccaggaaccuucaagacgcccgaaggugagguaggcgcaauagcccuggauuuuaagccugggacaucgggaagcccaaucgucaaccgagaaggcaaaauugugggucuuuaugggaauggaguugugacuaccucaggcacauacgucuccgcuaucgcccaggcaaaggcuagucaggagggcccccugccugagauugaagacgagguguuccggaaacgcaacuugaccaucauggaucuacacccggggucuggaaagacuagaagguaucugccagccauaguucgggaagcgauuaaacgaaagcucagaaccuuaauccuggcccccacacgcguggucgcaagcgagauggcugaagcccuuaaggguaugccuaucagguaccaaacgacugcugugaaauccgagcauaccggcaaggagauuguagaccugaugugccacgcaacauuuaccaugcgucucuugucaccagugcggguucccaauuauaacaugaucauaauggaugaagcccauuucacugacccuucuagcauugccgcuagaggguacaucaguacaagggucggaaugggcgaggcggcagccauuuuuaugaccgcuacgccgcccgguuccguggaagccuucccacagagcaaugcagugauccaggaugaggaacgcgacauaccugagcgaucuuggaacucaggguaugaguggauuacugauuuucccggaaaaacagucugguucguaccauccaucaagaguggcaaugacaucgccaacugucugaggaaaaauggcaagcgggugauucagcucagcaggaagaccuuugauaccgaauaccagaaaacuaagaacaacgacugggacuacguugugacaaccgauaucucggagaugggggcuaauuuccgcgcggaccgugucauugauccuagacggugccugaaacccgugauacuuaaggacggaccagaaaggguuauccuagccgguccgaugccugugacagucgcaucugcugcccagcgccgaggcagaauugggcggaaccacaauaaagagggagaucaguauaucuacaugggccagccccugaacaaugacgaggaucaugcacacuggacugaagccaagauguuguuagacaacaucaauacgccagaggguauuauacccgcucuguucgaaccugagagggaaaaguccgccgcgaucgauggggaguaucgccucagaggcgaggcaaggaaaaccuuuguggaacugaugcggcguggagaccuuccaguauggcugagcuacaagguggccucagagggcuuccaauauagugaucgccgauggugcuuugacggggaaagaaacaaucagguucucgaggaaaacauggaugucgagauuuggacaaaagagggagaaaggaagaaauugcggccccgcuggcuggacgcuagaacuuacucugacccucuagcccugagggaguucaaggaauuugcugcaggucggcgauccgugagcggcgaucucauccuugagauugggaaacugccgcagcacuuaacccagagagcccaaaaugcuuuggacaaccuggugaugcuccauaauucagaacagggaggccgcgccuauaggcacgcaauggaggagcugccagauacaaucgaaacccuuaugcugcucgcguugauagccguccugacuggugggguuacguuauucuuucuaaguggccggggacugggcaagaccagcaucgggcuccuuugugugauggcuuccucuguacuguuguggauggccagcguggagccccauuggauugcagcuuccaucauucuggaguucuuucucaugguccugcuuaucccugagcccgaccgucagagaacaccacaggauaaccaacucgccuacgugguuauaggacuguuguucaugauucugacuguggcagccaaugagauggguuuacuagaaaccacaaagaaagaccugggcaucgggcacgucgcuguaggaaaccaccaucacgcggccaugcucgauguggaccuucauccugcaucagcuuggacccuguacgccguugccacuacaauuaucacgcccaugaugaggcacaccauagagaacacuacagcaaauaucucuuugaccgcuauugccaaccaggcggcuauccugaugggccucgauaaggguuggccaauuaguaaaauggacaucggggugccucugcuugccuuaggcugcuauucgcaggucaauccgcugacccucacagcagccguguugaugcuggucgcucauuacgcaauaauuggacccggccuacaagccaaggcgacucgcgaagcucagaaacggacggccgcagggaucaugaagaacccaaccguggauggaaucguugccauugaccuggauccugugguauaugacgcuaaguuugagaaacagcucggccagaucaugcuucugauauuguguacaagccaaauucugcucaugcgaacuaccugggcccugugcgaauccaucacauuagcaaccgguccccuuacuacgcugugggaggggucuccaggaaaguucuggaauacaaccauugcugugucaauggccaacaucuuuagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguucaacacauauaagagaucagggauaauggaagucgaccguuccgaggccaaagaaggacugaagaggggcgagacuaccaaacacgcaguuagucgggguacagcuaaguugcgcugguuuguggagcgaaaucuggucaaaccugaaggcaaggugaucgaucucggguguggaagaggcggguggagcuacuauugcgccggauuaaagaaaguaacggaggugaagggcuacaccaaaggugggcccggacacgaagaaccgauuccaauggccacuuacggcuggaaccugguuaaacuucauucuggcaaagacguguucuuuaucccucccgaaaagugugauacacugcuaugcgacauuggggaguccucaccaaaucccaccaucgaggaaggaaggacucuccggguccugaaaaugguggagccuugguugcgcgguaaccaauucuguauuaagauccugaauccguauaugcccagcgucguggaaacacucgagcagaugcagagaaagcacggcgggaugcuuguuaggaacccacugucgcgaaauucuacccaugagauguacuggguaaguugcggaacgggcaacauaguguccgcggucaauaugaccagccggauguuacugaaccguuuuacaauggcucacagaaaaccuacuuaugaacgcgauguggacuugggugcagggaccaggcacguugccguggagcccgaagucgcuaaccucgauauuaucggacagcggaucgagaauauuaagcaugaacacaaaucaacauggcauuacgacgaggauaacccuuauaagacuugggccuaccacggcuccuaugaggugaaaccaucuggcagcgcaaguuccaugguaaauggggugguuaagcugcuaaccaagcccugggacgucauaccuauggugacacaaaucgccaugaccgauacuacgccauucggacagcagagaguguuuaaagaaaaggucgacacacgcacccccaaagcuaagagggguacugcgcaaauuauggagguuaccgccaaauggcuuuggggcuuccugagccgaaacaagaagccgcggaucuguacaagagaagaguuuacgaggaaagugcgcucuaaugcagcuauuggggccguauucguggacgaaaaccaguggaacucagcaaaggaggccgucgaggaugaacguuuuugggaccucgugcaucgggagagagaacugcacaaacagggaaagugcgcuaccugcguuuacaacaugaugggcaaaagggagaagaaguugggugaguucgggaaagccaagggaagucgcgcgaucugguacauguggcugggcgcacgauuucucgaguucgaggcccuuggcuucaugaaugaagaucacugguuuucccgggagaacagccugucugggguggaaggagaggguuuacauaaacugggcuauauauugagagacaucucgaagauuccugggggaaauauguacgcugaugacacugccggcugggauacaaggaucaccgaggacgaucuccagaacgaagcacgcauuacugacaucauggagccagaacacgcucugcuagccaaaucaauauucaaacuuacauaucaaaauaaagucgugagaguacagcggcccgcuaagaacgguaccguuauggaugugauuagcaggcgugaccagcgaggguccggacaggucggcacauacggccugaauacuuuuaccaacauggaggcccaacucauccgccagauggaaagugaggggaucuucucuccuagcgagcuggaaacgccaaacuuggcagagagaguguuagauuggcuggaaaaguauggaguggagcggcucaaaaggauggcgauuuccggugacgacugugucguuaagcccauagaugaccgcuuugccaccgcucuuacagcccugaaugauaugggcaaagugagaaaggacaucccgcagugggaaccuucaaaaggguggaacgauuggcagcaaguacccuucugcagucaucacuuucaccagcuaauuaugaaggacggacgggagaucguggucccauguaggaaucaggaugagcuggugggccgagcacguguuucucagggugcuggguggagccucagagaaacugccugcuugggaaaguccuacgcacaaauguggcagcugauguauuuccaucgccgggaccuuaggcuggccgcgaacgcuauuuguucagccgugccugucgauuggauccccaccagcagaacaacuuggucuauacacgcacaucaccaguggaugaccacggaggacaugcucuccguguggaaucgcguauggaucgaagagaacccauggauggaagauaaaacacauauuaguagcuggggcgacguucccuacuuaggcaagcgggaggaccaauggugcgggucgcugaucggauugaccgccagggcuacuugggccacaaauauucagguggcaaucaaccagguccgaagacugauugguaaugagaacuaccucgauuauaugaccuccaugaaacgguuuaagaaugaaucugacccugagggcgcucuuugguga

SEQ ID NO: 13946 - RNA, 9879 nt, Artificial Sequence
  derived and/or modified CDS sequence (opt3) from DENV-1__GU131778__SS-prME
agcgugaccaugcugcucaugcuuaugcccaccgcacuggcuuuccacuugacuacgaggggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccacgaucacauacucuguggagcaacggaguacuagaaucugagaugaucauacccaagaucuauggcgguccuauuucccagcacaauuacagaccaggcuacuuuacacaaaccgccgggccguggcaucugggaaaacucgagcuggauuucgaccuuugcgaaggcacuacagucgugguggaugagcacugcgggaacaggggacccaguuugcgcaccacgacugucaccggcaagaucauucacgaaugguguugccggagcuguacacugccuccauuaagauuuaaaggugaggacgggugcugguauggaauggagaucaggcccguuaaggaaaaggaggaaaaucucgugaaaucuaugguauccgcuggcucaggugagguggacaguuucagccugggccuucuguguauaucgauuaugaucgaagaggucaugcgcucccgauggucucggaagauguugaugaccgggacucucgccguguuuuuccugcuaaucaugggacagcugacauggaacgaucucauucgucugugcaucaugguuggcgcaaaugcuagcgacagaauggggaugggaaccacauaccuugccuugauggcaacuuuuaaaaugaggccuauguucgccgugggccuguuauuucgccggcucaccucaagagagguccugcuucugacgauuggucuaagucucguggcuuccguugaacugccaaacucuuuggaggaacugggggauggauuagcgaugggcauaaugauccucaagcugcuuacagacuuccagagccaucaacugugggccaccuugcucucccugacuuuuauuaaaaccacauucucacuacacuaugcauggaagacuauggcuauggugcugagcaucgucagucuuuuuccccucugucugucuaccacgucccagaagacaaccugguugccgguacuguuaggcagccucgggugcaaaccucugacuauguuccuuauugccgagaauaagaucuggggaaggaaaucguggccacugaacgaagguauaauggccgugggcaucguuucaauuuugcucucuagucugcuaaagaacgaugugccccuggcugggccucuuaucgcaggaggcaugcucauugccuguuacgucaucuccgguagcucugcggaccugagcuuggagaaagcugccgagguguccugggaagaggaagcagagcauucaggggccagucacaauauauuaguagaagugcaggaugacggaacaaugaagauuaaagaugaggagcgagacgauacccugacuauccuccugaaggcuacacuucuggcagucagcggcguuuaucccuugucuaucccagccacccuauucgugugguacuuuuggcagaagaaaaagcaacgcuccggcgugcugugggacauuccuucacccccagaagucgagcgggcggugcucgaugacgggauauauagaaucaugcagaggggacugcuuggucguagucagguuggcguagggguguuccaggaaaacgucuuucauacgauguggcacgugacucgcggagcuguuuuaauguaccaaggcaaacggcuggagccgagcugggccuccgugaagaaagaccucauuucuuacggugggggauggagauugcagggcucguggaauaccggcgaggaaguccaggugaucgcaguagagccugggaagaaccccaagaauguccagacagccccaggaaccuucaaaacaagcgaaggugaggugggcgcuauugcccuggauuuuaagcccgggacuucaggauccccuaucguuaacagggaaggcaaaauagugggucucuaugggaauggagucgugaccacgaguggcacauacguuucugcaaucgcucaagccaaggcgagccaggagggcccacugcccgagauugaagacgagguguuccgaaaacggaaccuuacuaucauggaucugcacccuggguccggaaagacccgcagauauuugccggccauugucagggaagcaaucaagcggaaacuacgaacacugauacucgcuccaaccagagugguagccucagagauggcugaagcauuaaaggguaugcccauucgcuaccagacuaccgccgugaaaucugagcauacaggcaaggagaucguugaccugaugugccacgccacguuuacuaugaggcuucugagcccuguccgugugccaaauuauaacaugaucauuauggaugaagcucauuucaccgaccccaguuccaucgcggcacggggguacauaagcacaagagugggaaugggcgaggccgcugccauuuuuaugaccgcaacuccuccggguucugucgaagccuucccccaaucaaaugcuguaauccaggaugaggaaagggacauuccagagcgcuccuggaacaguggguaugaguggaucacagauuuuccuggaaaaaccgugugguucguucccagcauaaagucgggcaaugacauugcgaacugucuccgaaagaauggcaaaagagugauccaguugucucggaagacguucgauacugaauaccagaaaacaaagaacaacgacugggacuacgucgugaccaccgauaucuccgagaugggggccaauuuuagggcagaccgcguuauugauccacguagaugccugaaaccugugauccucaaggacggacccgaacgggucauucuggcugguccaaugccggugacuguagccagcgcagcccaaaggcgcggccgaauagggagaaaccacaauaaggagggagaucaguauaucuacaugggccagccucuuaacaaugacgaggaucaugcucacuggacagaagccaaaaugcuacuggacaacauuaauacccccgaggguaucaucccagcguuguucgaacccgagcgggaaaagucagcagccauugauggggaguauagguuacgcggcgaggcuagaaaaacauuuguggaacugaugaggcggggagaccucccuguuuggcugaguuacaaggucgccucugagggcuuccaguauuccgaucgucgcuggugcuuugacggggaacgaaacaaucaagugcuugaggaaaacauggauguggagauauggacuaaagagggagaaagaaagaaacugaggccacgguggcucgacgcucgcacguacagcgaccccuuggcacugagagaguucaaggaauuugccgcugguaggcggucagucaguggcgaucuaauccuggagauugggaagcucccucagcaccuuacccagcgagcccagaaugcacuggacaacuuaguuauguugcauaauagcgaacaaggaggcagagcguaucgccacgccauggaggagcugccggauacaaucgaaacucucaugcugcuugcucugauugccgugcucaccggugggguaacauuguucuuucuguccggcaggggauuaggcaaaaccucuaucgggcuacugugugugauggcaagcuccguccuccuuuggauggcuucaguggagccacauuggauagccgcaucuaucauucuggaguucuuuuugaugguucugcucauccccgagccugaccggcagcguacuccccaggauaaccagcuggccuacguggucauuggacuucucuucaugauccugacgguagcugcgaaugagauggguuugcuggaaaccacaaagaaagacuuaggcauagggcacguggccguugagaaccaccaucacgcagcuaugcuagauguggaccugcauccagccagugccuggacucucuacgcagucgcuaccacaauuaucaccccuaugaugagacacacuauugaaaacacaacggccaauaucucgcuuaccgcgauagcuaaccaagccgcaauccugaugggauuggauaagggcuggcccauuagcaaaauggacaucggugugccacugcucgcccuggggugcuauucccaggucaauccucuuacuuuaacagcugcagugcugaugcucguugcccauuacgcgauuaucggcccgggauugcaggcuaaggccaccagggaggcacaaaagcgcaccgccgcuggcauaaugaaaaaccccacaguggaugggauuguagccaucgaccuggauccaguggucuaugacgcaaaguuugaaaaacagcuaggacagaucaugcugcucauucuuuguacuucucagauccuguugaugcggacgaccugggcucugugcgagucaauaacacucgccacuggcccucugaccacauuaugggaggguagccccgggaaguucuggaauaccacuauugcgguuuccauggccaacaucuuccgaggaaguuaccuugcaggcgcuggucuggccuuuucucucaugaaaagccuaggcgggggaagaaggggcacgggggcacaaggagaaacacugggcgagaaguggaagcgccaguugaaucagcugucaaaauccgaguucaacaccuauaagcggagugguauuauggagguggacagaagcgaagcuaaagaggggcucaagcguggagagacuaccaaacacgccgucucuaggggcacagccaaacuucggugguuuguggaacgcaaucugguaaagccagaggguaaagugaucgauuugggcugugggcgaggaggcugguccuacuauugcgcggggcugaagaaaguuacugaagugaagggauacaccaaaggcgguccugggcacgaggaacccauaccgauggcuacauacggauggaaccucgucaaguuacauucaggcaaagacguguucuuuaucccaccugagaagugugauacgcugcuuugcgacauuggcgagagcucgcccaauccaaccaucgaagaggggagaacucugaggguccuaaagaugguggaacccuggcuccggggaaaccaguucuguauuaaaauccugaauccuuauaugccgucuguuguagagacauuggagcaaaugcagcgcaagcacgguggcaugcuggugagaaacccccucaguagaaauuccacccaugaaauguacugggucagcugcgggacuggaaacauugugucagcaguuaauaugacaucccgaaugcuucugaaccgguuuaccauggcccaccguaaaccaacguaugagagagauguggacuuaggcgcugguacccgccacgucgccguggaaccugagguagcaaaccuggauaucauagggcagaggauugaaaauaucaagcaugagcacaaaucuacauggcauuacgacgaggauaaccccuauaagacuugggccuaccacggaagcuaugaagugaagccuaguggcuccgcuagcucuaugguuaauggcgucgugaaauugcucaccaagccaugggacgugauccccauggucacacagauugcgaugacugauaccacaccuuucgggcaacagcggguuuuuaaagagaagguggacaccagaacuccaaaagccaagcgcggaacggcacagauaauggaaguaacagcuaaguggcugugggguuuccuaucaaggaacaaaaagccccgaaucuguacccgggaggaauuuacuagaaaagugaggaguaaugccgcaauuggcgccgucuucguggacgagaaccaauggaacuccgcuaaggaggccguugaagaugagcgcuuuugggaccuugugcaucgugaacgggagcugcacaaacaggggaagugcgcgaccugcgucuacaacaugaugggaaagagagagaagaagcucggcgaguucgguaaagcaaaggggagcagggccaucugguacauguggcugggagcucgcuucuuggaguuugaagcccugggcuucaugaaugaggaucacugguuuucucgagaaaacucgcucucaggcguggagggggagggacuucauaaacuggguuauauuuuacgggacaucagcagaauaccgggcgggaauauguacgcagaugacacagcuggaugggauacgaggaucaccgaagacgaucugcagaacgaggccaagauuacugacaucauggaaccugagcacgcuuugcucgccaaauccauuuucaagcugacauaucagaauaagguaguucgcgugcaaagaccagccaaaaauggcaccgucauggaugugaucagucggagggaccagcgugguucuggacaggugggaacuuacggccuaaauacauuuaccaacauggaagcgcagcuuauacgacaaauggagagcgagggcauuuucucccccucagaacuggagacaccuaaccucgccgggcgcguccuggauugguuggaaaagcauggaguugagagauuaaaacggauggcuaucaguggugacgacugugugguaaagccaaucgaugacagguuugccacugcacugaccgcucucaaugauaugggcaaagugcgcaaggacauuccccagugggaaccgucuaagggguggaacgauuggcagcaggucccuuucugcagccaccacuuucaucaacuuauaaugaaagacggaagagagaucgugguucccugucggaaucaggaugagcuggugggcagggcccgagucucccagggugcaggguggucacuacgugaaacggccugccugggaaagagcuaugcgcagauguggcaacucauguacuuccacagacgcgacuugcggcuggcugccaacgcaauuuguucugccgugccaguagauuggguuccuaccuccaggacaacuuggaguauccaugcucaccaucaguggaugaccacagaggacaugcuuagcguguggaauagagucuggauugaagagaaccccuggauggaagauaaaacucacaucucguccuggggcgacgugccauaucugggcaagcgcgaggaccaguggugcgggucucucauaggauuaaccgcccgggcaacgugggcuacaaauauccaaguugccauuaaccaggugaggcgacugaucgguaaugagaacuacuuggauuacaugaccucaaugaaaagauuuaagaaugaaagcgaccccgagggcgcgcugugguga

SEQ ID NO: 13947 - RNA, 9879 nt, Artificial Sequence
  derived and/or modified CDS sequence (opt3) from DENV-1__GU131779__SS-prME
agcgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccgguagcuucaaacuggagaaggaaguggccgagacgcagcacggaacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggccuccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgugaguguugaacugccaaacuccuuagaggaacucggggauggacuggccaugggcauuaugauccuuaaacuguugaccgacuuccaaucucaucagcucugggcuacucugcuaagccugaccuuuauuaagacaacuuucucccuucacuaugcguggaaaaccauggccauggugcucucaaucgucagccuguuucccuugugucugaguacgacaucucagaagaccacuugguuaccgguacuccugggcucccuugggugcaagccucugacaauguucuugauagcagagaauaaaaucuggggaaggcgaagcuggccacucaacgaagguauuauggcugugggcaucguuucgauucugcuaucaucucugcuuaagaacgaugugccccucgccgggccucugaucgccggaggcauguugauagcuuguuacgucauuagugguuccagcgcagacuuaucucuggagaaagccgcggaggugagcugggaagaggaagcugagcauuccggggccucacacaauauccucguagaagugcaggaugacggaaccaugaagaucaaagaugaggagcgcgacgauacucugacaauucuucugaaggcaaccuugcuagccgucaguggcguuuauccccugagcauaccagcuacgcucuuugugugguacuucuggcagaagaagaagcagcggucuggcgugcugugggacacuccuucacccccagaagucgagagagcagugcuugaugacgggaucuauaggauuaugcagcguggauuacugggucgcagccagguuggcguagggguguuccaagaaaacgucuuucauaccauguggcacgugacacggggagccguucucauguaccagggcaaaagauuggagccgaguugggcgagcgugaagaaagaccugaucuccuacggugggggauggaggcuccagggcucuuggaauaccggcgaggaaguccaggugauugcuguagagccugggaagaaccccaaaaauguccaaacaacuccaggaaccuucaagacgcccgaaggugaggugggcgccaucgcacuggauuuuaagccugggacaucgggaagcccaauaguuaaccgagaaggcaaaaucgugggucuuuaugggaauggagucgugacuaccucaggcacauacguuuccgccauugcucaggccaaggcaagucaggagggcccccugccugagaucgaagacgagguguuccggaaacgcaacuugaccauuauggaucuacacccggggucuggaaagacuagaagguaucugccagcuaucguccgggaagccauaaaacgaaagcucagaaccuuaauucuggcgcccacacgcgugguagccagcgagauggcagaagcucuuaaggguaugccuaucagguaccaaacgacugccgugaaauccgagcauaccggcaaggagaucguugaccugaugugccacgcuacauuuaccaugcgucucuugucaccaguccgggugcccaauuauaacaugauuaucauggaugaagcacauuucacugacccuucuagcauagccgccagaggguacauuaguacaagggugggaaugggcgaggcugcggcaaucuuuaugaccgccacgccgcccgguuccgucgaggcuuucccacagagcaaugccguaauucaggaugaggaacgcgacaucccugagcgaucuuggaacucaggguaugaguggauaacugauuuucccggaaaaacagugugguucguuccauccauuaagaguggcaaugacaucgcaaacugucugaggaaaaauggcaagcgggugauccagcucagcaggaagaccuuugauaccgaauaccagaaaacuaagaacaacgacugggacuacgucgugacaaccgauauuucggagaugggggccaauuuccgcgcugaccguguuaucgauccuagacggugccugaaacccgugauucuuaaggacggaccagaaagggucauacuagcggguccgaugccugugacaguagccucugcagcucagcgccgaggcagaaucgggcggaaccacaauaaagagggagaucaguauauuuacaugggccagccccugaacaaugacgaggaucaugcccacuggacugaagcaaagauguuguuagacaacaucaauacgccagaggguaucauucccgcccuguucgaaccugagagggaaaaguccgcugccauagauggggaguaucgccucagaggcgaggcgaggaaaaccuuuguggaacugaugcggcguggagaccuuccaguuuggcugagcuacaaggucgcaucagagggcuuccaauauagugaucgccgauggugcuuugacggggaaagaaacaaucaggugcucgaggaaaacauggauguggagaucuggacaaaagagggagaaaggaagaaauugcggccccgcuggcuggacgccagaacuuacucugacccucuagcucugagggaguucaaggaauuugccgcuggucggcgauccgucagcggcgaucucauucuugagaucgggaaacugccgcagcacuuaacccagagagcacaaaaugccuuggacaaccugguuaugcuccauaauucagaacagggaggccgcgcuuauaggcacgccauggaggagcugccagauacaauugaaacccuuaugcugcucgcauugaucgcggugcugacuggugggguaacguuauucuuucuaaguggccggggacugggcaagaccagcauagggcuccuuugugugauggccuccucuguccuguuguggauggcuagcguggagccccauuggaucgccgcauccauuauccuggaguucuuucucaugguucugcuuauuccugagcccgaccgucagagaacaccacaggauaaccaacucgcuuacguggucaucggacuguuguucaugauacugacuguagccgcaaaugagauggguuuacuagaaaccacaaagaaagaccugggcauugggcacguggccguuggaaaccaccaucacgcugcgaugcucgauguggaccuucauccugccucagcauggacccuguacgcugucgccacuacaaucauuacgcccaugaugaggcacaccaucgagaacacuacagccaauauaucuuugaccgcaaucgcuaaccaggccgcgauucugaugggccucgauaaggguuggccaaucaguaaaauggacauuggggugccucugcuugcuuuaggcugcuauucgcaggucaauccgcugacccucacagccgcaguguugaugcugguugcccauuacgcuaucauaggacccggccuacaagcaaaggccacucgcgaagcgcagaaacggacggcugccgggauuaugaagaacccaaccguggauggaaucguagcaaucgaccuggauccuguggucuaugacgccaaguuugagaaacagcucggccagauuaugcuucugaucuuguguacaagccaaauacugcucaugcgaacuaccugggcucugugcgaauccauuacauuagccaccgguccccuuacuacgcugugggaggggucuccaggaaaguucuggaauacaaccaucgcaguuucaauggcuaacauuuuuagaggcagcuaccucgccggugcgggccuagccuucucccugaugaaaagucuagggggaggcaggcgcgggacuggagcacagggcgagacccugggugaaaaguggaaacggcagcucaaucagcuuucuaagagcgaguucaacacauauaagagaucagggaucauggaaguggaccguuccgaggcuaaagaaggacugaagaggggcgagacuaccaaacacgccgucagucgggguacagcaaaguugcgcugguuuguggagcgaaaucugguaaaaccugaaggcaaggugauagaucucggguguggaagaggcggguggagcuacuauugcgcuggauuaaagaaaguuacggaggugaagggcuacaccaaaggugggcccggacacgaagaaccgaucccaauggccacuuacggcuggaaccuggucaaacuucauucuggcaaagacguguucuuuauuccucccgaaaagugugauacacugcuaugcgacaucggggaguccucaccaaaucccaccauugaggaaggaaggacucuccggguccugaaaaugguggagccuugguugcgcgguaaccaauucuguaucaagauucugaauccguauaugcccagcguuguagaaacacucgagcagaugcagagaaagcacggcgggaugcuugugaggaacccacugucgcgaaauucuacccaugagauguacugggucaguugcggaacgggcaacaucguguccgccguuaauaugaccagccggauguuacugaaccguuuuacaauggcgcacagaaaaccuacuuaugaacgcgauguggacuugggugcugggaccaggcacgucgcaguggagcccgaaguagccaaccucgauauaauuggacagcggaucgagaauaucaagcaugaacacaaaucaacauggcauuacgacgaggauaacccuuauaagacuugggcuuaccacggcuccuaugaggugaaaccaucuggcagcgccaguuccaugguuaauggggucgugaagcugcuaaccaagcccugggacgugauuccuauggucacacaaauagcaaugaccgauacuacgccauucggacagcagagaguuuuuaaagaaaagguggacacacgcacccccaaagccaagagggguacugcucaaaucauggagguaaccgcgaaauggcuuuggggcuuccugagccgaaacaagaagccgcggauuuguacaagagaagaguuuacgaggaaagugcgcucuaaugccgcaaucggggcugucuucguggacgaaaaccaguggaacucagccaaggaggcaguugaggaugaacguuuuugggaccucgugcaucgggagagagaacugcacaaacagggaaagugcgcaaccugcgucuacaacaugaugggcaaaagggagaagaaguugggugaguucgggaaagcuaagggaagucgcgccauuugguacauguggcugggcgcgcgauuucucgaguucgaggcacuuggcuucaugaaugaagaucacugguuuucccgggagaacagccugucugggguggaaggagaggguuuacauaaacugggcuauaucuugagagacauaucgaagaucccugggggaaauauguacgccgaugacacugcuggcugggauacaaggauuaccgaggacgaucuccagaacgaagcccgcaucacugacauuauggagccagaacacgcacugcuagcuaaaucaaucuucaaacuuacauaucaaaauaaaguaguuagagugcagcggcccgccaagaacgguaccgucauggaugugauaagcaggcgugaccagcgaggguccggacaggugggcacauacggccugaauacuuuuaccaacauggaggcucaacucauucgccagauggaaagugaggggaucuucucuccuagcgagcuggaaacgccaaacuuggccgagagagucuuagauuggcuggaaaaguauggaguugagcggcucaaaaggauggcaaucuccggugacgacugugugguaaagcccauugaugaccgcuuugcgaccgcccuuacagcucugaaugauaugggcaaagugagaaaggacauaccgcagugggaaccuucaaaaggguggaacgauuggcagcaaguccccuucugcagucaucacuuucaccagcuaaucaugaaggacggacgggagauugugguuccauguaggaaucaggaugagcuggugggccgagcccgugucucucagggugcaggguggagccucagagaaacugcuugcuugggaaaguccuacgcccaaauguggcagcugauguauuuccaucgccgggaccuuaggcuggcagccaacgcgaucuguucagcugugccuguagauuggauucccaccagcagaacaacuuggucuauccacgcccaucaccaguggaugaccacggaggacaugcucuccguuuggaaucgcguguggauagaagagaacccauggauggaagauaaaacacauaucaguagcuggggcgacguccccuacuuaggcaagcgggaggaccaauggugcgggucgcugauuggauugaccgcaagggccacuugggcuacaaauauccagguggccauuaaccagguucgaagacugaucgguaaugagaacuaccucgauuauaugaccuccaugaaacgguuuaagaaugaaucugacccugagggcgcacuuugguga

SEQ ID NO: 13948 - RNA, 9879 nt, Artificial Sequence
  derived and/or modified CDS sequence (opt3) from DENV-1__GU131780__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucaccccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacuagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucagcggccaucugaagugccguuuaaaaauggauaagcugacacuaaaagggaugucguaugugauguguacuggaucuuucaagcucgagaaggaagucgccgagacccagcacgguacggugcugguucagauuaaauacgagggcacagacgcuccuugcaagauaccauuuuccacccaggaugaaaaaggggugacucaaaacggacgccuuaucacagcgaaucccauuguaaccgacaaggagaaaccugucaacaucgaagcagagccacccuucggcgagucauauauagugauuggugccggggaaaaggcuuugaagcugaguugguuuaaaaagggcagcuccaucggaaaaauguucgaggccacugcaagaggcgccaggcggauggcuauccucggggauaccgccugggacuuuggaucuauugguggcguuuucacaagcguggggaagcugguccaucagaucuuuggaacggcauacggcgugcuuuucucagguguaaguuggaccaugaaaauugggauaggcgugcuguugacuuggcucggacugaauucccgaagcacaucuuuaucaaugaccuguaucgcgguuggccuggucacacuauaccucggggugauggugcaggcugauaguggaugcgucauuaacuggaagggccgcgaacugaagugugguagcgggaucuuuguuacuaaugaggugcacaccuggacggaacaguauaaauuccaagccgacuccccgaagagacuuucugcagccaucggaaaagcuugggaggagggcgugugcgguauuaggucggccacacgguuggaaaacauaauguggaagcagaucagcaacgagcugaaucauauucuccuggaaaacgacaugaaauuuaccguagucgugggcgauguugcagggaucuuagcucagggaaagaaaaugauucgcccucagcccauggaguacaaguauuccuggaagucauggggcaaagccaagaucauaggggcggacgugcaaaauacuaccuucaucauugauggaccaaacacaccugaaugucccgacgaucagagagccuggaauaucugggaggucgaggacuacggcuuugguauuuucacuaccaacaucuggcugaaacuuagggauaguuauacacaggugugcgaccaccguuugaugucugcugcaauaaaggauagcaaagccguucacgcugacaugggguacuggauugaauccgagaagaaugaaacguggaagcucgcccgggcaucauucaucgaggugaaaaccuguauuuggccaaagagccauacucuguggucuaacggaguacuagaauccgagaugaucauacccaaaaucuauggcgguccuauuagucagcacaauuaccgaccaggcuacuuuacacaaaccgcggggccguggcaucugggaaagcucgagcuggauuucgaccuuugcgaaggcacuacagucgugguggaugagcacugcgggaacagaggacccagcuugaggaccacgacugucaccggcaaaaucauucacgaaugguguugccgcucuuguacacugccuccauuacgguuuaagggugaggacgggugcugguauggaauggagaucagacccguuaaggaaaaagaggaaaaucucgugaaguccaugguaucagccggcaguggugagguggacagcuucucgcugggccuucuguguauauccauuaugaucgaagaggucaugaggucucgcuggagccgaaaaauguugaugaccgggacucucgcuguguuuuuccugcuaaucaugggacagcugacauggaacgaucucauucggcugugcaucaugguuggcgccaaugcaucagaccguauggggaugggaaccacauaccuugcuuugauggccacuuuuaagaugagaccuauguucgcagugggccuguuauuuaggcgccucaccagucgggagguccugcuucugacgauuggucuaucccucguggccucuguugaacugccaaacagcuuggaggaacugggggauggauuagcuaugggcauaaugauccucaaacugcuuacagacuuccagucccaucaacugugggcgaccuugcucucacugacuuuuauuaagaccacauucagccuacacuaugccuggaagacuauggcaauggugcugaguaucgucucucuuuuuccccucugucuguccaccacgagccagaaaacaaccugguugccgguacuguuaggcucgcucgggugcaagccucugacuauguuccuuauugcugagaauaaaaucuggggaagaaagucauggccacugaacgaagguauaauggccgugggcaucguuucuauuuugcucaguucccugcuaaaaaacgaugugccccuggccgggccucuuaucgcuggaggcaugcucauugcauguuacgucaucagcgguucuagcgccgaccuguccuuggagaaggcggcugaggugucaugggaagaggaagccgagcauaguggggcaagccacaauauauuaguagaagugcaggaugacggaacaaugaaaauuaaggaugaggagagggacgauacccugacuauccuccugaaggccacacuucugaccgucucuggcguuuaucccuuguccaucccagcuacgcuauucgugugguacuuuuggcagaaaaagaaacaacgaucaggcgugcugugggacacuccuagucccccaaaggucgaacgcgcagugcucgaugacgggauuuaucggauaaugcagagaggacugcuugguaggagccagguuggcguagggguguuccaggagaacgucuuucauaccauguggcacgugacacguggagccguuuuaauguaccaaggcaaacgccuggaaccguccugggcgucugugaagaaggaccucaucucguacggugggggauggcgguugcagggcagcuggaauaccggcgaggagguccaggugauugcuguagaaccugggaaaaaccccaagaauguccagacagccccaggaacuuucaaaaccucagagggugaagugggcgcaaucgcccuggauuuuaagcccgggacguccggaaguccuauuguuaacagagagggcaaaaucgugggucucuaugggaauggagucgugacaacuucuggcaccuacguuagcgcuauagcccaagcaaaggcuucccaggaaggcccacugcccgagaucgaggacgaaguguucaggaagcgaaaccuuacaauuauggaucugcacccugggucaggaaaaacccggcgcuauuugccggccaucgucagagaggcgauuaagaggaaacuacggacucugauccucgccccaacccgagugguagcaucugaaauggcugaggccuuaaaggguaugcccauaagauaccagacaacggcugugaaaagcgaacauacuggcaaggagauuguugaccugaugugccacgcaaccuuuacaaugcgccuucugaguccugucagggugccaaauuauaacaugaucaucauggaugaggcccauuucaccgaccccuccagcauugccgcucguggguacaucucuacucgggugggaaugggcgaagcggcagccauauuuaugacagcuaccccuccggguucagucgaggccuucccccaauccaaugcaguaauucaggaugaagagagagacaucccagaaaggaguuggaacagcggguaugaguggauuacggauuuuccuggaaagacugugugguucguucccucgaucaaaucuggcaaugacauagccaacugucuccgcaagaauggcaaacgagugauucaguuguccagaaagacauucgauaccgaguaccagaaaaccaagaacaacgacugggacuacgucgugacuacagauaucagcgaaaugggggcuaauuuucgggcggacaggguuaucgauccacgccguugccugaagccugugauucucaaagacggacccgagagagucauccuggccgguccaaugccggugaccguagcaucagcugcccaacggaggggccgcauugggcgaaaccacaauaaggaaggagaucaguauauauacaugggccagccucuuaacaaugacgaggaucaugcacacuggacagaggccaaaaugcuacuggacaacaucaauacucccgaagguauuaucccagcuuuguucgagcccgaaagagagaagagugccgcgaucgauggggaauaucgguuaaggggcgaggcacgcaaaacguuuguggagcugaugagaaggggagaccucccuguuuggcugucuuacaaggucgccuccgaaggcuuccaguauagcgaucggcguuggugcuuugacggggagcgcaacaaucaagugcuugaagagaacauggauguggaaauuuggaccaaagagggagagcgaaagaagcugagaccaagguggcucgacgcucggacauacucagaccccuuggcccugcgcgaauucaaagaguuugcugcagguagaaggagugucagcggcgaucuaauacuggaaaucgggaagcucccucagcaccuuacucagcgggcccagaaugcucuggacaacuuaguuauguugcauaauuccgagcaaggaggccgagccuauagacacgcaauggaagagcugccggauaccauugagacaaugaugcuccuggcgcuuaucgccgugcugaccggugggguaacucucuucuuuuugucuggccgcggacugggcaaaacgagcauuggguuacuaugugugauggcuuccucaguccugcucuggauggccucuguggaaccacauuggaucgcagcuaguauaauccuugaguucuuucugaugguuuugcugauucccgaaccugacaggcagcggaccccccaggauaaccagcucgccuacguggucaucggacugcuuuucaugauucucacaguagcagccaaugagaugggucuguuggagacuaccaagaaagaccugggcaucgggcacguggcuguugaaaaccaccaucacgcggccauguuagauguggaccuacauccagcaucggcuuggacacuguacgccgucgccaccacuauaauuacaccuaugaugcgucacacgaucgagaacaccacugcaaauauuagccucacagcuaucgccaaccaagcggcuauacuuaugggacuggauaagggcuggcccaucuccaagauggacauuggugugccauugcuggcccucgggugcuauucucaggucaauccucugacccuuaccgcagccguguuaaugcugguugcucauuacgcaaucauuggcccgggacuccaggccaaagcgacaagagaagcucaaaagaggacugccgcaggcaucaugaaaaaccccacgguggaugggauaguagccauugacuuggauccaguggucuaugacgcuaaguuugagaaacagcugggacagaucaugcuacugauccucuguaccucacagauucuucugaugcgcacaacuugggccuugugcgaaagcaucacccuggcaacaggcccucucaccacucugugggaggguucccccgggaaguucuggaauacgacaauagcuguuaguauggccaacauuuuccggggaucuuacuuagcgggcgccggucuugcauuuagccugaugaagucacucggcgggggacgaagaggcaccggggcucaaggagagacucuaggcgaaaaauggaagaggcagcugaaucaguuguccaaaagugaguucaacaccuauaagcgcagcgguaucauggaaguggaccggucugaggccaaagaagggcugaagagaggagagacaacuaagcacgcagucucccguggcaccgcuaaacucaggugguuuguggagcggaaucuuguaaagccagaagguaaagugauugaucugggcugugggcgcggaggcuggucauacuauugcgccggguugaagaaaguuacagaggugaagggauacacgaaaggcgguccugggcacgaagagcccaucccgauggccaccuacggauggaaccuggucaagcuccauagcggcaaggacguguucuuuauaccaccugaaaaaugugauacuuuacugugcgacaucggcgagucgucucccaauccaacaauugaggaagggcgaacccuuagaguccugaagaugguggagcccuggcuaaggggaaaccaguucuguaucaaaauucucaauccuuauaugccgaguguuguagaaacucuggagcaaaugcagcggaagcacgguggcauguuggugcgcaacccccuguccagaaauagcacacaugagauguacugggucucaugcgggaccggaaacaucguguccgcgguuaauaugacgucuaggaugcuccuuaaccgauuuaccauggcucaccggaaaccaacauaugaacgugauguggaccugggcgcagguacuagacacgucgccguggagccugaaguagcuaacuuagauauuaucgggcagcgcauagagaauauuaagcaugaacacaagagcaccuggcauuacgacgaggauaaccccuauaaaacaugggccuaccacggaaguuaugaggugaagccuuccggcagcgcaucuucaaugguuaauggcgucgugaaacuguugacuaagccaugggacgugauccccauggucacccagaucgccaugacagauaccacuccuuucgggcaacagaggguuuuuaaagaaaagguggacacgcggacaccaaaggcuaaaagaggaaccgcgcagauuauggagguaacugccaaguggcucugggguuuccugagucgcaacaaaaagcccaggauauguacccgagaagaguuuacacggaaagugagauccaaugcagcuaucggcgccgucuucguggacgaaaaccaauggaauagcgcaaaggaggccguugaggaugaaagguuuugggaccuagugcaucgcgagcgugaacuucacaagcaggggaaaugcgcuacgugcgucuacaacaugaugggaaagcgggagaaaaagcugggcgaauucgguaaagccaaggggucuagagcgauuugguacauguggcucggagcaagguuccuggaguuugaggccuugggcuucaugaaugaagaucacugguuuucgcgcgagaacucacugagcggcguggaaggggagggacuccauaaacuugguuauauccugcgagacauuuccaagaucccgggcgggaauauguacgcugaugacaccgccggaugggauacucggauaacagaggacgauuuacagaacgaagcaaagaucaccgacauuauggagccugaacacgcucuguuggccaaaaguaucuucaagcucacuuaucagaauaaaguaguuagagugcaaaggccagcuaagaacggcacagucauggaugugauuucucgcagagaccagcgggguagcgggcaggugggaaccuacggccugaauacauuuacuaacauggaggcccagcuaaucaggcaaauggaauccgagggcauauucucacccagugagcuugaaaccccuaaccuggcacgucgaguccucgauuggcuggagaaacaugggguugaacgcuugaagagaauggcgauuucuggagacgacugugugguaaagccaaucgaugaccgguuugccacggcuuuaaccgcccugaaugauauggguaaagugaggaaggacaucccccagugggagccgagcaaaggcuggaacgauuggcagcaggucccuuucugcucccaccacuuucaucaacucauuaugaaggacgggcgcgaaauagugguucccuguagaaaucaggaugagcuugugggacgggcaagggucucacagggcgcugguuggagccugcgagagacagccugccuagggaaaucuuaugcacagauguggcaacugauguacuuccaccguagagaccuccgcuuggccgcgaacgcuaucuguuccgccgugccaguagauuggguuccuacuagucggaccacauggagcauucaugcacaccaucaguggaugacuaccgaagacaugcugucgguguggaauagggucuggaucgaggaaaaccccuggauggaggauaagacgcacauuuccucuuggggagacgugccauaucuuggcaagagagaagaccaguggugcggcucacugaucgggcucacagcccgcgcuaccugggccacuaauauacaaguugcaaucaaccaggugcggagguuaauuggaaaugagaacuaccuggauuacaugacaagcaugaaacgauuuaagaaugagagugaccccgaaggugcuuugugguga

SEQ ID NO: 13949 - RNA, 9879 nt, Artificial Sequence
  derived and/or modified CDS sequence (opt3) from DENV-1__GU131781__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagauaagccugucaacauagaggccgaaccacccuucggcgaguccuauauugugaucggugcuggggagaaagccuugaagcugucaugguuuaagaaaggcaguagcaucggaaagauguucgaagcaaccgccagaggcgcuaggcggauggccauucucggggacacugcaugggauuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgacucaggaugcgucguuaacuggaaaggccgcgagcugaagugugguagugggaucuuugugacaaaugaagugcacacuuggaccgagcaauauaaguuccaggcagacagcccgaaaagacuuuccgccgcuaucggaaaggccugggaagagggcguaugcgguauuaggucugcaacgcgguuggagaacauaauguggaaacagaucucgaacgaacugaaucauauucuccuggagaacgauaugaaguuuacagucgugguuggcgacguggcugggaucuuagcccagggaaaaaagaugauucgcccucaacccauggaauacaaauauagcuggaaguccuggggcaaggcgaaaaucauaggggccgauguccagaauaccacuuucaucauugacggaccaaacaccccugagugucccgaugaccagagagcuuggaauaucugggaaguggaggauuacggcuuugguauuuucacaacuaacaucuggcugaagcuuagggacucauauacccagguuugcgaucaccguuugaugagugcagccauaaaagacucuaaggcugugcacgccgauaugggguacuggauugagagcgaaaaaaaugagacauggaagcucgcacgggcguccuucaucgaaguaaagacguguauuuggccaaaaucacauacccuguggagcaacggaguccuagagucugaaaugaucauacccaagaucuauggcgguccuauuucccaacacaauuaccgaccaggcuacuuuacucagacagccgggccguggcaucugggaaaacucgagcuggacuucgaucuuugcgagggcaccacugugguggucgacgaacacugcgggaacagaggacccaguuugaggacaaccacgguuacuggcaagaucauucacgagugguguugccgcagcuguacccugccuccauuacgguuuaaaggugaagacgggugcugguauggaauggagaucagacccgugaaggagaaggaagagaaucucguaaaaucuaugguguccgcuggcucaggugaagucgauaguuucagccugggccuucuguguauaucgauuaugaucgaggaagugaugaggucccgcuggucucgaaagauguugaugacagggacccucgccguuuuuuuccugcuaaucaugggacagcugacuuggaacgaccucauucggcugugcaucauggugggcgcaaaugcuagcgaucguauggggaugggaacaaccuaccuugccuugauggcaacauuuaaaaugagaccuauguucgccgucggccuguuauuuaggcgccucacuucacgggaggugcugcuucugaccauuggucuaagucucguugcuuccguggagcugccaaacucuuuggaagagcugggggacggauuagcgaugggcauaaugauccucaagcugcuuacggauuuccaaagccaucagcugugggccacauugcucucccugaccuuuauuaaaacuaccuucucacuacacuaugcauggaagacaauggcuaugguccugagcaucguaagucuuuuuccccucuguaugucuacuaccucccagaagacgacauggcugccgguguugcugggcagcuuagggugcaaaccucucaccauguuccugauugccgaaaauaagaucuggggaagaaaaucguggccacuuaacgaggguauaauggccguuggcaucgugucaauucuguugucuagucuccugaagaacgacgucccccuagcugggccucugaucgcaggaggcaugcuuauugccuguuacgugaucuccgguagcucugcggaucucagccuggaaaaagcugccgagguauccugggaggaagaggcagaacauucaggggccagucacaauauauugguggagguccaggacgauggaacuaugaagauuaaagacgaagagagggaugacacauuaaccauccugcucaaggcuacucugcuugcaguuagcggcguguauccccugucuaucccagccacauuguucgugugguacuuuuggcaaaagaaaaagcagcgauccggcguccuaugggauaccccuucacccccagagguggaacgcgcgguucuggacgacgggauuuaucggauaaugcagagaggacuccuggguaggagucagguaggcgugggggucuuccaagagaacguguuucauacgauguggcacguuacucguggagcugugcuuauguaccagggcaaacgcuuagaaccgagcugggccuccgucaagaaagaucugaucucuuacggugggggauggcggcuccagggcucguggaauaccggcgaggaggugcagguaauugcagucgaaccugggaagaaccccaagaaugugcaaacagccccaggaaccuucaaaacaagcgagggugaaguuggcgcuaucgccuuggacuuuaagcccgggacuucaggauccccuauugugaacagagagggcaaaaucgucggucuguaugggaauggagugguuaccacgaguggcacauacgugucugcaauagcucaggccaaggcgagccaggaaggcccacuccccgagaucgaggaugaagucuucaggaaacgaaaccugacuauuauggaccuucacccuggguccggaaagacccggcgcuaucugccggccaucgugagagaggcaauuaagaggaaauugcggacacuaauccuggcuccaacccgaguaguggccucagaaauggcugaggcacucaaggguaugcccauaagauaccaaacuaccgccguuaaaucugaacauacaggcaaggagauugucgauuuaaugugccacgccacguuuacuaugcgccugcuuagcccugugagggugccaaauuauaacaugaucaucauggacgaggcucauuucaccgaucccaguuccauugcggcacguggguacaucagcacacgggucggaaugggcgaagccgcugccauauuuaugaccgcaacuccuccggguucuguagaggccuucccccagucaaaugcugugauucaggacgaagagagagauaucccagaaagguccuggaacaguggguaugaguggauuacagacuuuccuggaaaaaccguuugguucgugcccagcaucaagucgggcaaugauauagcgaacugucugcgcaagaauggcaaacgagucauucagcucucuagaaagacguucgacacugaguaccaaaaaacaaagaacaacgacugggauuacgugguuaccaccgacaucuccgaaaugggggccaauuuucgggcagauagggugaucgacccacgccguugcuugaaaccugucauucugaaggauggacccgagagagugauccucgcugguccaaugccgguaacuguggccagcgcagcccagcggaggggccgcauugggcgaaaccacaauaaggaaggagaccaguauguuuacaugggccagccucugaacaaugaugaggaccaugcucacuggacagaggccaaaaugcuucuagauaacauaaauacccccgaagguaucauuccagcgcuguucgagcccgaaagagagaagucagcagccaucgacggggaauaucgguugaggggcgaggcucgcaaaacauuugucgaguuaaugagaaggggagaucugccuguguggcucaguuacaagguggccucugaaggcuuccaauauuccgaccggcguuggugcuuugauggggagcgcaacaaucagguccuggaagagaacauggacguugaaaucuggacuaaagagggagagcgaaagaaacuuagaccaagguggcuggacgcucggacguacagcgauccccucgcauugcgcgaauucaaggaguuugccgcugguagaaggucagugaguggcgaccugauucuagaaauagggaagcugccucagcaccucacccagcgggcccaaaaugcacuugauaaccugguaauguuacauaauagcgagcagggaggccgagcguauagacacgccauggaagaguugccggacacaaucgagacucugaugcuccuggcucuuauugccgugcugaccgguggggucacacucuucuuuuuguccggccgcggacugggcaaaaccucuaucggguuacuaugugugauggcaagcuccguucugcucuggauggcuucaguggaaccacauuggauugccgcaucuaucauacuugaguucuuucugauggucuugcugauccccgaaccugauaggcagcggacuccccaggacaaccaacucgccuacguagugauuggacugcuuuucaugauccucacgguugcugcgaaugagaugggucuguuggagaccacaaagaaagaucugggcauugggcacguggccgucgaaaaccaccaucacgcagcuauguuagacguggaucuacauccagccagugccuggacucuguacgcagucgcuaccacaaucauaaccccuaugaugcgucacacuauugagaacacaacggccaauaucucgcucaccgcgauugcuaaccaggccgcaauccuuaugggacuggacaagggcuggcccauaagcaaaauggauaucggugugccauugcuggcccucgggugcuauucccagguuaauccucugacucuuacagcugcaguguuaaugcugguagcccauuacgcgauuaucggcccgggacuccaagcuaaggccaccagagaagcacagaagaggaccgccgcuggcauuaugaaaaaccccacaguggacgggaucgucgccauagauuuggacccaguuguguaugacgcaaaguuugagaaacagcugggacagauuaugcuacugauccucuguacuucucaaauccuucugaugcgcacgaccugggcuuugugcgaaucaauuacacuggccacuggcccucucaccacacugugggaggguagccccgggaaguucuggaauaccacuaucgcggucuccauggccaacauauuccggggaaguuacuuagcaggcgcuggucuugccuuuucucugaugaaaagccucggcgggggacgaagaggcacgggggcacagggagagacacuaggcgaaaaguggaagaggcagcugaaucaguugucaaaauccgaguucaacaccuauaagcgcagugguauuauggaaguggaucggagcgaggcuaaagaagggcugaagagaggagagacuaccaaacacgccguaucucguggcacagccaagcucaggugguuuguggagcggaaucuuguuaagccagaagguaaagugaucgaccugggcugugggcgcggaggcugguccuacuauugcgcgggguugaagaaagucacugaggugaagggauacaccaaaggcgguccugggcacgaagagcccauuccgauggcuacauacggauggaaccuggucaagcuccauucaggcaaagauguguucuuuaucccaccugaaaagugugacacguuacugugcgauauaggcgagagcucgcccaauccaaccaucgaggaagggcgaacucuuagaguucugaagaugguagagcccuggcuaaggggaaaccaauucuguauuaaaauccucaauccuuauaugccgucuguggucgaaacacuggagcagaugcagcggaagcacgguggcauguuggugcgcaacccccugaguagaaauuccacccaugagauguacuggguuagcugcgggacuggaaacauugugucagcagucaauaugacauccaggaugcuccuuaaccgauuuaccauggcccaccggaaaccaacguaugaacgugacguggaucugggcgcugguaccagacacguagccguggagccugaaguugcaaacuuagacaucauugggcagcgcaucgagaauauaaagcaugaacacaaaucuacauggcauuacgaugaggacaaccccuauaagacuugggccuaccacggaagcuaugaggucaagccuaguggcuccgcuagcucuauggugaauggcguggucaaacuguugaccaagccaugggauguuauucccauggugacacaaaucgcgaugacugacaccacaccuuucgggcagcagaggguauuuaaagaaaagguggacacccggacuccaaaagccaagagaggaacggcacaaaucauggaggucacagcuaaguggcucugggguuuccugucacgcaacaaaaagcccaggauuuguacccgagaagaguuuacucggaaagugagaaguaaugccgcaauaggcgccguuuucguggaugaaaaccaguggaauuccgcuaaggaggccgucgaggacgaaagguuuugggaucuagugcaucgcgagcgugaacuucacaaacaggggaagugcgcgaccugcguauacaacaugaugggaaagcgggagaaaaagcugggcgaauucgguaaagcaaaggggagcagagccaucugguacauguggcucggagcuagguuccuggaguuugaggccuugggcuucaugaaugaagaccacugguuuucucgcgagaacucgcugucaggcguugaaggggagggacuccauaaacuugguuauauucugcgagauaucagcaagauuccgggcgggaauauguacgcagacgauacagcuggaugggacacgcggaucaccgaggaugacuuacagaacgaagccaaaauaacugauaucauggagccugaacacgcucuguuggccagauccauuuucaagcucacauaucaaaauaagguggucagggugcagcgcccagcaaaaaacggcaccgugauggacgucaucaguagacgggaucagagggguucugggcagguuggaacuuacggccugaauacauuuaccaacauggaggcgcaacuaauucgucagauggaaagcgagggcaucuucucccccucagagcuugaaacaccuaaccuggccgggcgagugcucgacuggcuggagaagcauggaguagaacgcuugaaaagaauggcuauaaguggugacgauuguguggucaagccaauugacgaucgguuugccacugcauuaaccgcucugaaugacaugggcaaagugaggaaggauaucccccagugggagccgucuaagggguggaacgacuggcagcaaguuccuuucugcagccaccacuuucaucagcucaucaugaaagauggacgcgaaauugugguccccuguagaaaucaggacgagcuugugggccgggccaggguaucccagggugcaggguggucacugcgagagacggccugccuaggaaagagcuaugcgcaaauguggcagcugauguacuuccaccguagagaucuccgcuuggcugccaacgcaauauguucugccguuccaguggacugggucccuaccucccggacaacuuggaguauccaugcucaccaucaguggaugaccacagaagauaugcugagcguguggaauaggguuuggauugaggaaaaccccuggauggaggacaaaacucacaucucguccuggggcgacgugccauaucuuggcaagagagaagaucaauggugcgggucucugauuggacucaccgcccgcgcaacgugggcuacaaauauccaggucgccauaaaccaggugcggagguuaaucgguaaugagaacuaccuggacuacaugaccucaaugaaacgauuuaagaaugagagcgaucccgaaggcgcguugugguga

SEQ ID NO: 13950 - RNA, 9879 nt, Artificial Sequence
  derived and/or modified CDS sequence (opt3) from DENV-1__GU131782__SS-prME
agcgugaccaugcugcucaugcuuaugcccacagcacuggcuuuccacuugacuacgagaggaggggaaccucauaugaucgucaccaagcaggaaaggggaaaauccuuacuguuuaagacaucugccgguguuaacaugugcacucuaauugcaauggaccucggagaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggccagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggccuuggugagguggacuccuuuucacugggcuugcucuguauuaguaucaugaucgaagaggucaugaggagccgcuggucgcgaaagaugcugauggcugggacccuagccguguuccugcuccugauuaugggacagcuuacuuggaacgauuugauccggcugugcauuaugguuggcgcaaaugcuuccgaccguauggggaugggaacaaccuauuuagcccucauggcaacauuuaaaaugagaccuauguucgccgugggccugcuuuuuaggcgccugacuucucgggagguccuacuccugaccauagguuugagccugguggcuucaguugaauuaccaaacagucucgaggaacugggggauggacuugcgaugggcaucaugauucugaaguugcucacggacuuccaaccccaccagcugugggccacacuacugucccuuaccuuuaucaaaacuacccucucucugcauuacgcauggaagacaauggcuaugguguugagcauugucucccuguucccguuaugucucucaacuaccagccagaagacgacauggcugccuguacuucugggcaguuuggggugcaaaccacucaccauguuucugaucgccgagaauaagauauggggaagaaaaucuuggccccuaaacgaagguaucauggccgugggcguuguguccauucugcuuagcucgcuccugaagaacgaugucccuuuggcugggcccuuaaucgcaggaggcaugcugauugccuguuaugugaucucagguucuagugcggaccucucccuggagaaagcugccgagguaagcugggaagaggaagcagagcacucuggggccagccauaauauacuuguggaaguccaggaugacggaacuaugaagauuaaagaugaggagagggacgauacacugaccaucuugcuaaaggcuacucugcucgcaaucuccggcguuuacccacugucaauuccugccacacuuuucgugugguauuuuuggcaaaagaaaaagcagcgaaguggcguguuaugggacacccccagcccaccggaagucgagcgcgcggugcuggaugacgggauauaccggaucaugcagagaggacucuuggguaggucucagguuggcguagggguguuccaagaaaacgucuuccacacgauguggcacgugacucguggagcuguucugauguaucagggcaaacgccucgagccuuccugggccucagugaagaaagaccugauuaguuacggugggggauggcggcuucagggcagcuggaauaccggcgaggaaguccaggugaucgcaguagagcccgggaagaacccaaagaauguccaaacagcccccggaaccuuuaaaacaccugaaggugaggugggcgcuauugcccuggauuucaagccagggacuuccggaucucccaucguuaacagagaaggcaaaauaguggguuuguacgggaauggagucgugaccacgucgggcacauauguuagcgcaaucgcucaggccaaggcgucacaggagggcccucuaccggagauugaagacgagguguuuaggaaacgaaaccugacuaucauggaucuccauccaggguccggaaagacccggcgcuacuuacccgccauugucagagaagcaaucaagaggaaacugcggacacuuauacuggcuccuacccgagugguagccagugagauggcugaagcacucaaggguaugccaauuagauaucaaacuaccgccgugaaaucugagcacacaggcaaggagaucguugacuugaugugccaugccacguucacuaugcgccugcucagccccgucagggugccuaauuacaacaugaucauuauggaugaagcucacuuuaccgacccguccucaaucgcggcacguggguauauaucuacacgggugggaaugggcgaggccgcugccauuuucaugaccgcaacucccccagguagcgucgaagccuuuccucagaguaaugcuguaauccaggaugaggaaagagacauucccgagagguccuggaacagcggguacgaguggaucacagauuucccaggaaaaaccgugugguuuguuccuucuauaaagucaggcaaugacauugcgaacugucugcgcaagaauggcaaacgagugauccagcuuuccagaaagacguucgauacugaauaucagaaaaccaagaacaacgacugggacuacgucgugaccaccgauaucagugagaugggggccaauuuucgggcagacaggguuauugauccccgccguugccuaaaaccagugauccugaaggacggaccggaaagagucauuuuggcugguccuaugcccgugacuguagccagcgcagcccagcggaggggccgcauagggcgaaaccauaauaaggagggagaucaguacaucuauaugggccagccauuaaacaaugacgaggaucacgcucacuggacagaagccaaaaugcugcucgacaacauuaauacccccgaggguaucaucccugcgcuguucgaaccagagagagaaaagucggcagccauugauggggaguaccggcuuaggggcgaggcucgcaaaacauucguggaacugaugagaaggggagaccuccccguuugguugucuuauaaggucgccuccgagggcuuucaauacagcgaucggcguuggugcuucgacggggaacgcaacaaucaggugcuggaggaaaacauggauguggagauauggacuaaagagggagaacgaaagaaacuaagaccuagguggcuggacgcucggacguauucagacccgcucgcacuucgcgaguuuaaggaguucgccgcugguagaaggagugucucuggcgaucugaucuuagagauugggaaguugccacagcaucugacccagcgggcccaaaaugcacucgacaaccugguuaugcuucacaauuccgaacagggaggccgagcguacagacaugccauggaggagcugcccgauacaaucgaaacucucauguugcuggcuuuaauugccgugcuaaccggugggguaacacuguuuuuccucagcggccgcggacuuggcaaaaccucaaucgggcuguugugugugauggcaaguagcguccugcucuggauggcuuccguggagccucacuggauagccgcaucuaucauucuggaauuuuuccuuaugguucuccugauccccgagccagacaggcagcggacuccucaggauaaccaauuggccuauguggucauuggacuguuauuuaugauccuaacgguagcugcgaaugagaugggucugcucgaaaccacaaagaaagaccuuggcauagggcacguggccguugagaaccaucaccaugcaacuaugcuggauguggacuugcaccccgcuagcgccuggacccuguacgccgucgcaacaaccauuaucacuccaaugaugcgucauacaauugaaaacacgaccgcuaauaucucccucacugccauagcgaaccaggcugccauccugaugggacuugauaagggcuggccuauuucaaaaauggacaucggugugccguuacuggcacucgggugcuacucucaggucaaucccuugacacugaccgccgcugugcuaaugcugguugcacacuaugccauuaucggcccaggacuccaagcgaaggcuaccagagaggcccagaagaggacagcagccggcauaaugaaaaacccuacuguggaugggauuguagcuaucgaccuugaucccguggucuacgacgccaaguucgaaaaacagcugggacagaucauguugcugauucucuguacgagucaaauccuguuaaugcgcaccacaugggcacuuugcgagucgauaacucuggcuaccggcccacucacaacccuaugggaggguagcccugggaaguuuuggaauacuacgauugccguuuccauggcgaacaucuuccggggaucuuaucuggccggcgcagguuuggcuuuuucacugaugaaaagccucggcgggggacgaagaggcacaggggcccagggagaaacccuuggcgagaaguggaagaggcagcugaaucaguuguccaaaagugaguucaacauuuacaagcgcucugguaucauggagguggaccggagcgaagcaaaagaggggcugaagagaggagagacuacccgucacgcugucucaaggggcacagccaaacuccggugguucguggaacgcaauuuaguaaagcccgaggguaaggugauagaucugggcugugggcgaggaggcugguccuauuacugcgccgggcuuaaaaagguuacugaagugaaaggauauaccaagggcgguccggggcaugaggaaccaaucccuauggcgacauacggauggaaccuggucaaacuacacaguggcaaggacguguuuuucacgcccccagagagaugugauacccuccugugcgacauuggcgagagcucucccaauccuacuaucgaagaggggaggacauugcggguccugaaaaugguggaaccguggcuccgcggaaaccaauuuuguauuaagauccuuaaucccuacaugccauccguuguagagacccuggagcagaugcagagaaagcaugguggcauguuagugaggaacccucugucacgaaauagcacucacgaaauguauugggucucgugcgggacaggaaacauugugucugcuguuaauaugaccagucggauguugcucaaccguuucacgauggcacacagaaaacccaccuacgagcgcgauguggaccugggcgccgguacaaggcaugucgcuguggaaccugagguagccaaccuagauaucauagggcagcggauugaaaauaucaagcacgagcauaaauccacuuggcacuaugacgaggauaacccauacaagaccugggcauaucauggaagcuacgaagugaaacccucaggcuccgccucuagcaugguuaauggcgucgugaaacuucugacaaagccuugggacgugaucccaauggucacucaaauugcuaugaccgauacaacccccuuugggcagcagagaguuuucaaagagaagguggacacucgcacgccgaaagcgaagaggggaacagcccaaauaauggaaguaaccgcacgauggcucugggguuuucugagucggaacaaaaagccuagaaucuguacuagggaggaguucacccgcaaggugcguuccaaugcugccauuggcgcagucuuuguggacgagaaccaguggaauagcgccaaagaggcuguugaagaugagcgguucugggacuuggugcagaaggaaagagagcugcacaaacaggggaagugcgccacaugcgucuauaacaugaugggaaaaagggaaaagaagcucggcgaguuugguaaagcgaaggggucucgcgcaaucugguacauguggcuuggagcccgauuccuggaguuugaggcuuuaggcuucaugaaugaggaucacugguucucacgggaaaacagucuguccggcguggagggggagggauugcauaaacucgguuacauucugagagacaucagcaagauaccaggcgggaauauguaugccgaugacacggcaggaugggauaccaggaucacugaagacgaucuacaaaacgaggcuaaaauuacagacaucauggaacccgagcacgcccuucuggcuaccucuauuuuuaagcucacuuaccagaauaaaguaguucgcgugcagagaccugccaagaacggcacagucauggaugugaucucgcggagggaccagcgugguucagggcaagugggaaccuauggccugaauacauucacuaacauggaagcacaguugauacgacagauggagagcgagggcauauuuuuaccauccgaacuggagacccccaaccucgcggaacgcguccuugauuggcuggagaagcaugggguugaaagacuaaaacggauggccaucaguggagacgacugugugguaaagccgaucgaugacagguucgcuacggcccugaccgcacucaaugauauggguaaagugcgcaaggacauuccucagugggagcccucuaaaggcuggaacgauuggcaacaggucccauuuugcagccaccacuuccaucaguugauaaugaaggacgggagagagaucgugguuccuugucggaaucaggaugaacuggugggaagggcucgagucucccaaggcgccgguuggucacuucgugagacagcaugccuggggaagaguuacgcccagauguggcagcucauguauuuucacagacgcgacuuacggcuggcggcuaacgccauuuguucugcagugcccguagauuggguuccaacuagcaggaccacaugguccauccaugcccaccaucaauggaugacuaccgaagacauguugucaguguggaauagagucuggauugaggaaaaccccuggauggaggauaaaacgcacgugagcucuuggggagacguuccuuaccugggcaagcgcgaggaccaguggugcggcucccucaucgggcuuacagcucgggccaccugggcaaguaauauacagguggcuaucaaccaggucaggcgacugauuggaaaugaaaacuaucuagauuacaugacuagcaugaaaagauucaagaaugagggugacccagaaggcgcccugugguga

SEQ ID NO: 13951 - RNA, 9879 nt, Artificial Sequence
  derived and/or modified CDS sequence (opt3) from DENV-1__GU131784__SS-prME
agcgugaccaugcugcuaaugcuuaugcccaccgcacuggcuuuccacuugacuacgagaggcggggaaccucauaugaucgucuccaagcaggaaagggggaagucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucagacgggggagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacaccaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuaugucaucuccgguagcucugcggaccugagcuuggagaaggcugccgagguguccugggaagaggaagcagagcacucaggggccagucauaauauauuaguagaagugcaggaugacggaacaaugaaaauuaaggaugaggagagggacgauacccugacuauccuccugaaggcuacacuucuggcagucagcggcguuuaccccuugucuaucccagccacccuauucgugugguauuuuuggcagaaaaagaaacaacgauccggcgugcugugggacacgccuucacccccagaagucgagcgcgcggugcucgaugacgggauuuaccggauaaugcagagaggacugcuugguaggagucagguuggcguagggguguuccaggaaaacgucuuucacacuauguggcacgugacccguggagcuguuuuaauguaucaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuacgggaauggagucgugacgacaaguggcacuuauguuucugcaauagcucaagccaaagcgagccaggagggcccacugcccgagaucgaagacgagguguucaggaagcgaaaccuuaccauuauggaucugcauccuggguccggaaagacacggcgcuacuugccggccaucgucagagaagcaauuaaaaggaagcuacggacccugauccucgcuccaacucgagugguagccucagagauggcugaagcauuaaaagguaugcccauaagauaucagaccacagccgugaagucugagcacacgggcaaagagauuguugaccugaugugccaugccacuuuuaccaugcgccuucugagcccugucagggugccaaauuacaacaugaucaucauggaugaagcucacuucacagaccccaguuccauugcggcacguggguauaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguacgaguggauuaccgauuuuccuggaaagacggugugguucguucccagcaucaagucgggcaaugacauagcgaacugucuccgcaaaaauggcaagcgagugauucaguugucuagaaaaacuuucgauacagaauaucagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccauaauaaagagggagaucaguacauauauaugggccagccucuuaacaaugacgaggaucacgcucacuggaccgaagccaagaugcuacuggacaacaucaauacacccgaggguauuaucccagcguuguucgaacccgagagagaaaaaucagcagccaucgauggggaguaccgguuaaggggcgaggcucgcaagacuuuuguggaacugaugagaaggggagaccucccuguuuggcugaguuauaaagucgccucugagggcuuccaguacuccgaucggcguuggugcuuugacggggaacgcaacaaucaagugcuugaggaaaacauggauguggagauuuggacgaaggagggagaacgaaagaaacugagaccaagguggcucgacgcucggaccuauagcgaccccuuggcacugcgcgaguucaaagaauuugccgcugguagaaggucagucaguggcgaucuaauacuggagaucgggaaacucccucagcaucuuacacagcgggcccagaaugcacuggacaacuuaguuauguugcacaauagcgaacaaggaggccgagcguacagacaugccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacacuggaucgccgcaucuauaauccuggaguucuuuuugaugguucugcucauucccgagccugacaggcagcggacgccccaggauaaccagcuggccuauguggucaucggacuucucuucaugauucugaccguagcugcgaaugagauggguuugcuggaaacaacuaaaaaggacuuaggcaucgggcacgccgcaguggagaaccaucaccaugcugccaugcuagauguugaccugcacccagccagugcauggacccucuacgcuguggccacaaccauaauuacuccuaugaugcgucauacaaucgaaaacacgaccgcgaauauuucgcuuacugcuaucgccaaccaagcagccauacugaugggauuggauaaaggcuggcccaucagcaagauggacauuggugucccacugcucgcucuggggugcuacucccaggugaauccucuuacauuaaccgcagccguccugaugcucguggcgcacuaugcuaucauuggcccgggauugcaggccaaggcaaccagagaggcccagaagaggacagcugccggcaucaugaagaaccccacuguugaugggauaguggcaauugaccuggauccaguaguguacgacgcuaaauuugaaaagcagcuaggacagaucaugcugcucauccuuuguacgucucagauucuguugaugcgcaccacaugggcccugugcgagucaaucacucucgcgaccggcccucugacaaccuuaugggaggguagccccgggaaauucuggaauacuacgauagccgucuccauggcaaacauuuuccggggaaguuaucuugcuggcgccggucuggcauuuucucucaugaaaagccuaggcgggggacgaagaggcacaggggcucaaggagaaacccugggcgagaaguggaaaaggcaguugaaucagcugucaaaguccgaguucaacacuuacaaacgcagugguaucauggagguugaccggagcgaagccaaggaggggcucaaaagaggagagaccacaaagcacgccgugucucguggcacugcgaaacuuaggugguuugucgaacggaaucuggugaaaccagaggguaagguaauugauuugggcugugggcgcggaggcugguccuauuacugcgcugggcugaaaaaggugaccgaaguuaaaggauauacaaagggcgguccugggcaugaggaacccaucccgauggcaacguacggauggaaccucgugaaauuacacucaggcaaggacgucuucuuuauaccaccugagaagugugauacccugcuuugcgacaucggcgagagcucgcccaauccaacuauugaagaggggcgaacacugagagugcuaaaaauggucgaacccuggcucaggggaaaccaguucuguaucaagauucugaauccuuacaugccgucugugguugagaccuuggagcaaaugcagcggaaacaugguggcaugcugguacgcaacccccucaguagaaauuccacucacgaaauguauugggugagcugcgggacaggaaacaucgucucagccgugaauaugaccuccaggaugcuucugaaccgauuuacgauggcucaccggaagccaaccuacgagcgugauguugacuuaggcgccgguacaagacauguggcagucgaaccugagguggccaaccuggauauuaucgggcagcgcauagaaaauauuaaacacgagcauaagucuacuuggcacuaugacgaggauaaccccuacaagaccugggcuuaucauggaagcuacgaaguaaaaccuaguggcuccgcgagcucuauggugaauggcguugucaaguugcucacaaaaccaugggacgugauccccauggugacucagaucgccaugaccgauacaaccccuuucgggcaacagagggucuuuaaggagaaaguugacacucggacgccaaaggcaaagagaggaacagcucagauuauggaagugaccgccaaauggcugugggguuuccuaucacgcaacaagaaacccaggauauguacucgagaggaauuuacccggaagguaagaaguaaugcagccaucggcgcuguguucgucgacgagaaccaauggaacuccgccaaagaggcgguggaagaugagagguuuugggaccuuguucaccgcgaacgugagcugcacaagcaggggaagugcgcaacaugcguguauaacaugaugggaaaacgggaaaagaaacucggcgaguucgguaaggccaaagggagcagagcuauuugguacauguggcugggagccagguucuuggaguuugaagcacugggcuucaugaaugaggaucauugguuuucucgcgaaaacucgcucucaggcgucgagggggagggacuucacaagcuggguuacaucuuacgagacauuagcaaaaucccgggcgggaauauguaugcugaugacacggccggaugggauacccggauaacugaagacgaucugcagaacgaggcuaagaucacagacauuauggaaccugagcaugccuugcucgcaaaguccaucuucaaacugaccuaccagaauaaggugguaagaguucaaaggccagcgaaaaacggcacugugauggaugucauuagucgcagagaccagcgggguucuggacaggugggaacauauggccuaaauaccuuuacaaacauggaagcccagcuuaucaggcaaauggagagcgagggcauauucucccccucagaacuggagacuccuaaccucgcucgucgagugcuggauugguuggaaaagcacggggucgagcgcuuaaaaagaauggccauuaguggagacgacuguguugugaagccaaucgaugaccgguuugcaaccgcucugacggcccucaaugauauggguaagguaaggaaagacaucccccagugggaaccgucuaagggcuggaacgauuggcaacaggugccuuucugcagccaccauuuucaccaacuuauuaugaaagacgggcgcgagauagucgugcccuguagaaaucaggaugagcugguuggacgggcaagggugucccagggcgccgguuggucacuacgagaaaccgcgugccugggaaagagcuacgcucagauguggcaacucauguauuuccaucguagagacuugcgccuggccgcaaacgccaucuguucugcugucccaguggauuggguaccuacaucccggacuaccuggaguauucacgcccaucaccaguggaugacaacugaggacaugcuuagcguuuggaauaggguguggaucgaagagaaccccuggauggaagauaaaacccacauuucguccuggggagacgucccauaccugggcaagagagaggaccaguggugcggcucucucaucggguuaacggcacgcgcuacaugggccaccaauauacaaguggcgaucaaccagguucggaggcugauuggaaaugagaacuauuuggauuacaugacuucaaugaagcgauuuaaaaaugaaagcgaccccgagggugcucugugguga

SEQ ID NO: 13952 - RNA, 9879 nt, Artificial Sequence
  derived and/or modified CDS sequence (opt3) from DENV-1__JF937612__SS-prME
agcgugaccaugcugcucaugcuuaugcccacagcccuggcuuuccacuugacuacgagaggaggggaaccucauaugaucgucuccaagcaggaaaggggaaaaucuuuacuguuuaagaccucagccgguguuaauaugugcacacuaauugccauggaccucggagaacugugugaagauacuaugaccuacaaaugcccacggauuacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaaugccaccuuuauuaucgauggaccaaacacaccugaaugucccgacgaucagagagcuuggaauauuugggaggucgaggacuacggcuucgguaucuuuacuaccaacauauggcuuaaguugagggauuccuauacacaggugugcgaccaccgucucaugucagcagccauucgggauaguaaagcuguucacgccgacaugggguacuggaucgaaucugagaagaaugaaacguggaaacuggcacgagcgagcuucauugaggugaagaccuguaucuggccaaagucccauacucuauggucaaacggaguacuggaaagcgagaugauaauccccaaaauuuauggcgguccuaucucucaacacaauuacagaccaggcuacuucacacaggccgcugggccguggcaucucggaaagcuggagcuugauuuugacuugugcgaaggcaccacugucgugguggaugagcacugcgggaacaggggacccucccugcgcacaaccacggucacuggcaaaauuauccacgaaugguguugccggaguuguaccuuaccuccacucagauucaggggugaggacgggugcugguauggaauggagauacgccccguuaaggaaaaagaggaaaaucuggugaaguccaugguaucugccggcuccggugagguggacucauuuagucuuggccuguuguguauuagcaucaugaucgaagaggucaugcgaucgcgguggucccguagaaugcucaugacagggacccuggcaguguucuuucuacugauuaugggacagcucacuuggaacgaucugaucaggcuuugcauuaugguuggcgcuaaugccucugaccgcauggggaugggaacaaccuacuuggcacugauggccacauucaagaugcggccuauguuugcugugggcuuacucuucagaaggcugacuagccgagagguccuucugcuaaccauaggucucucacugguggcgaguguugaauugccaaacucccuggaggaauuaggggauggacucgccaugggcaucaugauucugaaacuucugacggacuuucaaucucaucaguugugggcaacacuccugagccuaaccuucaucaagacuaccuuuucccugcacuaugcuuggaaaacaauggccauggugcuuucaauugucagccucuucccccuguguuugaguacuaccucucagaagacgacauggcugccgguauuacucggcucccuggggugcaaaccucuuaccauguuucugaucgccgagaauaagauauggggacgccggagcuggccauugaacgaagguaucauggcugugggcauuguuucgauccuccugucaucucuacugaagaacgaugugccccuugcagggccucucauugccggaggcaugcugaucgcguguuacgucauaagugguuccagcgcugacuugucuuuagagaaagccgcagaggugagcugggaagaggaagccgagcauuccggggcuucacacaauauucugguagaagugcaggaugacggaacuaugaagaucaaagaugaggagagagacgauacacucaccauccugcuuaaggcaacucuguuggccgucaguggcguuuauccccuaagcauuccagcgacacuguucgugugguacuucuggcagaaaaagaaacagaggucuggcgugcucugggacaccccuucacccccagaagucgagcgugcugugcuggaugacgggauauaucgcaucaugcagcggggacuuuuagguagaagccagguuggcguagggguguuucaagaaaacgucuuccauacgauguggcacgugacuaggggagccguucugauguaccagggcaagcgacucgagccgaguugggcaagcgugaagaaagacuugauuuccuacggugggggauggcggcugcagggcucuuggaauaccggcgaggaaguccaggugaucgccguagagccugggaagaaccccaaaaauguccaaacagcuccaggaaccuuuaagacacccgaaggugaggugggcgccauugcacucgauuucaaaccugggacuucgggaagcccaaucguuaaccgcgaaggcaagauagugggucuguaugggaauggagucgugaccacgucaggcacauacguuuccgcuaucgcccaggcgaaggccagucaggagggcccccuuccugagauugaagacgagguguuuagaaaaaggaaccugacuaucauggauuugcacccggggucuggaaagacccggcgauaucuaccagcaauugucagagaagcuaucaaacgcaagcugaggacacucauauuagcccccacccgugugguagcuagcgagauggcagaagcccugaaagguaugccuauucgguaccaaacuaccgccgugaaguccgagcauacaggcaaggagaucguugaccuuaugugccacgcuacguucacuaugagacugcucucaccagucagggugcccaauuauaacaugaucauuauggaugaagcgcauuuuaccgacccuucuagcaucgcagcccgcggguacauaaguacacgagugggaaugggcgaggcugccgcaauuuucaugaccgccacuccgcccgguuccgucgaggcuuuuccacagagcaaugcgguaauccaggaugaggaaagagacauuccugagcggucuuggaacucaggguaugaguggaucacagauuuccccggaaaaaccgugugguuuguuccauccauaaagaguggcaaugacauugccaacuguuugaggaaaaauggcaagcgcgugauccagcugagccguaaaacguucgauacugaauaccaaaagacaaagaacaacgacugggacuacgucgugaccaccgauaucucggagaugggggcaaauuucagagcugaccggguuauugauccuaggcgcugccucaaacccgugauccugaaggacggaccagaacgagucauucuugccgguccgaugccugugacuguagcaucugccgcucagagacggggcaggauagggcgcaaccacaauaaagagggagaucaguauaucuacaugggccagccccuaaacaaugacgaggaucaugcccacuggacagaagcgaagaugcuguuggacaacauuaauaccccagaggguaucauccccgcauuauuugaaccugagagagaaaaauccgccgcuauugauggggaguauaggcugcggggcgaggcccguaagacauucguggaacucaugcgccgaggagaccugccaguuuggcuuagcuacaaggucgcuucagagggcuuucaauauagugauagaagguggugcuucgacggggaacggaacaaucaggugcuggaggaaaacauggauguggagauauggacuaaagagggagaacgcaagaaacucagacccaggugguuggacgcacggacguacucugacccucuggcccuacgagaguuuaaggaguucgcugccgguagacgcuccgucagcggcgaucugauccucgagauugggaaacuuccgcagcaccugacccagagggcacaaaaugcguuagacaacuugguuaugcugcauaauucagaacagggaggccgggccuaucgucacgcuauggaggagcucccagauacaaucgaaacucugaugcuucuggcccucauugcaguguugaccggugggguaacacuguuuuucuuaaguggcagaggacuaggcaagaccagcaucgggcugcucugugugauggcuuccucuguccuucuguggauggccagcguggagccccauuggauagcagccuccaucauuuuggaauuuuuccugaugguucuccugaucccugagcccgacaggcagcgcacuccacaggauaaccaacuugcuuacguggucauuggacuccuguuuaugaucuugacgguagcggccaaugagaugggucuguuagaaaccaccaaaaaggaccuaggcauagggcacguggcaguugagaaccaccaucacgcugccaugcuggauguggaccuccauccugccucagcauggacucuuuacgcugucgccaccacaauuaucacccccaugaugcggcacacuauugaaaacacaacggcgaauaucucucugaccgcuauagccaaccaggcagccaucuugaugggacuggauaagggcuggccaauuaguaaaauggacaucggugugccucuccuggcucuugggugcuauucgcaggucaauccguuaacucugacagcagccgugcucauguugguugcgcauuacgcuauuaucggccccggacugcaagccaaggcaacccgagaggcccagaaaagaaccgcugccggcauaaugaagaacccaacaguggaugggauuguagcaaucgaccuagauccuguggucuaugacgcuaaauucgaaaagcagcugggacagaucaugcuccuuauucuguguacuagccaaaucuugcugaugaggacgaccugggcccucugcgaguccauaacacuggcgacuggccccuuaaccacacuuugggaggguucuccagggaaguuuuggaauaccacuauugccguuucaauggcaaacaucuuccgcggaagcuaccuggcuggcgccggucucgcauucucccuaaugaaaagucugggcgggggacggagaggcacgggggcucagggagaaacauugggcgagaaguggaaacgucagcugaaucagcucucuaagagcgaauuuaacaccuauaaaaggucagguauuauggagguggaccgguccgaagccaaggaggggcuuaagcgcggagagacuaccaaacacgccgucagucgaggcacagcgaagcugagaugguucguggaaaggaauuugguaaaaccugaggguaaggugaucgaucugggcugugggcggggaggcuggagcuacuauugcgcugggcucaaaaagguuacugaagugaagggauacaccaaaggcggucccgggcacgaggaaccgauaccaauggcaacauacggauggaacuuagucaagcugcauucuggcaaagacguguuuuucaucccucccgagaagugugauacgcuucugugcgacauuggcgaguccucaccaaaucccaccaucgaagaggggcgcacucuaagaguccucaaaaugguggaaccuuggcugaggggaaaccaauuuuguauuaagaucuugaauccguauaugcccagcguuguagagacacuggagcagaugcagcgaaaacacgguggcaugcucgugcggaacccacuuucgcguaauucuacccaugaaauguacugggucaguugcgggacuggaaacauuguguccgccguuaauaugacaagcagaaugcuguuaaaccgcuucaccauggcucacaggaagccuacguaugagcgggauguggaccugggcgccgguaccagacacgucgcaguggaacccgagguagccaacuuggauaucauagggcagcgcauugaaaauaucaagcaugagcacaaaucaacauggcauuacgacgaggauaacccuuauaagacuugggcuuaccacggauccuaugaagugaaaccaucuggcagcgcgaguuccaugguuaauggcgucgugaagcuccugaccaaacccugggacgugaucccuauggucacacaaauugccaugacugauaccacaccauuugggcagcagaggguuuucaaggagaagguggacacccgaacucccaaagcaaagcggggaacggcucaaauaauggaaguaacagccaaauggcuaugggguuuucuuagcagaaacaagaaaccgaggaucuguacccgcgaggaguucacucguaaggugcggucuaaugcagccauuggcgcugucuuuguggacgagaaccaguggaacucagccaaggaggcgguugaagaugagagauucugggaccuggugcauagggaacgcgagcuccacaaacaggggaagugcgcaaccugcgucuacaacaugaugggaaaacgagaaaagaaacugggcgaguuugguaaggccaaggggagucgggcuaucugguacaugugguugggagccagauuccuggaguucgaagcacucggcuuuaugaaugaggaucacugguucuccagggaaaacagccuuucuggcguggagggggagggacugcauaaauuagguuauauucugcgcgacaucucgaagauaccuggcgggaauauguacgcugaugacacagccggaugggauacgagaaucaccgaagacgauuugcagaacgaggcucggauuacugacaucauggaaccagagcacgcccuccuggcaaaaucaauuuuuaagcuaacauaucaaaauaaaguaguuagggugcagcgucccgcgaagaacggcaccgucauggaugugaucagccgacgcgaccagagagguuccggacaggugggaacuuacggccuuaauacauucaccaacauggaagcccaacugauacggcagauggagagugagggcauauuuucuccuagcgaacucgagacaccaaaccuggcugaaagggucuuggauugguuagagaaauaugggguugaacgccugaagagaauggccaucuccggagacgacugugugguaaagcccaucgaugaccgguucgcaacugcucucaccgcccuuaaugauauggguaaagugaggaaggacauuccgcagugggagccuucaaaaggcuggaacgauuggcagcaaguccccuuuugcagucaucacuuccaccagcugauaaugaaggacgggcgagagaucgugguuccaugucguaaucaggaugagcuagugggcagagcacgcgucucucagggcgccgguuggagccugcgggagacggcgugccucgggaaauccuacgcucaaauguggcaguugauguauuuucauaggagagaccugcgccuugccgcaaacgccauuuguucagcugugccuguagauuggauccccaccagccggacaacuuggucuauucacgcccaucaccaguggaugaccacagaagacaugcuguccguuuggaauaggguguggaucgaggaaaacccauggauggaggauaagacucauauaaguagcuggggagacguccccuaccucggcaagcgagaggaccaauggugcggcucguuaaucgggcugaccgcaagagcuacgugggccacaaauauucagguggcgaucaaccagguucggagguugauuggaaaugaaaacuaccuggauuauaugaccuccaugaaacgcuucaagaaugagucugacccugaaggugcucucugguga

SEQ ID NO: 13953 - RNA, 9879 nt, Artificial Sequence
  derived and/or modified CDS sequence (opt3) from DENV-1__GU131786__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaccggccagaggcgcuaggcggauggccauucucggggcaaccgcgugggauuuuggauccaucgguggcguuuucccuucuguggggaaacugguccaucagauuuuuggaacugcuuacggcgugcuuuucagcgguguaucauggaccaugaagauagggaucggcgugcuguugacauggcucggacugaauagucgauccacgagcuuaucuaugaccuguauugccguuggccuggucacucuauaccucggggugauggugcgcgcagacucaggaugcgucaucaacuggaaaggcagagaacugaagugugguagugggaucuuuguuacaaaugaggugcacaccuggacagaacaguauaaguuccaagccgauagccccaaaaggcuuuccgcugccauuggaaaggcaugggaggagggcgugugcgguauacggucugcuacucgcuuggaaaacaucauguggaaacagauuucgaacgagcugaaucauauccuccuggaaaacgacaugaaguuaaccguagucgugggcgacguugccgggauucuggcgcagggaaaaaagaugaucagaccacagccuauggaguacaaauauagcuggaaguccuggggcaaggccaaaauaaucggggcugaugugcaaaauacgacauuuauuaucgacggacccaacaccccagaaugucccgaugaccagagggcauggaauauuugggaggucgaggauuacggcuucgguaucuuuacuaccaacauauggcuuaaguugcgugacucauauacacaggugugcgaucaccggcucaugagugccgcuauuaaagacucuaaggccguucacgcagauaugggguacuggaucgaaagcgagaaaaaugaaacuuggaagcuggcgcgagccuccuucauugaggugaagaccuguaucuggccuaaaucacauacacuauggagcaacggaguacuggaaucugagaugauaaucccaaagauuuauggcgguccgaucucccagcacaauuacagacccggcuacuucacgcaaaccgcugggccuuggcaucucggaaaacuggagcuugacuuugauuugugcgaaggcacuacagucgugguggacgagcacugcgggaacaggggaccaagucugcgcaccacuacagucaccggcaagauuauccacgaaugguguugccggagcuguacguuacccccucucagauucaaaggugaggaugggugcugguauggaauggagauaaggccaguuaaggaaaaggaggaaaaucuggugaaaucuaugguauccgccggcucaggugagguggacaguuuuagccuuggccuguuguguauuucgaucaugaucgaagaggucaugcgcucccgauggucucggaagaugcucaugacugggacccuggcaguguucuuucuacugauuaugggacagcucacauggaacgaccugauccgucuuugcauuaugguuggcgcuaaugccagcgauagaauggggaugggaaccacuuacuuggcacugauggccacauucaaaaugaggcccauguuugcugugggcuuacucuuccgccggcugaccucaagagagguccuucugcuaacaauaggucucagucugguggcguccguugaauugccgaacucucuggaggaauuaggggacggacucgccaugggcaucaugauucugaagcuucugacugauuuucagagccaucaauugugggcaacccuccugucccuaacguucaucaggacaaccuuuucacugcacuaugcuuggaaaacuauggccauggugcuuagcauugucagucucuucccucuguguuugucuaccacaucccagaagacuaccuggcugccaguauuacucggcagccuggggugcaagccccuuacgauguuucugaucgccgagaauaaaauauggggacgaaagucguggccuuugaacgaagguaucauggcugugggcauuguuucaauccuccugucuagucuacugaaaaacgacgugccccuugcagggccacucauugccggaggcaugcugaucgcguguuacgucauauccgguagcucugcugauuugagcuuagagaaggccgcagugguauccugggaggaagaggccgaacauucaggggcuagucacaauauucugguggagguccaggacgauggaacaaugaaaaucaaggacgaagagcgcgaugacacccucacuauccugcuuaaagcaacacuguuggccguuagcggcguguauccucuaucuauucccgcgacccuguucgugugguacuucuggcagaagaagaaacaacgguccggcguccucugggauacuccaucaccgccugagguggaaagagcuguucuggacgaugggauauauaggaucaugcagcguggacuuuuaggucgcagucagguaggcgugggggucuuucaggagaacguguuccauacaauguggcacguuacccggggagccgugcugauguaccaaggcaagagacucgaacccagcugggcauccgucaaaaaggacuugauuucuuacggugggggauggaggcugcagggcucguggaauacgggcgaggaggugcagguaaucgccgucgaaccagggaaaaaccccaagaaugugcagacugcuccuggaaccuuuaagacaagcgagggugaaguuggcgccauugcacucgacuucaaaccagggaccucaggaucccccaucgugaaccgagagggcaagauagucggucuguaugggaauggagugguuacaacuaguggcaccuacgugucugcuaucgcccaagcgaaagccagccaggaaggcccucuuccggagauugaggaugaagucuuucggaagcgcaaccugacgaucauggacuugcacccaggguccggaaaaacaagaagguaucuacccgcaauugugcgggaggcuaucaagcgaaagcugagaacucucauauuagccccuacccgcguaguggcuucagaaauggcagaggcccugaaagguaugccaauuagguaccagacaaccgccguuaagucugaacauacuggcaaagagaucgucgaucuuaugugccacgcuaccuucacaaugcgucugcucagccccgugcgggugccuaauuauaacaugaucauuauggacgaggcgcauuuuacggauccgaguuccaucgcagccagaggguacauaagcacuagggucggaaugggcgaagcugccgcaauuuucaugaccgccacacccccagguucuguagaggcuuuuccucaaucaaaugcggugauccaggacgaagagcgcgauauucccgaacgauccuggaacaguggguaugaguggaucaccgacuucccaggaaagacuguuugguuugugccuagcauaaaaucgggcaaugauauugccaacuguuugagaaagaauggcaagcgggucauccagcugucuaggaaaacauucgacaccgaguaccagaagacgaaaaacaacgauugggacuacgugguuacuacagacaucuccgaaaugggggcaaauuuccgcgcugaucgugugauugaccccagacggugccucaagccagucauccugaaagauggaccggagagggugauucuugccgguccuaugcccguaaccguggcaagcgccgcucaacgccgaggcagaauagggcggaaccacaauaaggaaggagaccaguauaucuacaugggccagccacuaaacaaugaugaggaccaugcccacuggaccgaggcgaagaugcuguuggauaacauuaauacucccgaagguaucaucccugcauuauuugagccagaaagggagaaaucagccgcuauugacggggaauaucgccugagaggcgaggccaggaagacauucguugagcucaugcggcguggagaucugcccgucuggcuuaguuacaaaguggcuucugaaggcuuucaguauuccgaccgccgauggugcuucgauggggagagaaacaaucaagugcuggaagagaacauggacgucgaaauauggaccaaggagggagagaggaaaaagcuccggccucgcugguuggaugcaagaacauacagcgacccgcuggcccuaagggaauuuaaagaguucgcugccggucggcgaucaguuaguggcgaccugauccucgaaauugggaagcuuccacagcaccugacucagagagcacagaaugcguuagauaacuuggugaugcugcauaauagcgagcaaggaggccgcgccuauaggcacgcuauggaagagcuccccgacacgaucgagacccugaugcuucuggcccucauugcaguauugacagguggggugacucuguuuuucuuauccggccggggacuaggcaagaccucuaucgggcugcucugugucauggcuagcuccgugcuucuguggauggccucaguugaaccucauuggauagcagccucuaucauuuuggaguuuuuccugauggugcuccugauccccgaaccagaucgucagagaacaccucaggacaaccagcuugcuuacgucguaauuggacuccuguuuaugaucuugaccguggcggccaaugagaugggucuguuagagacuacgaaaaaggaucuaggcauagggcacguugcaguggaaaaccaccaucacgcugccaugcuggacgucgaucuccaucccgccagugcauggacccuuuacgcuguggccacaacuauuaucaccccaaugaugaggcacacaauugagaacaccacugcgaauaucucgcugacagcuauagccaaccaagcagccaucuugaugggacuggacaaaggcuggccuauuagcaagauggauaucggugucccgcuccuggcucuugggugcuauucccaggugaaucccuuaacgcugaccgcagccguucucauguugguggcgcauuacgcuauuaucggcccaggacugcaggccaaagcaacucgcgaagcccaaaagcggacagcugccggcauaaugaagaacccuaccguagacgggauuguggcaaucgaucuagaccccgucguuuaugaugcuaaauucgagaagcagcugggacagaucaugcuccuuauucuguguaccucucagaucuugcugaugcgaacaacuugggcccucugcgaaucaauaacgcuggcgaccggcccauuaacaacucuuugggaggguagcccugggaaauuuuggaauaccacaauugccguguccauggcaaacaucuucagaggaaguuaccuggcuggcgccggucucgcauucucucuaaugaagagccugggcgggggaaggcgcggcaccggggcucaaggagagacuuugggcgaaaaauggaagcggcagcugaaucagcucucaaaguccgaguuuaacacguauaaaagaagugguauuauggaagucgaccguagcgaggccaaggaagggcuuaaaaggggagagacaaccaagcacgccgugucucggggcacugcgaaacugcgcugguucguagagcgaaauuuggugaagcccgaagguaagguuaucgaccugggcugugggagaggaggcugguccuacuauugcgcugggcucaaaaaggugaccgaggucaaaggauacacaaagggcgguccggggcacgaagagccaauaccuauggcaacuuacggauggaacuuagugaaacugcauucaggcaaggaugucuuuuucauccccccagaaaaaugugacacccuucugugcgauauuggcgagagcucgcccaauccuacaaucgaggaagggaggacgcuacgggugcucaagaugguugagccguggcugcgcggaaaccaguuuuguauuaagaucuugaaucccuauaugccaucuguaguggaaacccuggagcaaaugcagagaaaacacgguggcaugcucgucaggaacccucuuagucgaaauuccacucaugagauguacugggugagcugcgggacaggaaacauuguuucagccgugaauaugaccucccggaugcuguuaaaccguuucacuauggcucacagaaagcccacauaugaacgcgacgucgaucugggcgccgguaccaggcacguggcaguagagccugaaguggccaacuuggacaucauagggcagcggauugagaauaucaaacaugaacacaagucuacguggcauuacgaugaggacaacccauauaaaaccugggcuuaccacggaagcuaugagguuaagcccaguggcuccgcgagcucuauggucaauggcguggugaagcuccugacaaaaccuugggaugucaucccaaugguuacucagauugccaugaccgacacaacucccuuugggcaacagagaguguucaaggaaaaaguagauacccgcacaccgaaggcaaaaaggggaaccgcucagauaauggaggugacugccaaguggcuaugggguuuucuuucacgaaacaagaaaccucggaucuguacgagagaagaguucacaaggaagguccgcaguaaugcagccauuggcgcuguguuuguugacgaaaaccaauggaauuccgccaaagaggcgguggaggacgaacguuucugggaucugguccaucgggagagagaacuccacaagcaggggaaaugcgcaaccugcguguacaacaugaugggaaagagggagaagaaacugggcgaauuugguaaggccaaagggagccgcgcuaucugguacaugugguugggagcccgauuccuggaguucgaggcacucggcuuuaugaaugaagaccacugguucucucgggagaacucgcuuucaggcguagaaggggagggacugcauaaguuagguuauauucugagagauaucagcaaaauaccaggcgggaauauguacgcugacgauacugccggaugggacaccaggaucacagaggaugacuugcagaacgaagcuaagauuacggauaucauggagcccgaacacgcccuccuggcaaaauccauuuuuaagcuaaccuaucagaauaagguugugcgcguccaaagaccugcgaaaaacggcacugugauggacgugaucagucggagggaucagcgugguucugggcaggucggaacauacggccuuaauaccuucacuaacauggaggcccagcugauacgacaaauggaaagcgagggcauuuuuuccccaucagagcucgaaacacccaaccuggcugggcgcguuuuggacugguuagagaagcauggaguggaaagacugaaacggauggccaucaguggugaugacuguguagugaagccgaucgacgauagguucgcaaccgcucucacagcccuuaaugacaugggcaaaguccgcaaggauauuccucagugggagcccucuaagggguggaacgacuggcagcaggugccauuuugcagccaccacuuccaucaacugauaaugaaagauggaagagaaaucguugugccuugucggaaucaggacgagcuagucggcagggcacgagugucccagggugccggguggucacugcgugagacugcgugccucggaaagagcuaugcucagauguggcaauugauguacuuucacagacgcgaucugcggcuugccgcaaacgccauuuguucugcuguacccguugacugggugccaaccuccaggacgaccuggaguauccaugcccaccaucaguggaugacaacugaagauaugcugagcgucuggaauagaguguggauugaggaaaaccccuggauggaggacaaaacccacaucucguccuggggcgauguuccuuaucucggcaagcgcgaagaccaguggugcgggucuuuaauaggacugacagcacgggcuacuugggccaccaauauccaaguggcgauuaaccaggucaggcgauugcuggguaaugagaacuaccucgacuacaugacgucaaugaaaagauucaagaaugagagcgauccagaaggcgcucuuugguga

SEQ ID NO: 13954 - RNA, 9879 nt, Artificial Sequence
  derived and/or modified CDS sequence (opt3) from DENV-1__GU131787__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacggcaugaaguucacuguagucgugggggacguugcaggcauucuggcucagggcaaaaagaugauccgcccucaacccauggaguacaaauauucguggaaaagcugggggaaggccaagauaaucggagcggaugugcagaauaccacauuuauuaucgacggcccaaacacuccugaaugucccgaugaccagagagccuggaauauuugggaggucgaggauuacgguuucgggaucuuuaccacaaacauauggcuuaaguugagggacuccuauacacaggugugcgaucaccgucucaugucagcugcaauuaaagacaguaaggccguucacgcugauaugggauacuggaucgaaucugagaaaaaugaaaccuggaagcuggcccgggcauccuucauugaggugaagacuuguaucuggccaaaaucccauacacuauggucaaacggcguacuggaaagcgagaugauaauccccaagauuuaugguggcccuaucucucaacacaauuaccgaccaggguacuucacccagacugcgggaccguggcaucucggcaaacuggagcuugacuuugauuugugcgaagggacaaccgucgugguggacgagcacugcggaaacagaggccccucccugaggacgacuaccgucacagguaagauuauccacgaaugguguugccgcaguuguaccuuaccuccacuccgguucagaggggaggauggaugcugguauggcauggagauaaggcccguuaaagaaaaggaggaaaaucugguaaagagcaugguaucugccgguuccggcgagguggacucauuuagucuugggcuguuguguauuagcaucaugaucgaagaggucaugcgcucgcgauggucccggaaaaugcucaugacuggaacacuggcuguguucuuucuacugauuaugggccagcucaccuggaacgaccugauccgucuuugcauuaugguuggggccaaugcaucugauagaaugggaaugggcacaacuuacuuggcucugauggccaccuucaagaugaggccuauguuugcaguggguuuacucuuccgccggcugacgagcagagagguccuucugcuaacaauagggcucucacugguggccaguguugaauugccaaacucccuggaggaauuaggagacggccucgcuaugggcaucaugauucugaaacuucugaccgauuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucgggucccugggaugcaagccucuuacaauguuucugaucgcugagaauaaaauaugggguaggcgaagcuggccauugaacgaaggcaucauggccguggggauuguuucgauccuccugucaucucuacugaagaacgacgugccccuugccggaccucucauugcuggcgguaugcugaucgcauguuacgucauaaguggguccagcgccgauuugucuuuagagaaagcggcugaggugagcugggaagaggaagccgagcauuccggagcaucacacaauauucugguagaagugcaggacgauggcaccaugaagaucaaagacgaggagcgcgaugacacucucacaauccugcuuaaggccacccuguuggcugucaguggcguuuauccccuaagcauuccagcaacgcuguucgugugguacuucuggcagaaaaagaagcagcggucuggggugcucugggauacuccuucacccccagaagucgagagagccgugcuggacgauggaauauauaggaucaugcagcguggucuuuuaggccgcagccagguugggguaggaguguuucaagaaaacgucuuccauaccauguggcacgugacacggggcgcgguucugauguaccaggguaaaagacucgagccgaguugggcuagcgugaagaaagacuugauuuccuacgggggaggcuggaggcugcagggcucuuggaauaccggggaggaaguccaggugaucgccguagagccuggaaagaaccccaaaaauguccaaacagcaccagguacuuuuaagacccccgaaggcgaggugggggccauugcucucgacuucaagccuggaacgucgggcagcccaaucguuaaccgagaagguaaaauaguggggcuguauggaaauggcgucgugacaacuucaggcaccuacguuuccgccaucgcacaggcuaaggccagucaggaggggccccuuccugagauugaagaugagguguuucggaaacgcaaccugacaaucauggacuugcacccgggaucugguaagaccagaagguaucuaccagcgauuguccgggaagccaucaaacgaaagcugagaacucucauauuagcacccacccgcgugguagcuagcgagauggccgaagcucugaagggcaugccuauuagguaccaaacaacggcagugaaauccgagcauacugggaaggagaucguugaucuuaugugccacgccaccuucacaaugcgucugcucucaccaguccgggugcccaauuauaacaugaucauuauggacgaagcccauuuuaccgauccuucuagcaucgcugcgagaggauacauaaguacuagggugggcaugggugaggcagccgcuauuuucaugacagccaccccgcccggguccgucgaagcauuuccacagagcaaugccguaauccaggacgaggaacgcgauauuccugagcgaucuuggaacucaggauaugaguggaucacggacuuccccggcaaaacugugugguuuguuccauccauaaagaguggcaaugauauugcuaacuguuugaggaaaaaugggaagcgggugauccagcugagcaggaagacauucgacaccgaauaccagaaaaccaagaacaacgauugggacuacgucgugacuacagacaucucggagaugggagcgaauuuccgcgccgaucguguuauugacccuagacggugccucaaacccgugauccugaaggaugguccagaaagggucauucuugcaggcccgaugccugugaccguagcuucugccgcacagcgccgagggagaauaggacggaaccacaauaaagagggcgaccaguauaucuacaugggucagccccuaaacaaugaugaggaccaugcccacuggacagaagcuaagaugcuguuggauaacauuaauacuccagaggggaucauccccgccuuauuugaaccugagagggaaaaguccgcggcaauugacggcgaguaucgccugagaggagaggccaggaaaacguucguggaacucaugcggcguggcgaucugccaguuuggcuuagcuacaaggucgcuucagagggguuucaauauagugaccgccgauggugcuucgauggagaaagaaacaaucaggugcuggaggaaaacauggacguggagauauggaccaaagagggugaaaggaagaaacuccggccccgcugguuggaugccagaacauacucugacccucuggcucuaagggaguuuaaggaguucgcagccggccggcgauccgucagcggggaccugauccucgagauuggaaaacuuccgcagcaccugacucagagagcucaaaaugccuuagauaacuugguuaugcugcauaauucagaacagggcggucgcgcauauaggcacgcgauggaggagcucccagacaccaucgaaacacugaugcuucuggcccucauugcuguguugaccgggggcguaacucuguuuuucuuaaguggacggggccuagggaagacgagcaucggacugcucugugugauggccuccucuguccuucuguggauggcaagcguggagccccauuggauagcugccuccaucauuuuggaauuuuuccugaugguucuccugaucccugagcccgaucgucagagaaccccacaggacaaccaacuugcauacguggucauuggucuccuguuuaugaucuugacaguagccgcuaaugagaugggccuguuagaaacuaccaagaaagaucuagggauaggacacguggcgguugagaaccaccaucacgccgcaaugcuggacguggaucuccauccugcuucagccuggacacuuuacgccgucgcaaccacuauuaucacacccaugaugaggcacacgauugaaaacaccacugcuaauaucucucugacagccauagcgaaccaggcugccaucuugaugggccuggacaaggguuggccaauuaguaaaauggauaucggggugccucuccuggcacuuggcugcuauucgcaggucaauccguuaacccugaccgccgcugugcucauguugguugcacauuacgccauuaucggacccggccugcaagcgaaggcuacacgcgaggcccagaaacggacugcagccgggauaaugaagaacccaacgguggacggaauuguagcuaucgaucuagacccuguggucuaugaugccaaguucgaaaaacagcugggccagaucaugcuccuuauucuguguaccagccaaaucuugcugaugcgaacaacuugggcacucugcgaguccauaacccuggcuacaggucccuuaaccacucuuugggaggggucuccaggaaaguuuuggaauacgacaauugccguuucaauggcgaacaucuucagaggcagcuaccuggccggugcaggccucgcuuucucccuaaugaaaagucuagggggaggcaggcgcgggaccggagcccagggcgaaacuuugggugagaaguggaaacggcagcugaaucagcucucuaagagcgaauuuaacaccuauaagagaucagggauuauggagguggaccguuccgaagcaaaagagggacuuaagaggggcgagacaacuaaacacgcugucagucgggguaccgccaagcugcgcugguucguggaacgaaauuugguaaaaccugagggcaaggugaucgaccugggguguggaagaggcggguggagcuacuauugcgccggacucaagaaaguuacagaagugaagggcuacacgaaaggugggcccggacacgaggaaccgauaccaauggcgaccuacggcuggaacuuagucaagcugcauucuggcaaagauguguuuuucaucccucccgagaagugugacacucuucugugcgauauuggggaguccucaccaaaucccacaaucgaagagggaaggacccuacggguccucaaaaugguggaaccuuggcugcgcgguaaccaauuuuguauuaagaucuugaauccguauaugcccagcguuguagagacucuggagcagaugcagagaaagcacggcgggaugcucgugaggaacccacuuucgcgaaauucuacacaugaaauguacugggucaguugcggaaccggcaacauuguguccgcuguuaauaugacgagccggaugcuguuaaaccguuucaccauggcacacagaaaaccuacauaugagcgcgacguggaucugggugccgggacuaggcacgucgcuguggaacccgagguagccaacuuggacaucauaggacagcggauugaaaauaucaagcaugagcacaaaucaaccuggcauuacgaugaggacaacccuuauaagacaugggcauaccacggcuccuaugaagugaaaccaucuggcagcgccaguuccaugguuaauggggucgugaagcuccugacuaagcccugggaugugaucccuauggucacccaaauugcuaugacagacaccacuccauuuggacagcagagaguuuucaaagagaagguggauacgcgcacacccaaagcgaagagggguaccgcccaaauaauggaaguaacugcaaaauggcuauggggcuuucuuagccgaaacaagaagccgcggaucuguaccagagaggaguucacaaggaaagugcgcucuaaugcugccauuggggcagucuuuguggacgagaaccaguggaacucagccaaggaggcuguugaagacgagcguuucugggaucuggugcaucgggaaagagagcuccacaaacagggaaagugcgccacgugcgucuacaacaugaugggcaaaagggaaaagaagcugggugaguuugggaaagcgaagggaagucgcgcaaucugguacaugugguugggcgcccgauuccuggaguucgaagcucucggcuuuaugaaugaggaccacugguucucccgggaaaacagccuuucugggguggagggagagggucugcauaaauuaggcuauauucugagagauaucucgaagauaccugggggaaauauguacgccgacgauaccgcaggcugggacacuaggaucacagaagaugacuugcagaacgaggcucgcauuaccgauaucauggaaccagagcacgcccuccuggcuagaucaauuuuuaaacuaacuuaucaaaauaagguaguucgggugcagaggcccgccaaaaacgguacagucauggacgugaucagccgucgagaucagcgcggguccggacaggugggcaccuacggccuuaauacauucacuaacauggaagcacaacugauaagacagauggagagugaggggauauuuucuccuagcgaacucgagaccccaaaccuggcggaacgggucuuggacugguuagagaaguauggaguugaaaggcugaagcgcauggccaucuccggugaugacugugugguaaaacccaucgacgauagauucgcuacggcccucaccgcacuuaaugacaugggcaaggugcggaaagauauuccgcagugggagccuucaaagggguggaacgacuggcagcaaguccccuuuugcagucaucacuuccaccagcugauaaugaaagauggaagggagaucgugguuccaugucgaaaucaggacgagcuggugggccgugcuagagucucucagggugccggguggagccugcgcgagacagcaugccucggaaaguccuacgcccaaauguggcaguugauguauuuucaucggagggaucugagacuugcggcuaacgccauuuguucagcagugccuguagacuggauccccacuagccgcaccacauggucuauucacgcccaucaccaguggaugacuaccgaagauaugcuguccguuuggaaucggguguggaucgaggaaaacccauggauggaggacaagacgcauauaaguagcuggggcgauguccccuaccucggcaaaagggaggaccaauggugcgggucguuaaucggacugacagcucgagccaccugggcaacuaauauucagguggcuaucaaccagguuagacgguugauugguaaugaaaacuaccuggacuauaugacauccaugaagagguucaaaaaugagucugauccugaaggcgcccucugguga

SEQ ID NO: 13955 - RNA, 9879 nt, Artificial Sequence
  derived and/or modified CDS sequence (opt3) from DENV-1__HM181968__SS-prME
uccgugaccaugcugcucaugcuuaugcccaccgcccuggcuuuccacuugacuacgaggggaggggaaccucauaugaucgucaccaagcaggaaaggggaaaauccuuacuguuuaagacaucugcggguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaagggggcaacucagaacggacgcuugauuacagccaaucccaucguuaccgacaaagagaagccugugaacauagaagcugagccacccuuuggcgagucuuauauuguaaucggugccggggaaaaagcacugaagcucuccugguucaagaaaggcucaaguaucggaaagauguuugaggccacugcuagaggcgccaggcggauggcaauucugggggauaccgcgugggacuucggaagcgucgguggcguguuuacauccguugggaaacuugugcaucagaucuucggaacggcuuacggcguccuguuuucuggugugagcuggaccaugaagauugggauaggcguauugcucacuuggcugggauuaaauucacgaaguacaucccugagcaugaccuguaucgccgugggccuaguuacacucuaccugggggucauggugcaggcagauucuggaugcgugauuaacuggaaaggccgcgaacuuaagugugguucagggaucuucgucacuaaugagguucacaccuggacggaacaauauaaguuucaggccgacaguccgaaaagauugagcgcugccaucggaaaggcaugggaggagggcgugugcgguauuagguccgcuacacggcuggaaaacauaauguggaaacagaucucuaacgagcucaaucauauucuguuagaaaacgacaugaaguucaccgugguagucggcgaugugguugggauccuggcccagggcaaaaagaugauucgcccucaacccauggagcacaaauacucguggaaaagcuggggcaaggcgaagaucauaggggccgacgugcagaauacuaccuuuaucauugauggaccaaacacaccugaaugucccgacgaucagagagcuuggaauaucugggaggucgaggacuauggcuucgguauuuuugcaacuaacaucuggcuuaaguugagggauuccuacacccaggugugcgaccaccgucucaugucagccgcuauaaaagauaguaaggccguucaugcagacaugggguauuggauugaaucugagaaaaaugaaacauggaagcuggcgcgggccagcuucaucgaggugaagacguguauuuggccaaaaucccacacccuauggucaaacggaguacuggaaagcgagaugaucauacccaagaucuacggcgguccuauuucucaacauaauuaucgaccaggcuacuucacucagacagcugggccguggcaccucggaaaacuggagcuugauuuugacuugugcgaaggcaccacugucgugguggaugagcacugcgggaacagaggacccucccugaggacaaccacggucacuggcaagaucauucaugaaugguguugccgcaguuguaccuuaccuccacuccgguucaaaggugaggacgggugcugguacggaauggagaucagacccguuaaggaaaaggaggaaaaucuggugaaaagcaugguaucugccggcuccggugagguggacucauuuagucuuggccuguuguguauaagcauuaugaucgaagaggucaugaggucgcgcuggucccgaaagaugcucaugacagggacccuggcaguguuccuacugcucaucaugggacagcugacuuggaacgaucuuauucgguugugcaucaugguuggcgcuaaugccucugaccguauggggaugggaacaaccuaucuggcauuaauggccacauuuaaaaugagaccuauguucgcugugggccuccugcuuaggcgccugacuagccgggagguccuacuccugaccauugguuugucacugguggcgaguguugaauuaccaaacucccucgaggaacugggggauggacuugccaugggcauaaugauccugaaguugcucacggacuuucaaucucaccagcugugggcaacacuacugagccuuaccuucauuaaaacuacccucucccugcauuacgcuuggaagacaauggccaugguguugucaaucgucagccuguuucccuuaugucucaguacuaccucucagaagacgacauggcugccgguacuucugggcuccuucgggugcaaaccuuugaccauguuucucauuacugagaauaagaucuggggaagaaaaagcuggccacugaacgaagguauaauggccgugggcguugugucgauccuacugucaucucuucucaagaacgaugucccccuggcugggccuuugauugcaggaggcauguuaaucgccuguuaugugauuagugguuccagcgcggaccugucucucgagaaagcugccgagguaagcugggaagaggaagcagagcacuccggggccucacauaauauccugguggaaguccaggaugacggaacaaugaagauaaaagaugaggagagggacgauacccuuacuauucuguugaaggcuacacuacuggcaguuaguggcguguacccccucagcaucccagccacccuguucgugugguauuuuuggcaaaagaaaaagcagcgaucuggcguccuuugggacacgccuucacccccagaaguggagcgcgcgguuuuagaugacgggaucuaccggauuaugcagagaggacugcucgguaggagccagguaggcgugggggucuuccaagaaaacguguuccacacuauguggcacguuacccguggagcuguguugauguaucagggcaaacgccuggagccgaguugggccagcgucaagaaagaccucauauccuacggugggggauggcggcugcagggcucuuggaauacaggcgaggaagugcagguaaucgcagucgagccugggaagaaccccaagaaugugcaaaccgccccaggaacauuuaaaacucccgaaggugagguuggcgcuauugcccuugauuucaagccugggaccucgggaagcccaaucgugaacagagaaggcaaaauugucggucuguacgggaauggagugguuacgacaucaggcacuuauguguccgcaaucgcucaggccaaggcgagucaggagggccccuugccugagauagaagacgaggucuuuaggaaacgaaaccuaaccaucauggaucugcauccggggucuggaaagacacggcgcuaccucccagccauugugagagaagcaaucaagaggaaauuacggacccugauucuugcucccacucgaguaguggccagcgagauggcugaagcacugaaggguaugccuaucagauaucaaaccacagccguuaaauccgagcacacgggcaaggagauagucgaccucaugugccaugccacuuucaccaugcgcuugcugucaccagugagggugcccaauuacaacaugauuaucauggaugaagcucacuuuacagacccuucuagcaucgcggcacguggguauauuaguacccgggucggaaugggcgaggccgcugccaucuucaugacugcaacaccgcccgguuccguagaagccuuuccacagagcaaugcugugauacaggaugaggaaagagacauuccugagaggucuuggaacucaggguacgaguggaucaccgauuuccccggaaaaacgguuugguuugugccauccauuaagaguggcaaugacaucgcgaacugucuccgcaagaauggcaaacgagucauacagcugagcagaaagacuuucgauacagaauaucagaaaaccaagaacaacgacugggacuacgugguuaccacugauauuucggagaugggggccaauuuucgggcagacagggugaucgauccucgccguugccuuaaacccgucauccuaaaggacggaccagaaagagugauucuggcugguccgaugccuguaacaguggccucugcagcccagcggaggggccgcaucgggcgaaaccauaauaaggagggagaucaguacauuuauaugggccagcccuugaacaaugacgaggaucacgcucacuggaccgaagccaaaauguuacuggacaacauaaauacaccagaggguaucauucccgcacucuucgaaccugagagagaaaaguccgcagccaucgauggggaguaccggcugaggggcgaggcucgcaaaacuuucguugaacuuaugagaaggggagaccugccagucuggcucagcuauaagguggccucagagggcuuucaauacagugaucggcguuggugcuucgacggggaacgcaacaaucagguguuggaggaaaacauggaugucgagaucuggacgaaagagggagaacgaaagaaacugagacccagguggcuagacgcucggaccuauucugacccucuggcacuccgcgaguuuaaggaguucgccgcugguagaagguccguuagcggcgaucuuauucuggagauagggaaguuaccgcagcauuugacacagcgggcccaaaaugcacuggacaaccucgugaugcugcacaauucagaacagggaggccgagcguacagacaugccauggaggagcuuccagauacuaucgaaacccugaugcucuuggcucugauugccguauuaacagguggggugacccuauuuuuccugaguggccgcggacucggcaaaacuagcaucgggcuucugugugucauggcauccucuguguugcuguggauggcuagcguugagccccacuggauugccgcauccaucauacucgaauuuuuccugauggugcuucucaucccugagcccgacaggcagcggacgccacaggauaaccaacuggccuaugucguaauuggauugcuguuuaugaucuuaaccguggcugcgaaugagaugggucuacuggaaacaacuaagaaagaccucggcauugggcacguugccguggagaaccaucaccaugcaaccaugcuugaugucgaccugcacccugcuucagccuggacauuguacgccguggcaaccacuaucauaacacccaugaugcgucauacgauugaaaacaccacugcuaauaucucucugacagccauugcgaaccaggcugccauccucaugggacuggauaagggcuggccaauaaguaaaauggacaucggugucccucuuuuagcacuggggugcuacagccaggugaauccgcucaccuugaccgccgcuguucugaugcuaguggcacacuaugccauuaucggccccggacugcaagcgaaggcuacaagagaggcccagaagaggacugcagccggcauuaugaaaaacccaacgguagaugggaucguggcuauagaccucgauccugucguuuacgacgccaaguucgaaaaacagcuuggacagauuaugcuguugauccuguguaccagccaaauccuccugaugcgcacaacuugggcauuaugcgaguccauuacccuugcuacaggcccccugaccacucucugggaggguucuccagggaaguuuuggaauacgacaaucgccgugucaauggcgaacauauuccggggaagcuaucuagccggcgcaggucuggcuuuuuccuugaugaaaagucugggcgggggacgaagaggcaccggggcccagggagaaacucucggcgagaaguggaagaggcagcuuaaucagcugucuaaaagcgaguucaacauuuacaagcgcucagguaucauggaggucgaccgguccgaagcaaaagagggguugaagagaggagagaccacacgucacgcugugaguaggggcacugccaaacugcggugguucguagaacgcaaucucgugaagccugaggguaagguuauugauuuaggcugugggcgaggaggcuggagcuauuacugcgccgggcugaaaaaggugaccgaagucaaaggauauacaaagggcggucccgggcaugaggaaccgaucccaauggcgacguacggauggaaccuugugaaacugcacucuggcaaggacgucuuuuucaccccucccgagaaaugugauacucuacucugcgacauaggcgaguccucaccaaaucccacaaucgaagaggggagaacccugaggguguugaagaugguugaaccuuggcugcggggaaaccaauuuuguauuaagauccucaauccguacaugcccagcguaguggagacucuugagcagaugcagcgcaaacaugguggcaugcuggucagaaacccauuaucgagaaauucuacacacgaaauguauugggugaguugcgggaccggaaacauuguuuccgcugugaauaugacgagccgaaugcuguugaaccgguucaccauggcacaccguaagccuacauacgagagagaugucgaccucggcgccgguacucgccauguggcuguagaacccgagguggccaaccuggauaucauugggcagaggaucgaaaauauaaaacacgagcauaagucaaccuggcacuaugacgaggauaacccuuacaaaacaugggcauaucauggauccuacgaaguuaagccaucuggcagcgccaguuccauggucaauggcguggugaagcuacuuacuaaacccugggacgucauuccuaugguuacccaaaucgcuaugacagauaccacuccauuugggcagcagcggguguucaaggagaaaguagacacgagaacacccaaggcgaaacgcggaaccgcccaaaucauggaagugacugcaagguggcugugggguuuucucagccgaaacaagaagccgcggauuuguaccagagaggaguucacaaggaaaguccgcucuaaugcugccauaggcgcaguguuuguugacgagaaccaguggaacucagccaaggaggcuguggaagaugagcguuucugggaccugguccagaaagaacgggaguugcacaagcaggggaaaugcgccacgugcguguauaacaugaugggaaagagagaaaagaaacugggcgaguuugguaaggcgaaagggaguagggcaaucugguacauguggcucggagcccgcuuccuugaguuugaagcucugggcuucaugaaugaggaucacugguucucccgagaaaacagcuuaucuggcguagagggggagggacugcauaaguuggguuacauucuccgggacaucucgaaaauuccuggcgggaauauguaugccgaugacaccgcaggaugggauacuagaaucacagaagacgaucugcaaaacgaggcuaagauaaccgacaucauggaaccagagcacgcccuacuugcuacuucaauuuuuaaacugacauaccagaauaagguugugaggguccagcgccccgccaagaacggcaccgugauggaugugaucagcagacgggaccagagggguuccgggcaagucggaacauauggccucaauacuuucaccaacauggaagcacagcugauucgucagauggagagugagggcaucuuuuugccuucugaauuagagacgccaaaccuggcggaacgaguucucgauuggcuugagaaauacgggguggaacgccugaagagaauggccauaagcggagacgacuguguagugaaacccauugaugaccgguucgcuaccgcccuaacagcacugaaugauauggguaaggucaggaaagacaucccgcagugggagccuuccaagggcuggaacgauuggcaacaggugcccuuuugcucacaucacuuccaccagcucaucaugaaggacgggcgcgagauuguugugccauguagaaaucaggaugaauuggucggacgggcuagggugagucaaggcgccgguuggucucugcgagagacugcaugccuugggaaaagcuaugcccagauguggcagcugauguacuuucaucguagagaccuccgcuuagcggcuaacgccauauguuccgcaguaccuaucgauuggguucccaccucacggacaacuuggagcauucacgcccaucaccaauggaugaccacggaagacaugcugucuguguggaauagggucuggaucgaggaaaacccauggauggaggauaagacacauguguccaguuggggagacguucccuauuugggcaaaagagaggaccaguggugcggcagccugauugggcucaccgcucgcgccacuugggcaucgaauauccagguggcuauaaaccagguccggaggcuuaucggaaaugaaaacuaccuggauuacaugacauccaugaagcgauucaaaaaugagggugacccugaaggcgcccuaugguga

SEQ ID NO: 13956 - RNA, 9879 nt, Artificial Sequence
  derived and/or modified CDS sequence (opt3) from DENV-1__GU131789__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcugugaguggcgucuauccccugagcauaccagcaacgcucuuuguuugguacuucuggcagaagaagaagcagcggucuggcgugcugugggacacuccuucacccccagaaguggagagagccguccuugaugacgggaucuauaggauuaugcagcguggauuacugggucgcagccaggugggcguugggguauuccaagaaaacguguuucauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacaacuccaggaaccuucaagacgcccgaaggugaggucggcgcaaucgcccuggauuuuaagccugggacaucgggaagcccaauagugaaccgagaaggcaaaaucguuggucuuuaugggaauggaguggucacuaccucaggcacauacguguccgcuauugcccaggcaaaggcuagucaggagggcccccugccugagaucgaagacgagguuuuccggaaacgcaacuugaccauuauggaucuacacccggggucuggaaagacuagaagguaucugccagccaucgugcgggaagcgauaaaacgaaagcucagaaccuuaauucuggcccccacacgcgucguggcaagcgagauggcugaagcccuuaaggguaugccuaucagguaccaaacgacugcuguaaaauccgagcauaccggcaaggagaucguggaccugaugugccacgcaacauuuaccaugcgucucuugucaccaguucggguccccaauuauaacaugauuaucauggaugaagcccauuucacugacccuucuagcauagccgcuagaggguacauuaguacaagggugggaaugggcgaggcggcagccaucuuuaugaccgcuacgccgcccgguuccguggaagccuucccacagagcaaugcagucauucaggaugaggaacgcgacaucccugagcgaucuuggaacucaggguaugaguggauaacugauuuucccggaaaaacaguaugguucgugccauccauuaagaguggcaaugacaucgccaacugucugaggaaaaauggcaagcggguuauccagcucagcaggaagaccuuugauaccgaauaccagaaaacuaagaacaacgacugggacuacguggucacaaccgauauuucggagaugggggcuaauuuccgcgcggaccgugugaucgauccuagacggugccugaaacccguuauucuuaaggacggaccagaaagggugauacuagccgguccgaugccugucacaguggcaucugcugcccagcgccgaggcagaaucgggcggaaccacaauaaagagggagaucaguauauuuacaugggccagccccugaacaaugacgaggaucaugcacacuggacugaagccaagauguuguuagacaacaucaauacgccagaggguaucauucccgcucuguucgaaccugagagggaaaaguccgccgcgauagauggggaguaucgccucagaggcgaggcaaggaaaaccuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacaaaagagggagaaaggaagaaauugcggccccgcuggcuggacgcuagaacuuacucugacccucuagcccugagggaguucaaggaauuugcugcaggucggcgauccgugagcggcgaucucauucuugagaucgggaaacugccgcagcacuuaacccagagagcccaaaaugcuuuggacaaccuggucaugcuccauaauucagaacagggaggccgcgccuauaggcacgcaauggaggagcugccagauacaauugaaacccuuaugcugcucgcguugaucgccguucugacugguggggugacguuauucuuucuaaguggccggggacugggcaagaccagcauagggcuccuuuguguaauggcuuccucugugcuguuguggauggccagcgucgagccccauuggaucgcagcuuccauuauccuggaguucuuucucauggugcugcuuauuccugagcccgaccgucagagaacaccacaggauaaccaacucgccuacguugugaucggacuguuguucaugauacugacugucgcagccaaugagauggguuuacuagaaaccacaaagaaagaccugggcauugggcacguagcugugggaaaccaccaucacgcggccaugcucgauguugaccuucauccugcaucagcuuggacccuguacgccguggccacuacaaucauuacgcccaugaugaggcacaccaucgagaacacuacagcaaauauaucuuugaccgcuaucgccaaccaggcggcuauucugaugggccucgauaaggguuggccaaucaguaaaauggacauuggggucccucugcuugccuuaggcugcuauagccaggugaauccgcugacccucacagcagccgucuugaugcugguggcucauuacgcaaucauaggacccggccuacaagccaaggcgacucgcgaagcucagaaacggacggccgcagggauuaugaagaacccaaccguugauggaaucguggccaucgaccuggauccuguaguguaugacgcuaaguuugagaaacagcucggccagauuaugcuucugaucuuguguacaagccaaauacugcucaugcgaacuaccugggcccugugcgaauccauuacauuagcaaccgguccccuuacuacgcugugggaggggucuccaggaaaguucuggaauacaaccaucgcugucucaauggccaacauuuuuagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguucaacacauauaagagaucagggaucauggaaguugaccguuccgaggccaaagaaggacugaagaggggcgagacuaccaaacacgcagugagucgggguacagcuaaguugcgcugguuugucgagcgaaaucuggugaaaccugaaggcaagguaauagaucucggguguggaagaggcggguggagcuacuauugcgccggauuaaagaaagugacggagguuaagggcuacaccaaaggugggcccggacacgaagaaccgaucccaauggccacuuacggcuggaaccuggugaaacuucauucuggcaaagacgucuucuuuauuccucccgaaaagugugauacacugcuaugcgacaucggggaguccucaccaaaucccaccauugaggaaggaaggacucuccgggugcugaaaauggucgagccuugguugcgcgguaaccaauucuguaucaagauucugaauccguauaugcccagcgugguugaaacacucgagcagaugcagagaaagcacggcgggaugcuuguaaggaacccacugucgcgaaauucuacccaugagauguacugggugaguugcggaacgggcaacaucgucuccgcggugaauaugaccagccggauguuacugaaccguuuuacaauggcucacagaaaaccuacuuaugaacgcgauguugacuugggugcagggaccaggcacguggccgucgagcccgaaguggcuaaccucgauauaauuggacagcggaucgagaauaucaagcaugaacacaaaucaacauggcauuacgacgaggauaacccuuauaagacuugggccuaccacggcuccuaugagguaaaaccaucuggcagcgcaaguuccauggugaaugggguugucaagcugcuaaccaagcccugggacgugauuccuauggugacacaaauagccaugaccgauacuacgccauucggacagcagagagucuuuaaagaaaagguugacacacgcacccccaaagcuaagagggguacugcgcaaaucauggaggugaccgccaaauggcuuuggggcuuccugagccgaaacaagaagccgcggauuuguacaagagaagaguuuacgaggaaaguacgcucuaaugcagcuaucggggccguguucgucgacgaaaaccaguggaacucagcaaaggaggccguggaggaugaacguuuuugggaccucguucaucgggagagagaacugcacaaacagggaaagugcgcuaccugcguguacaacaugaugggcaaaagggagaagaaguugggugaguucgggaaagccaagggaagucgcgcgauuugguacauguggcugggcgcacgauuucucgaguucgaggcccuuggcuucaugaaugaagaucacugguuuucccgggagaacagccugucuggggucgaaggagaggguuuacauaaacugggcuauaucuugagagacauaucgaagaucccugggggaaauauguacgcugaugacacugccggcugggauacaaggauuaccgaggacgaucuccagaacgaagcacgcaucacugacauuauggagccagaacacgcucugcuagccaaaucaaucuucaaacuuacauaucaaaauaaagugguaagaguucagcggcccgcuaagaacgguaccgugauggaugucauaagcaggcgugaccagcgaggguccggacaggugggcacauacggccugaauacuuuuaccaacauggaggcccaacucauucgccagauggaaagugaggggaucuucucuccuagcgagcuggaaacgccaaucuuggcagagagaguguuagauuggcuggaaaaguauggagucgagcggcucaaaaggauggcgauuuccggugacgacuguguugugaagcccauagaugaccgcuuugccaccgcucuuacagcccugaacgauaugggcaaaguaagaaaggacaucccgcagugggaaccuucaaaaggguggaaugauuggcagcaagugcccuucugcagucaucacuuucaccagcuaauuaugaaggacggacgggagaucgucgugccauguaggaaccaggaugagcugguuggccgagcacgugugucucagggugcuggguggagccucagagaaacugccugcuugggaaaguccuacgcacaaauguggcagcugauguauuuccaucgccgggaccuuaggcuggccgcgaaugcuauuuguucagccgucccuguggauuggauccccaccagcagaacaacuuggucuauacacgcacaucaccaguggaugaccacggaggacaugcucuccguauggaaccgcguuuggaucgaagagaauccauggauggaagauaaaacacauauuaguagcuggggcgacgugcccuacuuaggcaagcgggaggaccaauggugcgggucgcugaucggauugaccgccagggcuacuugggccacaaacauucaggucgcaaucaaucaggugcgaagacugauugguaacgagaauuaccucgauuauaugaccuccaugaaacgguuuaagaacgaaucugacccugagggcgcucuuugguga

SEQ ID NO: 13957 - RNA, 9879 nt, Artificial Sequence
  derived and/or modified CDS sequence (opt3) from DENV-1__GU131790__SS-prME
agcgugaccaugcugcucaugcuuguccccacggcccuggcuuuccacuugacuacgagaggaggggaaccucauaugaucguuuccaagcaggaaagaggaaaaucuuuacuguuuaagaccucagccggugugaauaugugcacacuaauugccauggaccucggcgagcugugugaagauacuaugaccuacaaaugcccacggauaacagagaccgaaccggacgauguagacuguuggugcaaugcgacugauacaugggugaccuaugggacguguagucaaacuggagagcaccgccgagacaagcguagcgucgcucuugcaccccaugugggccuggguuuggagaccagaacagaaacuuggauguccucugagggggcauggaaacagauccagaggguugaaaccugggcccuccggcacccuggauucacagugauugcucuguuucuggcacaugccaucggcaccucgauuacgcagaagggcaucauauucauccucuuaaugcuggucacuccaucaauggcuaugcgcugcguggggauuggaagcagagauuuuguagagggucuuaguggcgccacauggguugacguggucuuggagcacggguccugugugaccacuauggcgaaggauaaacccacacuggacaucgaacuacucaagaccgaggugacgaacccugcaguccugaggaaacuuugcauugaagccaagaucucuaauaccacaacugauagccgguguccaacccaaggagaggcuacacugguugaagaacaagacgccaacuucgugugccgccgaacuuuuguagauagaggcugggguaauggguguggauuguucggcaaaggcucccucauaaccugcgcaaaguuuaagugcgugacaaaacuggaggggaagauuguccaguacgaaaacuuaaaauauucagugaucguuaccgugcacacuggagaccagcaucaagucgguaaugagaguacggaacacggcacaaccgcuacuauuacaccccaagccccuaccaccgagauccagcugacugacuacggggcgcucacacuugauuguagcccaaggacgggacuggacuucaacgaaaugguguugcuaaccaugaaggagaaaucuuggcugguacauaagcagugguuucucgaucugccgcuucccuggacuuccggcgccucaacaagccaagagaccuggaaucggcaggaccuguugguuacauucaaaacugcacacgcuaagaagcaggaaguggucgugcucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugucauguguaccggaucguucaaacuggagaaggaaguggccgagacgcagcacgguacaguucuugugcagauaaaguacgagggcaccgacgcuccuugcaaaaucccauucucgacucaagaugaaaaggggguaacacagaacggacgcuugauuaccgcgaaucccaucgucacugacaaagagaagccugugaacauagaagcagagccacccuuuggcgagucuuauauuguuaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguguuuacguccgucgggaaacuugugcaucagauuuucggaaccgcauacggcguacuguuuucuggugugagcuggacuaugaagauagggaucggcguuuugcucacauggcugggauuaaauucacgaaguaccucccugagcaugacauguauugcggucggccuagugacucucuaccugggggugaugguccaggcugauucuggaugcguuaucaacuggaaaggccgcgaacuuaagugugguucagggaucuucgugaccaaugaggugcacacguggacagaacaauauaaguuucaggccgacaguccgaaaagauugagcgcagccauuggaaaggcuugggaggagggcguaugcgguauaagguccgccacccggcuggaaaacaucauguggaaacagauuucuaacgagcucaaucauauccuguuagaaaacgacaugaaguucacugucgugguuggcgauguggcagggauucuggcucagggcaagaagaugauccgcccucaacccauggaguacaaauauucguggaaguccuggggcaaggccaaacuuauaggggcggacguccagaauaccacauuuaucauugauggaccaaacacuccugaaugucccgacgaucagagagccuggaauaucugggagguggaggacuacggcuucgguauuuuuaccacaaacaucugguugaagcucagggauagcuauacgcagguuugcgaccaccgucugaugucagcugcaauaaaagauaguaaggccgugcacgcugacaugggguacuggauugaaucugagaaaaaugaaaccuggaagcuagcccgggcauccuucaucgagguaaagacuuguauuuggccaaaaucccauacacuguggucaaacggaguccucgaaagcgagaugaucauacccaagaucuauggcgguccuauuucucaacacaauuaccgaccaggcuacuucacccagacugcggggccguggcaucugggaaaacuugaguuggauuuugaccugugcgaaggcacaaccgugguggucgaugagcacugcgggaacagaggacccuccuuaaggacgacuaccguuacaggcaagaucauucacgaaugguguugccgcaguuguacccucccuccacugcgguucagaggugaggacgggugcugguauggaauggagaucaggcccgugaaagaaaaggaggaaaaucuuguaaagagcauggugucugccggcuccggugaggucgacucauuuagucugggcuugcucuguauaagcauuaugaucgaagaggugaugcgcucgcgauggucccggaaaaugcugaugacugggacacuagcuguuuucuuucugcucaucaugggacagcugaccuggaacgaucuuauucguuugugcaucauggugggcgccaaugcaucugacagaauggggaugggaacaacuuaccuggcuuuaauggccaccuucaagaugaggccuauguuugcagucggccuccuguuccgccggcuuacgagcagagaggugcugcuacucacaauuggucugucauugguugccaguguggaacugccaaacuccuuagaggaacucggggauggacuggcuaugggcauaaugauccuuaaacuguugaccgacuuucaaucucaucagcucugggcgacucugcuaagccugaccuucauuaagacaacuuuuucccuucacuaugccuggaaaaccauggcaaugguccucucaaucguaagccuguuccccuugugucugaguacgacaucucagaagaccacuugguuaccggugcuccugggcucccuugggugcaagccucugacaauguuuuugauugcugagaauaaaaucuggggaaggcgaagcuggccacucaacgaagguauaauggccguuggcaucgugucgauucugcuaucaucucugcuuaagaacgaugucccccucgccgggccucugaucgcuggaggcauguugauugcauguuacgugaucagugguuccagcgccgacuuaucucuggagaaagcggcugagguaagcugggaagaggaagccgagcauuccggggcaucacacaauauacucguggaaguccaggaugacggaaccaugaagauuaaagaugaggagcgcgacgauacucugacaauccuucugaaggccaccuugcuagcuguuaguggcguguauccccugagcaucccagcaacacucuucgugugguacuucuggcagaagaagaagcagcggucuggcguccugugggacacuccuucacccccagaaguggagagagccguucuugaugacgggauuuauaggauaaugcagcguggauuacugggucgcagccagguaggcgugggggucuuucaagaaaacguguuccauaccauguggcacguuacacggggagcggugcucauguaccagggcaaaagauuggagccgaguugggcuagcgucaagaaagaccugaucuccuacggugggggauggaggcuccagggcucuuggaauaccggcgaggaagugcagguaauugccgucgagccugggaagaaccccaaaaaugugcaaacagcaccaggaacuuuuaagacccccgaaggugagguuggcgccaucgcucuggauuucaagccugggacgucgggaagcccaauugugaaccgagaaggcaaaaucgucggucuuuaugggaauggagugguuacaacuucaggcaccuacguguccgccauagcacaggcuaaggccagucaggagggcccccugccugagaucgaagacgaggucuuucggaaacgcaacuugacaauuauggaucuacacccggggucuggaaagaccagaagguaucugccagcgaucgugcgggaagccauuaaacgaaagcucagaacuuuaauccuggcacccacccgcguaguggcuagcgagauggccgaagcucuuaaggguaugccuauaagguaccaaacaacggcaguuaaauccgagcauacuggcaaggagauugucgaccugaugugccacgccaccuucacaaugcgucucuugucaccagugcgggugcccaauuauaacaugaucaucauggaugaagcccauuuuaccgacccuucuagcauugcugcgagaggguacaucaguacuagggucggaaugggcgaggcagccgcuauauucaugacagccaccccgcccgguuccguagaagcauuuccacagagcaaugccgugauucaggaugaggaacgcgacaucccugagcgaucuuggaacucaggguaugaguggauuacggauuuccccggaaaaacuguuugguuugugccauccaucaagaguggcaaugacauagcuaacugucugaggaaaaauggcaagcgggucauucagcucagcaggaagacauucgauaccgaauaccagaaaaccaagaacaacgacugggacuacgugguuacuacagauaucucggagaugggggcgaauuuccgcgccgaccgugugaucgauccuagacggugccugaaacccgucauucuuaaggacggaccagaaagggugauccuagcagguccgaugccuguaaccguggcuucugccgcacagcgccgaggcagaauugggcggaaccacaauaaagagggagaucaguauauauacaugggccagccccugaacaaugacgaggaucaugcccacuggacagaagcuaagauguuguuagacaacaucaauacuccagaggguauuauccccgcccuguuugaaccugagagggaaaaguccgcggcaaucgauggggaguaucgccucagaggcgaggccaggaaaacguucguugaacugaugcggcguggagaccuuccagucuggcugagcuacaagguggcuucagagggcuuucaauauagugaucgccgauggugcuucgacggggaaagaaacaaucaggugcucgaggaaaacauggaugucgagauuuggaccaaagagggagaaaggaagaaauugcggccccgcuggcuggacgccagaacauacucugacccucuagcucugagggaguuuaaggaguucgcagccggucggcgauccguuagcggcgaucucauacuugagaucgggaaacugccgcagcacuuaacucagagagcucaaaaugccuuggacaaccuggugaugcuccauaauucagaacagggaggccgcgcauauaggcacgcgauggaggagcugccagauaccauugaaacacuuaugcugcucgccuugaucgcuguacugaccgguggggugacuuuauuuuuccuaaguggccggggacugggcaagacgagcauugggcuccuuugugucauggccuccucugugcuguuguggauggcaagcguugagccccauuggaucgcugccuccauaauccuggaauuuuuccucauggugcugcuuauuccugagcccgaccgucagagaaccccacaggauaaccaacucgcauacgucguaaucggacuguuguuuaugauucugacaguggccgcuaaugagauggguuuacuagaaacuaccaagaaagaccugggcaucgggcacguugcgguggagaaccaccaucacgccgcaaugcucgaugucgaccuucauccugcuucagccuggacacuguacgccguggcaaccacuauaauuacacccaugaugaggcacacgaucgaaaacaccacugcuaauauuucuuugacagccaucgcgaaccaggcugccauacugaugggacucgauaagggcuggccaaucaguaaaauggacauuggugucccucugcuugcauuagggugcuauagccaggugaauccgcugacccucaccgccgcuguuuugaugcugguggcacauuacgccaucauuggccccggacuacaagcgaaggcuacacgcgaggcccagaaacggacugcagccggcaucaugaagaacccaacgguagaugggauaguggcuauugaccuggauccugucguuuaugacgccaaguucgaaaaacagcucggacagaucaugcuucugaucuuguguaccagccaaauucugcucaugcgaacaacuugggcacugugcgaguccaucaccuuagcuacaggcccccuuaccacucugugggaggguucuccagggaaguuuuggaauacgacaauagccgugucaauggcgaacauuuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguaucauggaggucgaccguuccgaagcaaaagaggggcugaagaggggagagacaacuaaacacgcugugagucggggcaccgccaaguugcgcugguucguagaacgaaaucuggugaaaccugaggguaagguuauugaucucggcugugggagaggaggcuggagcuacuauugcgccggguuaaagaaagugacagaagucaagggauacacgaaaggcggucccgggcacgaggaaccgaucccaauggcgaccuacggauggaaccuggugaaacuucauucuggcaaagacgucuuuuucauaccucccgagaagugugauacucugcuaugcgacaucggcgaguccucaccaaaucccacaauugaagaggggaggacccuccgggugcugaaaaugguugaaccuugguugcgcggaaaccaauuuuguaucaagauucugaauccguauaugcccagcguaguggagacucucgagcagaugcagagaaagcacgguggcaugcuugucaggaacccacugucgcgaaauucuacacaugaaauguacugggugaguugcgggaccggaaacaucguuuccgcugugaauaugacgagccggauguuacugaaccguuucaccauggcacacagaaaaccuacauaugagcgcgaugucgacuugggcgccgguacuaggcacguggcuguagaacccgagguggccaaccucgauauuaucgggcagcggauagaaaauauuaagcaugagcacaaaucaaccuggcauuacgacgaggauaacccuuauaagacaugggcauaccacggauccuaugaaguuaaaccaucuggcagcgccaguuccauggucaauggcguggugaagcugcuaacuaagcccugggacgucaucccuaugguuacccaaaucgcuaugacagauaccacuccauuugggcagcagagaguguucaaagagaagguagacacgcgcacacccaaagcgaagaggggaaccgcccaaauuauggaagugacugcaaaauggcuuugggguuuucugagccgaaacaagaagccgcggauauguaccagagaggaguucacaaggaaaguccgcucuaaugcugccaucggcgcaguguuuguugacgagaaccaguggaacucagccaaggaggcuguggaagaugagcguuucugggaccucguccaucgggaaagagagcugcacaaacaggggaagugcgccacgugcguguacaacaugaugggaaaaagggaaaagaaguugggcgaguuugguaaagcgaaggggagucgcgcaauuugguacauguggcugggagcccgauuccucgaguucgaagcucuuggcuuuaugaaugaggaucacugguucucccgggaaaacagccugucuggcguagagggggagggauuacauaaacuggguuauaucuugagagacauuucgaagaucccuggcgggaauauguacgccgaugacaccgcaggaugggauacuaggauaacagaagacgaucuccagaacgaggcucgcaucaccgacauuauggaaccagagcacgcccugcuagcuaaaucaaucuuuaaacuuacuuaucaaaauaaaguugugagaguccagcggcccgccaagaacggcacagugauggaugugauuagcaggcgugaccagcgagguuccgggcaggucggaaccuacggccugaauacauucacuaacauggaagcacaacucauccgccagauggagagugagggcauauuuucuccuagcgaacuggagaccccaaacuuggcggaaagaguuuuagauuggcuggagaaguauggggugaaacggcucaagaggauggccauuuccggagacgacuguguagugaaacccaucgaugaccgcuucgcuacggcccuuaccgcacugaaugauauggguaaggucagaaaagacaucccgcagugggaaccuucaaagggcuggaacgauuggcagcaagugcccuuuugcagucaucacuuccaccagcuaauuaugaaggacgggcgggagauaguugugccauguaggaaucaggaugagcuggucggacgagcucgugugucucagggcgccgguuggagccucagagaaacagcaugcuuggggaaauccuacgcccaaauguggcagcugauguauuuucaucgccgggaccuuaggcuggcggcuaacgccaucuguucagcaguaccuguugauuggauucccacuagcagaaccacauggucuauccacgcccaucaccaguggaugacuaccgaggacaugcucuccguguggaaucgcgucuggauugaagagaacccauggauggaagauaagacgcauaucaguagcuggggagacgugcccuacuuaggcaaacgggaggaccaauggugcggcucgcugauaggguugacagcuagggccaccugggcaacuaauauccagguugcuauuaaccaggugcgaagacugaucggaaaugagaacuaccucgauuauaugacauccaugaagcgguucaaaaaugaaucugacccugagggugcccuuugguga

SEQ ID NO: 13958 - RNA, 9879 nt, Artificial Sequence
  derived and/or modified CDS sequence (opt3) from DENV-1__GU131791__SS-prME
agcgugaccaugcugcucaugcuuaugcccacggcacuggcuuuccacuugacuacgcggggaggggaaccucauaugaucgucuccaagcaggaaagggggaaaucuuuacuguuuaagaccucagccgguguuaacaugugcacacuaauugcaauggaccucggagaacugugugaagauacuaugaccuacaaaugcccacggauaacagaaaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggccagcuucauugaggugaagacuuguaucuggccaaaaucccauacacuauggucaaacggaguacuggaaagcgagaugauaauccccaagauuuauggcgguccuaucucucaacacaauuaccgaccaggcuacuucacccaggcggccgggccguggcaucucggaaaacuggagcuugauuuugacuugugcgaaggcacuacagucgugguggaugagcacugcgggaacagaggacccucccugaggaccacgacugucaccggcaagauuauccacgaaugguguugccgcaguuguacauuaccuccacuccgguucagaggugaggacgggugcugguauggaauggagauaaggcccguuaaagaaaaggaggaaaaucugguaaagagcaugguaucugcuggcuccggugagguggacucauuuagucuuggccuguuguguauuagcaucaugaucgaagaggucaugcgcucgcgauggucccggcguaugcucaugaccgggacucuggccguguucuuucuacugauuaugggacagcucacauggaacgaucugaucagacuuugcauuaugguuggcgcaaaugcuucugacaggauggggaugggaaccacauacuuggcccugauggcaacuuucaaaaugcgcccuauguuugccgugggcuuacucuuccggagacugaccagcagggagguccuucugcuaacgauaggucucucacugguggcuaguguugaauugccaaacucccuggaggaauuaggggauggacucgcgaugggcaucaugauucugaaacuucugacagacuuucaaucucaucaguugugggccacccuccugagccuaacuuucaucaaaaccacauuuucccugcacuaugcauggaagacuauggcuauggugcuuucaauugucagccucuucccccuguguuugaguaccacgucucagaaaacaaccuggcugccgguauuacucggcucccuggggugcaagccucuuacuauguuucugaucgccgagaauaagauauggggacgacgcagcuggccauugaacgaagguaucauggccgugggcauuguuucgauccuccugucaucucuacugaaaaacgaugugccccuugcugggccucucauugcaggaggcaugcugaucgccuguuacgucauaagugguuccagcgcggacuugucuuuagagaaggcugccgaggugagcugggaagaggaagcagagcauuccggggccucacacaauauucugguagaagugcaggaugacggacccaugaaaaucaaggaugaggagcgggacgauacacucaccauccugcuuaaagcuacucuguuggcagucaguggcguuuauccacuaagcauuccugccacacuguucgugugguacuucuggcaaaagaaaaagcagagaucuggcgugcucugggacacccccuccccaccggaagucgagagggcggugcuggaugacgggauauaucguaucaugcagcgcggacuuuuaggucggucacagguuggcguagggguguuucaagaaaacgucuuccauacgauguggcacgugacuagaggagcuguucugauguaccagggcaagaggcucgagccuaguugggccagcgugaaaaaggacuugauuuccuacggugggggauggcgacugcagggcucuuggaauaccggcgaggaaguccaggugaucgcaguagagcccgggaaaaacccaaagaauguccaaacagcccccggaaccuuuaaaacaccugaaggugaggugggcgcuauugcccucgauuucaagccagggacuucgggaagccccaucguuaaccgggaaggcaagauagugggucuguaugggaauggagucgugaccacgucaggcacauacguuuccgcaaucgcucaggccaaagcgagucaggagggcccucuuccggagauugaagacgagguguuucgcaagagaaaccugacuaucauggauuugcacccagggucuggaaaaaccaggcgguaucuacccgccauuguccgagaagcaaucaagagaaaacugcgcacacucauauuagcuccuaccagggugguagccagcgagauggcugaagcacugaaggguaugccaauucguuaccaaacuaccgccgugaaguccgagcauacaggcaaagagaucguugaccuuaugugccacgccacguucacuaugcggcugcucucacccgucagagugccuaauuauaacaugaucauuauggaugaagcucauuuuaccgacccgucuagcaucgcggcaaggggguacauaaguacacgcgugggaaugggcgaggccgcugccauuuucaugaccgcaacucccccagguuccgucgaagccuuuccucagagcaaugcuguaauccaggaugaggaacgagacauucccgagagaucuuggaacucaggguaugaguggaucacagauuucccaggaaagaccgugugguuuguuccuuccauaaaaaguggcaaugacauugcgaacuguuugcggaagaauggcaaaagggugauccagcugagccgcaagacguucgauacugaauaccaaaagaccaagaauaacgacugggacuacgucgugaccaccgauaucucggagaugggggccaauuuccgugcagacagaguuauugauccccggaggugccucaagccagugauccugaaagacggaccggaacgcgucauucuugcugguccuaugcccgugacuguagccucugcagcccagcgaagaggccggauagggaggaaccacaauaaggagggagaucaguauaucuacaugggccagccacuaaacaaugacgaggaucaugcucacuggacagaagccaaaaugcuguuggacaacauuaauacccccgaggguaucaucccugcguuauuugaaccagagcgcgaaaaguccgcagccauugauggggaguauagacugaggggcgaggcucggaagacauucguggaacucaugcgucgcggagaccugcccguuuggcuuagcuacaaagucgccucagagggcuuucaauauagugaucgaagauggugcuucgacggggaaaggaacaaucaggugcuggaggaaaacauggauguggagauauggacuaaggagggagaacggaaaaagcuccgcccuagaugguuggacgcuaggacguacucugacccgcuggcacuacgggaguuuaaagaguucgccgcuggucgaagauccgucagcggcgaucugauccucgagauugggaaacuuccacagcaccugacccagcgcgcccaaaaugcauuagacaacuugguuauccugcauaauucagaacagggaggcagggcguaucggcacgccauggaggagcuccccgauacaauugaaacucugaugcuucuggcucucaucgccguguugaccggugggguaacacuguuuuucuuaaguggccguggacuaggcaaaaccagcauagggcugcucugugugauggcauccucuguccuucuguggauggcuagcguggagccucauuggaucgccgcauccauuaucuuggaauuuuuccugaugguucuccugauucccgagccagacagacagaggacuccucaggauaaccaacuugccuacguggucaucggacuccuguuuaugauauugacgguagcugcgaaugagaugggucuguuagaaaccacaaagaaggaccuaggcauugggcacguggccguugagaaccaccaucacgcagcuaugcuggauguggaccuccaucccgccucagccuggacucuuuacgcagucgcuaccacaaucauuaccccaaugaugcgccacacuaucgaaaacacaacggccaauauaucucugaccgcgaucgcuaaccaggccgcaauuuugaugggacuggauaaaggcuggccuaucaguaagauggacauuggugugccgcuccuggcccuugggugcuauucgcaggucaaucccuuaacucugacagcugcagugcucauguugguugcccauuacgcgaucauaggcccaggacugcaagcuaaagccacccgggaggcacagaagcgaaccgccgcuggcauuaugaaaaacccuacaguggaugggaucguagccaucgaccuagaucccguggucuaugacgcaaaguucgaaaagcagcugggacagauuaugcuccuuauccuguguacuagccaaauauugcugaugagaacgaccugggcucucugcgaguccauuacacuggccacuggcccauuaaccacacuuugggaggguucuccugggaaauuuuggaauaccacuaucgcgguuucaauggccaacauuuucaggggaagcuaccuggcaggcgcuggucucgccuucucccuaaugaagagucugggcgggggacgccggggcacgggggcacagggagaaacauugggcgagaaauggaagagacagcugaaucagcucucuaaaagcgaauuuaacaccuauaagcguucagguaucauggagguggacagguccgaagcuaaggaggggcuuaaacggggagagacuaccaagcacgccgucagucgcggcacagccaaacugcgaugguucguggaaagaaauuugguaaagcccgaggguaaagugauagaucugggcugugggaggggaggcuggagcuacuauugcgcggggcucaagaagguuacugaagugaaaggauacaccaagggcgguccggggcacgaggaaccaaucccuauggcuacauacggauggaacuuagucaaacugcauucuggcaaggacguguuuuucauucccccagagaaaugugauacgcuucugugcgacaucggcgaguccucacccaauccuaccauugaagaggggcggacucuacgcguccucaagaugguggaaccguggcugagaggaaaccaauuuuguaucaaaauuuugaaucccuauaugccaagcguuguagagacacuggagcagaugcagaggaagcacgguggcaugcucgugcgaaacccucuuucgagaaauucuacccaugaaauguacugggucaguugcgggacuggaaacaucguguccgcaguuaauaugacaagccguaugcuguuaaacagauucaccauggcccaccgcaagcccacguaugagagggauguggaccugggcgcugguacccggcacgucgccguggaaccugagguagcaaacuuggauauaauugggcagagaaucgaaaauaucaaacaugagcacaagucaacauggcauuacgacgaggauaacccauauaaaacuugggccuaccacggauccuaugaagugaagcccucuggcagcgcuaguuccaugguuaauggcgucgugaaacuccugaccaagccuugggacgugauuccaauggucacacaaauagcgaugacugauaccacacccuuugggcagcagcgcguuuucaaggagaaaguggacaccaggacuccgaaggccaaacgaggaacggcacaaaucauggaaguaacagcuaaguggcuaugggguuuucuuagccggaacaaaaagccuagaauuuguaccagggaggaguucacucgcaaggugcguucuaaugccgcaaucggcgccgucuuuguggacgagaaccaguggaacucagcuaaagaggccguugaagaugagcgguucugggaccuggugcauagagaaagggagcuccacaagcaggggaaaugcgcgaccugcgucuacaacaugaugggaaagcgcgagaaaaagcugggcgaguuugguaaggcaaaagggagucgagccauuugguacaugugguugggagcucgguuccuggaguucgaagcccucggcuuuaugaaugaggaucacugguucuccagagaaaacagccuuucuggcguggagggggagggacugcauaaguuagguuauauccugagggacauaucgaaaaucccaggcgggaauauguacgcagaugacacagcuggaugggauacgcgcauuaccgaagacgauuugcagaacgaggccagaaucacugacauuauggaacccgagcacgcucuccuggccaagucaaucuuuaaacuaacauaucaaaauaagguaguucgggugcagaggccugccaaaaacggcaccgucauggaugugauaagccgucgagaccagcgcgguuccggacaggugggaacuuacggccuuaauacauucaccaacauggaagcgcaacugauuagacagauggagagugagggcaucuuuucuccaagcgaacucgagacacccaaccuggccgaacgggucuuggauugguuagagaaguaugggguugaaaggcugaagcgcauggcuaucuccggagacgacugugugguaaaaccgauugaugacagauucgccacugcacucaccgcucuuaaugauauggguaaggugcggaaagacauaccucagugggagcccucaaagggcuggaacgauuggcagcaagucccauuuugcagucaucacuuccaccagcugaucaugaaagacgggagggagauugugguuccuugucgaaaucaggaugagcuagugggacgugccagagucucucagggcgcagguuggagccugcgcgagacggccugccucgggaaguccuacgcgcaaauguggcaguugauguauuuucaucggagggaccugagacuugcugccaacgcaaucuguucagccgugcccguagauuggauuccaaccagccgcacaacuuggucuauccacgcucaucaccaguggaugaccacagaagacaugcuguccguuuggaaucggguguggauagaggaaaaccccuggauggaggauaagacucauaucaguagcuggggagacgucccuuaccucggcaaaagggaggaccaauggugcggcucguuaauugggcugaccgcccgagcaacgugggcuacaaauauccagguggccauuaaccagguuagacgguugaucggaaaugaaaacuaccuggauuauaugaccuccaugaagagguucaaaaaugagucugacccagaaggugcgcucugguga

SEQ ID NO: 13959 - RNA, 9879 nt, Artificial Sequence
  derived and/or modified CDS sequence (opt3) from DENV-1__GU131792__SS-prME
agcgugaccaugcugcucaugcuuaugcccacagcacuggcuuuccacuugacuacgagaggcggggaaccucauaugaucgucaccaagcaggaaaggggaaaauccuuacuguuuaagacaucugccgguguuaacaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguagcguggcccuugcaccccaugucggccuggguuuggagaccagaacagaaacuuggaugagcuccgagggggccuggaaacagauccagaggguggaaccuugggcucuccggcacccaggauucaccguuauugcacuguuucuggcccaugcuaucggcacaucuauuacccagaagggcaucauauucauccucuuaaugcuggugacgcccucgauggccaugcgcugcgucgggauuggaucaagagcguuuguggagggucuuagcggcgcaacuuggguagauguuguguuggagcacgggaguugugucacaaccauggccaaggacaaaccuacucuggauaucgaacuacucaagacagaggugaccaacccagcugugcugaggaaacuuugcauugaagccaagaucuccaauacgaccacagacucucggugucccacucaaggagaggcaacccugauggaagaacaagaugcuacauucgucugccgccgaacuuuuguugacagaggcugggguaacggguguggauuguucggcaaaggcagccucauaaccugcgccaaguuuaagugcgugacaaaacuggaggggaagauuguacaguacgaaaauuuaaaauauuccgugaucgucaccgugcacacuggagaucagcaucaaguugguaacgagucaacggaacacggcacaaccgcgacuauuaccccucaggccccaacaagugagauccagcugccggacuacggggcacucacccuugacuguagccccaggacuggacuggauuucaaugaaaugguguugcuaacaaugaaggagaaaucuuggcugguccauaagcagugguuucucgaccugccucuuccauggacguccggcgcuucaaccagccaagagacuuggaaccggcaggaucuguuggugacauucaaaaccgcccacgcuaagaagcaggaaguaguugugcucgguagucaagagggggccaugcacacaggccugacuggagcaaccgaaauccagacgucuggcaccacaacuauuuuugccgggcauuuaaaaugccgucugaagauggacaaacuaacccucaagggaauguccuaugucauguguacagguagcuucaaacuggagaaggaaguggcugagacucagcacggcaccguccuugugcagauaaaguacgaggggacggaugcgcccugcaaaaucccuuucucgacacaagacgaaaagggaguuacccagaauggccgcuugauuacugcaaacccaaucgugacagauaaagagaagcccguaaauauagaagccgagccgccuuuuggugagucuuauauugucaucggggcuggcgaaaaagcccugaagcucuccugguucaagaaaggaucaaguaucggcaagauguuugaggcaaccgccagaggggcuaggcggauggccauucugggagacacugcaugggauuucgguagcgugggcgggguuuuuaccuccgugggaaaacuuguccaucagaucuucggcacagcguacggugugcuguuuucugggguaagcuggacgaugaagauuggcauaggaguguugcucaccuggcugggcuuaaacucacgaaguacuucccugagcaugacauguaucgcuguugggcuagucacccucuaccugggagugauggugcaggccgacucuggcugcgucauuaauuggaaaggucgcgaacuuaagugugggucaggaaucuucggcacaaacgagguucacacuuggaccgaacaauauaaguuucaggcagauagucccaaaagauugagcgccgcuaucgguaagccaugggaggagggcgugugcgggauuagguccgccacgcggcuggaaaauauaauguggaaacagaucucuaacgagcucaaccauauucuguuagaaaaugacaugaaguucacagugguagucggagacgugguuggcauccuggcacaggggaaaaagaugauucgcccucaacccauggagcacaaauacucguggaaaagcuggggaaaggcuaagaucauaggcgccgaugugcagaacaccacuuuuaucauugacgguccaaauacccccgaauguccugaugaccagagagcguggaacaucugggaggucgaggauuauggguucggaauuuuuacaacuaauaucuggcuuaaguugagggacucccacacccaggugugcgaucaucgucucauggccgcugcaauaaaagaccggaaggccguucacgcugauaugggcuacuggauugaaucagagaaaaacgaaccauggaagcuggcccgagcaaguuucaucgaggugaagacauguauuuggccgaaaucucauacgcuauggagcaaugguguacuggaauccgagaugaucauacccaagaucuauggcgggccuauuucacaacacaacuacagaccaggauauuucacccagacugcgggccccuggcaccucgggaaacuggagcuugacuuugauuugugcgaaggaacaaccgucgugguggacgagcauugcggcaauagggguccuagccugcgcacuacaaccgucacggggaagaucauucacgaaugguguugccggucuuguacuuuaccaccccucagauucaaaggagaggauggcugcugguacgguauggagaucaggccgguuaaggaaaaggaggaaaaccuggugaaauccaugguaagugccggcagcggggagguggacucuuuuucccuuggacuguuguguauaucaauuaugaucgaagaggucaugcgcagucgauggagccggaagaugcucaugaccggcacacuggcuguguuccuacugcucaucauggggcagcugaccuggaaugaccuuauucguuugugcaucaugguuggagccaacgcaucggauagaaugggcauggguacuacauaccuggcuuuaauggccaccuuuaaaaugaggccuauguucgcaguggggcuccuguuucgccggcuuacauccagagagguccugcuacucacuauuggacugucuuugguggccagcguugaacugccaaauucauuagaggaacucggcgacggccuggcuauggggauaaugauccuuaagcuguugaccgauuuccaaagucaucagcucugggcgacgcugcuaucccugacauuuauuaaaaccacucuuucucuccacuaugccuggaagaccauggcaauggugcugagcaucgucuccuuguucccccuguguuuaucaacaacuagccagaagaccacguggcucccuguacugcuuggaagucuggguugcaaacccuugacaauguuucucauuaccgagaacaagaucuggggcaggaaaucuuggccacugaaugaagggauaauggcugugggaguuguguccauccuacugagcucgcuucucaagaacgacgucccucuggccggccccuugauugccggugggauguuaaucgcuuguuacgugauuucaggaucuagugcagaucugucccucgagaaagccgcggagguaagcugggaagaggaagcugagcauucuggcgccagccacaacauccugguggaaguccaggacgauggcacuaugaagauaaaagacgaggagcgagaugacacacuuaccauucuguugaaggcaacucuacuggccguuuccgggguguauccacucucaaucccggcuacacuguucgugugguacuuuuggcaaaagaaaaagcagcgcaguggaguccuuugggauaccccuagucccccagaaguggagcgggcaguuuuagacgaugguaucuauagaauuaugcagaggggccugcucgcccguucucagguaggggugggagucuuccaagaaaauguguuccacacgauguggcauguuacucgcggcgcgguguugauguaccaggguaaacggcuggagcccuccugggcuucagucaagaaagaccucauaaguuaugggggaggcuggagacugcagggcagcuggaacaccggggaggaagugcagguaaucgccgucgagccuggaaagaauccaaagaacgugcaaacagcacccgguaccuuuaaaacaccugaaggcgagguuggggccauugcucuugacuucaagccgggaacuuccggcucuccaaucgugaauagggaagguaaaauugucgggcuguacggaaacggcgugguuaccacgucgggcacauacgugagcgccaucgcacaggcuaaggccucacaggaggggcccuugccugagauagaagaugaggucuuucgaaaacggaaucuaacuaucauggaccugcacccaggauccgguaagacccgcagauaucuccccgcgauugugagggaagccaucaagcggaaauuacgaacacugauucuugcaccuaccagaguaguggcuagugagauggccgaagcucugaagggcaugccgauccgcuaccaaacuaccgcaguuaaaucugagcauacagggaaggagauagucgaucucaugugccacgccacguucacuaugagguugcugagccccgugcgugugccaaacuauaauaugauuaucauggacgaagcccauuuuaccgauccuuccucaaucgcugcgcggggauacauuucuacaagagucggcaugggugaggcagccgcuaucuucaugaccgccacucccccagggagcguagaagcauuuccucagaguaacgccgugauacaggacgaggaaagggauauucccgagcgcuccuggaauagcggauaugaguggaucacagacuucccaggcaaaaccguuugguuugugccgucuauuaagucaggcaacgauaucgcuaauugucuccgaaagaacgggaaaagagucauacagcugucccggaagacguucgacacugaauaccagaaaacaaagaauaacgauugggacuaugugguuaccaccgacauuagugagaugggagcgaacuuuagggccgaucgcgugaucgacccucguagaugccuuaaacccgucauccuaaaggaugguccagaacgggugauucuggcaggccccaugccuguaacuguggcuagcgccgcacagaggcgcgggcgaaucggaagaaaucacaacaaggagggcgaccaguacauuuacaugggucagccauugaauaacgaugaggaccacgcccauuggacagaagcuaaaauguuacuggauaauauaaacacccccgaggggaucauuccugcccucuucgaaccggagcgggaaaagucggcggcaaucgacggcgaguauaggcugcgcggagaggccagaaaaacauucguugaacuuaugaggcggggcgaucugccagucuggcucucuuacaagguggcuuccgagggguuucaauauagcgaccgucgcuggugcuucgauggagaacgaaauaaccagguguuggaggaaaauauggacgucgagaucuggacuaaagagggugaaagaaagaaacugaggccccgguggcuagaugcccgcacguacucagacccucuggcucucagagaguuuaaggaguucgcagccggcaggcggaguguuucuggggaccuuauucuggagauaggaaaguuaccccagcacuugacccagcgagcucaaaacgcccuggauaaucucgugaugcugcauaacuccgaacagggcgguagagcauaucgccacgcgauggaggagcuuccagacacaaucgaaacucugaugcucuuggcccugauugcuguauuaaccgggggcgugacacuauuuuuccugagcggaaggggccucgggaaaaccucaaucggacuucugugugucauggccaguagcguguugcuguggauggcauccguugagccucacuggauugcugccucuaucauacucgaauuuuuccugauggugcuucucauccccgagccagaucggcagcguacuccucaggacaaucaacuggcauacgucguaauugguuugcuguuuaugaucuuaacgguggccgcuaacgagaugggccuacuggaaaccacaaagaaagaucucgggauuggacauguugcgguggagaaucaccaucacgccacuaugcuugacgucgaucugcauccggcaagcgcuuggaccuuguaugccguggccacaaccaucauaacucccaugaugagacacacaauugaaaacacgaccgcaaacaucucccugacugcuauugccaaucaggcggcuauccucaugggccuggacaaggguuggccaauaucaaaaauggauaucggggucccucuuuuagcccugggcugcuacucucaggugaacccccucacauugaccgcagccguucugaugcuaguggcucacuacgcaauuaucggaccaggccugcaagccaaggcgaccagggaggcucagaagcgcacagccgcagggauuaugaaaaauccuacuguagacggaaucguggccauagaucucgaccccgucguuuaugaugcuaaguucgaaaaacagcuuggccagauuaugcuguugauccuguguacgagucaaauccuccugaugcggaccacaugggccuuaugcgagucgauuacucuugcaaccgguccgcugacaacccucugggaggggagcccaggaaaguuuuggaacacuacgaucgcuguguccauggccaauauauuccgaggcucuuaccuagcgggugccggccuggcauuuucauugaugaaaagccuagggggaggcagaagggggacaggagcucagggcgaaacccucggugagaaguggaagcgccagcuuaaccagcuguccaaaagugaguucaauauuuauaagcggucugggaucauggaggucgacagaagcgaagccaaagagggauugaagcguggcgagacuaccaggcaugcagugucacgggguacagcuaaacugcgcugguucguagaacgaaaccucgugaagccugagggcaagguuauugacuuaggguguggaagaggcgggugguccuacuauugcgccggacugaaaaaggugacugaagucaaaggcuacaccaagggugggcccggacacgaggaaccaauccccauggccacauauggcuggaaucuugugaaacugcauaguggcaaggaugucuuuuucacgccuccggagaaaugugacacccuacucugcgauauaggggagagcucucccaacccaacuaucgaagagggaaggacacugcggguguugaagaugguugaaccuuggcugcgcgguaaucaauuuuguauuaagauccucaaccccuacaugccuuccguaguggagacccuugagcagaugcagagaaaacacggcgggaugcuggucaggaauccauuaucacgaaacagcacucacgaaauguacugggugucgugcggaacaggcaauauuguuucugcggugaacaugaccagucggaugcuguugaaucguuucacgauggcucauagaaagcccaccuaugagcgcgacgucgaucucggugcagggacaaggcacguggccguagaaccugagguggcuaaccuggacaucauuggacagcggaucgaaaacauaaaacaugagcacaaguccacuuggcauuacgaugaggacaauccauauaaaaccugggccuaccacggcagcuaugaaguuaagcccucaggcuccgcaucuagcauggucaacgggguggugaagcuacuuacaaaaccgugggaugucauuccuaugguuacucaaaucgccaugaccgacacaaccccauuuggacagcagagaguguucaaggagaaaguagauacucgcacgcccaaggcuaaaagggguacagcgcaaaucauggaagugaccgcccgauggcuguggggcuuucucagucggaauaagaagccuagaauuuguacuagggaggaguucacccgcaaaguccguuccaacgcagcuauaggggccguguuuguugacgagaaucaguggaacagcgcaaaggaggccguggaagacgagcgguucugggaucugguccagaaagaaagagaguugcacaagcagggaaaaugcgcuacaugcguguacaauaugaugggcaagagggaaaagaaacugggugaguuugggaaggccaaaggaucucgcgcgaucugguauauguggcucggcgcacgauuccuugaguuugaagcccugggcuucaugaacgaggaccauugguucucacgggaaaauaguuuauccgggguagagggagagggucugcacaaguugggcuacauucucagagauaucagcaaaauuccagggggaaacauguacgcugacgauacggccggcugggacaccaggaucacugaagaugaccugcaaaaugaggcaaagauaacagauaucauggaacccgagcaugcucuacuugccaccucuauuuuuaaacugacuuaucagaacaagguugugcgcguccagagaccggcuaagaaugguacagugauggacgugaucucgcggagggaucagcgugggucaggacaagucggcaccuacggccucaacacauucacuaauauggaagcccagcugauucgacagauggagagcgaggggaucuuuuugccuuccgaauuagagacccccaaccuggcagaacgcguucucgacuggcuugagaaauauggaguggaaagacugaagcggauggcgauaaguggugaugacuguguagugaaaccaauugacgauagguucgccacggcucuaaccgcccugaacgacaugggcaagguccgcaaagauaucccucagugggagcccucuaagggguggaaugacuggcaacaggugccauuuugcagccaccacuuccaucagcucaucaugaaggauggaagagagauuguugugcccugucggaaccaggacgaauuggucggcagggcacgagugucccaaggugcuggguggucacugcgugagacagccugccuuggaaaaaguuacgcacagauguggcagcugauguauuuucacagacgcgaucuccgguuagccgcgaaugcuauauguucugccguaccuguugacugggugccaacuagcaggaccacaugguccauccaugcacaccaucaauggaugacuaccgaagauaugcugucagucuggaacagaguguggauugaggaaaauccguggauggaggacaagacgcacguuagcucuuggggcgaugugcccuacuugggcaaacgcgaggaccaguggugcgggucccugaucggacucacagcccgggcuaccugggccaguaacauucaggucgcaaucaaucaggugaggcgacuuauagguaacgaaaauuaucuggacuacaugacuagcaugaagagauucaaaaacgagggcgauccugaaggggcucuaugguga

SEQ ID NO: 13960 - RNA, 9879 nt, Artificial Sequence
  derived and/or modified CDS sequence (opt3) from DENV-1__HM488256__SS-prME
agcgugaccaugcugcucaugcuuaugcccacagcccuggcuuuccacuugacuacgcgaggaggggaaccucauaugaucgucuccaagcaggaaaggggaaaaucuuuacuguuuaagaccucagccgguguuaacaugugcacauugauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcccaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacugcucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugccagacuacggggcgcucacucuugauuguagcccgaggacaggacuggacuucaacgaaauggucuugcuaacgaugaaggagaaaucuuggcuggugcauaagcagugguuucucgaucugccccuuccuuggaccuccggcgccucaacuagccaagagacauggaaucggcaggaccuguugguaaccuucaaaacagcacacgcuaagaagcaggaaguugugguccucgguagucaagagggggccaugcacacugcucugaccggcgccacggaaauccagaccucuggaacaacuaccauuuuugcaggccauuuaaaaugccgucugaagauggauaaacuaacacucaaggggauguccuaugugauguguacuggcagcuucaaacuggagaaggaacuugccgagacccagcacgguacggucuuggugcagauaaaguacgagggcacagacgcuccaugcaaaauccccuucucgacccaagaugaaaaggggguuacucagaacggacgccugauuacagcgaauccuaucgugaccgacaaagagaagccaguaaacauagaagcagagcccccguuuggcgagucuuauauugucaucggugccggggaaaaagcucucaagcuguccugguucaagaaaggcucaaguaucggaaagauguuugaggccacugcaagaggcgccaggcggauggcuauucuuggggccccugcaugggauuucggaagcaucgguggcguguuuaccuccguugggaaacuggugcaucagauuuucggaacagcguacggcgucuuguuuucuggugugagcuggacgaugaagauagggaucggcguacuccugaccugguuaggacuaaauucacgaaguacuucccuaagcaugacauguauugcugugggccucguuacccuguaccuuggggucauggugcaggccgacucuggaugcgugaucaacuggaaaggccgcgaauugaagugugguucagggaucuucgucacaaaugagguucacacuuggaccgaacaauauaaguuucaggcagauagucccaaaagacugagcgccgcuauuggaaaggccugggaggagggcgugugcgguauaagguccgcaacgcggcucgaaaacaucauguggaaacagauuucuaacgagcugaaucauaucuuacuggaaaacgacaugaaguucacagugguagucggcgacguggcugggauucuugcccagggcaagaaaaugauccgcccacaaccuauggagcacaaauacucguggaaaagcuggggcaaggcgaaaauaaucggggccgauguucagaauaccacuuuuauuaucgacggacccaacaccccagaaugucccgaugaccagagagcuuggaauauuugggagguggaggauuauggcuucgguaucuuuacaacuaacauaugguugaagcucagggacuccuacacccaggucugcgaucaccgucugaugucagcagccauuaaagacaguaaggcugugcaugccgauaugggguauuggaucgaaucugagaaaaaugaaacauggaagcuagcacgggcgagcuucauugagguuaagacguguaucugggccaaaucccacacccuguggucaaacggagugcucgaaagcgagaugauaaucccuaagauuuacggcgguccaaucucucaacauaauuaucgaccgggcuacuucacucagacagcugggcccuggcaccugggaaaacuugaguuggacuuugaucugugcgaaggcaccacuguagucguggacgagcacugcgggaacagaggaccuuccuuaaggacaaccacggugacuggcaagauuauccaugaaugguguugccgcaguuguacccucccaccccugcgguucagaggugaggaugggugcugguacggaauggagauaagcccugucaaagaaaaggaggaaaaucuuguuaagucuaugguguccgccggcucaggugagguagacaguuuuagccugggcuugcucuguauuucgaucaugaucgaagaggugaugaggucccgcuggucucgaaaaaugcugaugacagggacccuagcagucuucuuucugcucauugugggacagcugccauggaacgaccuuauccgguugugcauuaugguuggcgcuacugccagcgcacguauggggaugggaacaaccucacuggccuuaauggcuacauucaagaugagacccauguuugcggugggccuccuguucaggcgccuuacaagucgggagguccugcuacucaccauaggucuguccuugguggccucuguugaacugccgaauagcuuagaggaacucggggauggacuggcaaugggcaucaugauucuuaaacuguugacggacuuucaaucccaccagcucugggcuacacugcuaucacugaccuucaucaagacuaccuuuagccuucauuaugccuggaaaacaauggccaugggccucaguguggucucucuguucccuuugugucuguccacuaccagccagaagacgacaugguuaccaguacuccuggggucgcuuggaugcaagccccugaccauguuuuugauugcugagaacaaaaucugggguagaaggucauggccucucaaugaaggcauaauggcaguggggaucguuucuauucugcuaaguucccugcuuaagaacgaugugccccucgccggaccacugaucgcgggcgguauguugauugcuuguuacgucaucagcgggucuagcgccgacuuaucccuggagaaagcagccgaggugucaugggaagaggaagcugagcacaguggagcaagccauaacauacucguagaagugcaggaugacggcacuaugaagauuaaagaugaggagcgagacgauacacugaccauccuucugaaggccacuuugcuagcggucucuggcguuuauccucuguccauccccgcuacacucuucgugugguacuucuggcagaagaagaagcagcgcucaggggugcugugggacaccccaaguccgccugaagucgagcgggccgugcuugaugacggaauuuauagaauaaugcagagggguuuacugggccguagccagguugggguaggaguguuucaagaaaaugucuuccacacgauguggcacgugacucgcggcgcaguucucauguaccaggguaaacgguuggagcccuccugggccucugugaagaaagaucugaucucguaugggggaggcuggagacuccagggcagcuggaacaccggggaggaaguccaggugauugcuguagagccaggaaagaaucccaaaaacguccaaacagccccugguaccuuuaagacaccagaaggcgaggugggggcaaucgcucuggacuucaagcccggaacuucaggcuccccuauuguuaauagggaagguaaaaucguggggcuuuacggaaacggcgucgugaccacgaguggcacauacguuucugccauagcgcaggccaaggcaagccaggaggggccgcugccagagaucgaagacgagguguuucgaaaacggaauuugacuauuauggaucuacaucccggauccgguaagacccgcagauaucugccugcuaucgucagggaagccauuaaacggaagcuccgaacauuaauccuggcuccaaccagagugguagcaucagagauggccgaagcccuuaagggcaugcccauacgcuaccaaacuaccgcugugaaaucugagcacacagggaaggagauuguugaccugaugugccaugcgacguucacuaugaggcucuugagcccuguccgugugccgaacuauaauaugaucaucauggaugaagcacacuuuaccgaccccaguuccauugccgcucggggauacaucagcacaagagugggcaugggugaggccgcagccauauucaugaccgcuacuccaccugggucugucgaagcguuuccccagucaaacgccguaauucaggaugaggaaagggacaucccagagcgcuccuggaauaguggauaugaguggauuacagauuucccuggcaaaaccgugugguuuguucccagcaucaagucgggcaacgacauagcaaauugucugagaaagaacgggaagagagugauucagcucucucggaagacguucgauacugaauaccaaaagacuaagaauaacgacugggauuaugucgugaccaccgacaucuccgagaugggagcuaacuucagggccgaccgcguuaucgauccacguagaugccugaaaccggugauucuuaaggacgguccugaacgggucauccuagcaggccccaugccagugacuguagccagcgcugcccagaggcgcgggcgaauuggaagaaaucauaacaaagagggcgaucaguacauauacaugggucagccccugaauaacgacgaggaucacgcgcacuggacagaagcaaagauguuguuagacaauaucaacaccccugaggggauuaucccagcccuguuugaacccgagcgggaaaagucagcugccaucgauggcgaguauaggcuccgcggagaggcuagaaaaacauucguggaacugaugaggcggggcgaccuuccuguuuggcugaguuacaaggucgcaucugagggguuucaauauuccgaucgucgcuggugcuucgacggagaacgaaauaaccaggugcucgaggaaaauauggauguggagauuuggacuaaagagggugaaagaaagaaauugaggccgcgguggcuggacgcccgcacguacagcgauccacuagcucugagagaguuuaaggaguucgccgcaggcaggcggucagucaguggggaccucauacuugagaucggaaaacugccccagcauuuaacccagcgagcgcaaaacgccuuggacaaucugguuaugcuccacaacagcgaacagggcgguagagcuuaucgccaugccauggaggagcugccugauacaauugaaacucuuaugcugcucgcauugaucgcugugcugaccgggggcguaacauuauuuuuccuauccggaaggggccuggggaagaccucuauuggacuccuuugugugauggccagcuccguccuguuguggauggcaucaguggagccccacuggaucgccgcuucuauaauccuggaauuuuuccucaugguucugcuuauuccagagccugaccggcagcguacuccccaggauaaucaacucgcguacguggucaucggucuguuguuuaugauucugacgguagccgcaaacgagaugggcuuacuagaaaccacaaagaaagaccuggggaucggacacguggcuguugagaaucaucaccaugccgccaugcucgauguggaccuucacccagcaagugcuuggacucuguaugccgucgcgaccacaauaauuaccccuaugaugagacauacuaucgaaaacacaacggcuaacauuucguugaccgccaucgcaaaucaggccgcuauacugaugggccucgauaaggguuggccgaucagcaaaauggacauuggggugccccugcuugcauuaggcugcuacucccaggucaacccacugacucucacagccgcgguguugaugcugguugcucacuacgccaucauuggaccuggccuacaagcaaaggccaccagggaggcucagaaacgcaccgccgcagggaucaugaagaaucccacaguggauggaauaguagcuauugaccuggauccaguggucuaugacgccaaguucgaaaaacagcucggccagaucaugcuucugaucuuguguacuucucaaauucugcucaugcggacgaccugggcgcugugcgagucaaucacauuagccacugguccucuuaccacacugugggaggggagccccggaaaguuuuggaacaccacuauagcaguuuccauggcuaauauuuuccgaggcaguuaccucgccggugcaggccuagcuuucucucugaugaaaagccuagggggaggcagaagggggacgggagcccagggcgaaacacugggugagaaguggaaacgccagcucaaccagcuuucaaaguccgaauuuaauaccuauaagcggagugggaucauggagguggauagaagcgaagccaaagagggacugaagcguggcgagacuaccaaacacgcggucucuagggguacagcuaaguugcggugguucguggaacgcaaccugguaaaaccggagggcaaggugauugaccucggguguggacgaggcgggugguccuacuauugcgcaggauuaaagaaaguuacugaagugaagggcuacaccaaaggugggccaggacaugaggaaccuauccccauggccacauauggcuggaaucuggucaaacuucacucaggcaaagacguguuuuucauaccacccgagaagugugauacgcugcuaugcgacaucggggagagcucgccuaacccgaccauugaagagggaagaacucucaggguccugaaaaugguggaacccugguugcgggguaaucaauuuuguaucaagauucugaacccauacaugccuucuguuguagagacacucgagcagaugcagcgcaagcauggcgggaugcuugugagaaauccccugaguaggaacuccacccacgaaauguacugggucagcugcggaacuggcaauaucgugucagcuguuaacaugacaucccgaauguuacugaaucgguucaccauggcccaccguaaaccuacguaugagagagauguggacuugggugcagggacccgccaugucgccguggaaccagagguagcuaaccucgauauuaucggacagaggauagaaaacauuaagcacgagcauaaaucuacauggcacuacgacgaggauaaucccuauaagacuugggcguaccauggcagcuaugaagugaaaccuaguggcuccgccagcucuaugguuaacggggucgugaagcugcuaaccaagccaugggacgugauccccauggucacacaaaucgcaaugacugauaccacaccguuuggacagcagcggguuuucaaagagaagguggacaccagaacuccuaaagcuaagcgcgguacggcccaaauuauggaaguaacagcaaaauggcuuuggggcuuucugucaaggaauaagaagccacgaauauguacccgggaggaguucacuagaaaagugaggaguaacgccgcuaucggggccgucuuuguggaugagaaucaguggaacuccgcgaaggaggcaguugaagacgagcgcuucugggaccucgugcaccgugaacgggagcugcacaaacagggaaagugcgcaaccugcgucuacaauaugaugggcaaaagagaaaagaaguugggugaguuugggaaagcuaagggaagcagggccauuugguauauguggcugggcgcacgcuuccucgaguucgaagcucuuggcuuuaugaacgaggaucauugguucucucgagaaaauucgcugucagggguggagggagaggguuuacacaaacugggcuacaucuugcgggacauuagcaagauccccgggggaaacauguacgccgaugacacagcuggcugggauacgagaauaaccgaagacgaucuccagaaugaggccaggaucacugacauuauggaaccugagcaugcacugcuagcgaaauccaucuuuaaacuuacauaucaaaacaaaguaguucgcgugcagagaccagccaagaaugguaccgucauggaugugauuagucggagggaccagcgugggucuggacaggugggcacuuacggccugaacacauucaccaauauggaagcucaacucauccgacagauggagagcgaggggauauuuucccccucagaacuggagacaccgaacuuggccgaacgcgucuuagauuggcuggagaaguauggaguugaaagacucaaacggauggcaauuaguggugacgauugugugguaaagccuaucgacgacagguucgcuacugcccuuaccgcacugaacgauaugggcaaagugcgcaaggacaucccccagugggagccaucuaaaggguggaaugauuggcagcaagucccuuuuugcagccaccacuuccaucagcuaauuaugaaggacggaagagagauagugguucccugucggaaccaggaugaacuggugggcagggcccgagucucccagggugcgggguggucacuccgugagacggcuugcuugggaaagagcuacgcccaaauguggcagcugauguauuuucacagacgcgaccuucggcuggcagccaaugcuaucuguucugccgugccaguagauuggauucccaccuccaggacaacuuggaguauccaugcacaccaucaguggaugaccacagaagacaugcucagcguuuggaacagaguguggauugaggaaaauccuuggauggaggauaaaacucacaucucguccuggggcgacgucccauacuuaggcaagcgcgaggaucaauggugcgggucucugauaggauugaccgcucgggccacgugggcgacaaacauccagguggcuauuaaucagguuaggcgacugaucgguaacgaaaauuaucucgacuacaugaccucaaugaaaagauucaagaacgagagcgacccggaaggcgcccuuugguga

SEQ ID NO: 13961 - RNA, 9879 nt, Artificial Sequence
  derived and/or modified CDS sequence (opt3) from DENV-1__GU131793__SS-prME
agcgugaccaugcugcucaugcuuaugcccacagcccuggcuuuccacuugacuacgagaggcggggaaccucauaugaucgucuccaagcaggaaaggggaaagucuuuacuguuuaagaccucagccgguguuaauaugugcacacuaauugccauggaccucggcgaacugugugaagauacuaugaccuacaagugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgacgacucagaagggcauuaucuucauacucuuaaugcuggugacaccaucaauggcuaugcgcugcgucgggaucggaagcagagauuuuguggagggucuuaguggcgccaccuggguagacguuguguuggagcacggguccugugucacuacaauggcgaaggauaaacccacccuggacauugaacuacucaagacggaggugaccaacccugcagugcugaggaaacuuugcaucgaagccaagauuucuaauacaacuaccgauagccgguguccaacacaaggagaggcuacucuggucgaagaacaggacgccaacuucguuugccgccgaaccuuuguggauagaggcugggguaauggguguggauuguucggcaaaggcucccucaucacaugcgcaaaguuuaagugcguaaccaaacuggaggggaagauagugcaguacgaaaacuuaaaauauucagucauugugacuguucacacgggagaccagcaucaaguggguaaugagaguacagaacacggcaccacugcuaccaucacaccccaggccccuaccacugagauucagcugacagacuacggggcgcucacgcuugauuguagcccaaggaccggacuggacuucaacgaaauggucuugcuaacuaugaaggagaaaucuuggcuggugcauaagcagugguuucucgaucugccgcuucccuggacauccggcgccucaaccagccaagagacauggaaucggcaggaccuguugguaacuuucaaaaccgcacacgcuaagaagcaggaaguugugguccucgguagucaagagggggccaugcacacggcucugaccggcgccacagaaauccagacuucuggaaccacaacuaucuuugcaggccauuuaaaaugccgucugaagauggauaaacuaacccuccgcgggauguccuaugugauguguacggggagcuucaagcuggagaaagaagucgccgagacacagcacgguaccgugcuuguucagauuaaguacgagggcacugacgcuccuugcaagauaccauucucgacacaagaugaaaaaggggugacccagaacggaagauugaucacugcgaaucccauuguaaccgacaaggagaaaccugucaacaucgaagcagagccacccuuuggcgagucuuauauagugauuggugccggggaaaaggcucugaaacucuccugguucaagaagggcucaaguaucggaaaaauguuugaggccacagcaaggggcgcccggcgaauggcuauccugggggauacggccugggacuucggaagcauugguggcguuuuuaccuccguggggaaacuuguccaucagaucuucggaacugcauacggcgugcuguuuucugguguaagcuggacaaugaaaauugggauaggcguguugcucaccuggcugggauuaaauucacgcaguacaucccugagcaugacuuguaucgcgguuggccuagucacccucuaccugggggugauggugcaggcugauucuggaugcgucauuaacuggaagggcagagaacuuaaaugugguucagggaucuucguuacgaaugaggugcacacauggaccgaacaauauaaguuucaggccgacaguccgaagagguugagcgcagccaucggaaaggcuugggaggagggcgugugcgguauucgguccgccacucgccuggaaaacauaauguggaagcagaucucuaacgagcucaaucauauucuguuagaaaacgacaugaaauucaccguagucgugggcgauguugcagggauccuggcucagggaaagaaaaugauuagaccucaacccauggaguacaaguauucguggaaaagcuggggcaaggccaagaucauaggggcggacgugcagaauacaacuuuuaucauugauggaccaaacaccccugaaugucccgacgaucagagggccuggaauaucugggaggucgaggacuacggcuucgguauuuuuacaacgaacaucuggcuuaaauugcgugauuccuauacccaggugugcgaccaccggcucaugucagcugcaauaaaggauaguaaagccguucacgcugacaugggguacuggauugaaucugagaagaaugaaacuuggaaacuggcccgagcauccuucaucgaggugaagacauguauuuggccaaagucccauacccuauggucaaacggaguacuggaaagcgagaugaucauacccaaaaucuauggcgguccuauuucucaacacaauuacagaccaggcuacuucacucagacagcggggccguggcaucucggaaagcuggagcuugauuuugacuugugcgaaggcaccacggucgugguggaugagcacugcgggaacaggggacccucccugcgcacuaccacagucaccggcaaaaucauucacgaaugguguugccggaguuguacuuuaccuccacucagauucaggggugaggacgggugcugguauggaauggagauccgccccguuaaggaaaaagaggaaaaucugguaaagagcaugguaucugccggcuccggugagguggacucauuuagucuuggccuguuguguauaagcauuaugaucgaagaggucaugcgaucgcgguggucccguaagaugcucaugacagggacccuggcuguguucuuucuacugaucaugggacagcucacauggaacgaucugauuagacuuugcaucaugguuggcgccaaugcaucugacaggauggggaugggaacuaccuacuuggcucugauggccacguucaaaaugcgcccuauguuugcagugggcuuacucuuccggagacugacaagcagggagguccuucugcuaaccauuggucucucacugguggccaguguugaauugccaaacucccuggaggaauuaggggauggacucgcuaugggcauaaugauccugaaacuucugacugacuuucaaucucaucaguugugggcgacccuccugagccuaacauucauuaaaacuaccuuuucccugcacugugccuggaagacgauggcaauggugcuuucaaucgucagccucuucccccugugcuugaguacaaccucucagaaaacuacauggcugccgguauuacucggcucccugggguguaagccucuuaccauguuucugauugcugagaauaagaucuggggacgacgcagcuggccauugaacgaagguauaauggccgugggcaucguuucgauucuccugucaucucuacugaaaaacgaugugccccuugccgggccucucaucgcuggaggcaugcugauugcaugcuaugucaucagugguuccagcgccgacuugucuuuagagaaggcggcugaggugagcugggaagaggaagccgagcauuccggggcaucacacaauauacugguagaagugcaggaugacggaacuaugaaaauuaaggaugaggagcgggacgauacacucaccauccugcuuaaagccacgcuguuggcugucaguggcguuuacccccuaagcaucccagcaacucuguucgugugguauuucuggcaaaagaaaaagcagagaucuggcgugcucugggacaccccuucacccccagaagucgagagggccgugcuggaugacgggauuuaccguauaaugcagcgcggacuuuuaggucggagccagguuggcguagggguguuucaagaaaacgucuuccauacaauguggcacgugaccagaggagcgguucugauguaucagggcaagaggcucgagccgaguugggcuagcgugaaaaaggacuugaucuccuacggugggggauggcgacugcagggcucuuggaauacaggcgaggaaguccaggugauugccguagagccugggaaaaaccccaagaauguccaaacugcaccaggaaccuuuaaaacgcccgaaggugaggugggcgccaucgcucucgauuucaagccugggacaucgggaagcccaauuguuaaccgggaaggcaagaucgugggucuguacgggaauggagucgugacuaccucaggcacauauguuuccgccauagcacaggcuaaagccagucaggagggcccccuuccugagaucgaagacgagguguuucgcaagagaaaccugaccauuauggauuugcacccggggucuggaaaaacuaggcgguaccuaccagcgaucguccgagaagccauuaagagaaaacugcgcacccucaucuuagcacccacaagggugguagcuagcgagauggccgaagcucugaaggguaugccuauacguuaucaaacgacugcagugaaguccgagcauaccggcaaagagauuguugaccuuaugugucacgccacauucaccaugcggcugcucucaccagucagagugcccaauuacaacaugaucaucauggaugaagcccauuuuacugacccuucuagcauugcugcgaggggguauaucaguacacgcgugggaaugggcgaggcagccgcuauauucaugaccgccacgccgcccgguuccgucgaagcauuuccacagagcaaugccguaauucaggaugaggaacgagacaucccugagagaucuuggaacucaggguacgaguggauuacugauuuccccggaaagacagugugguuuguuccauccaucaaaaguggcaaugacauagcuaacugcuugcggaagaauggcaaaagggugauucagcugagccgcaagaccuucgauaccgaauaucaaaagacuaaaaacaacgacugggacuacgucgugacaaccgauaucucggagaugggggcgaauuuccgugccgacagaguuaucgauccucggaggugccucaagcccgugauucugaaagacggaccagaacgcgucauccuugcagguccgaugccugugacaguagcuucugccgcacagcgaagaggccggauugggaggaaccacaauaaggagggagaucaguacauauauaugggccagccccuaaacaaugacgaggaucaugcccacuggacugaagcuaaaaugcuguuggacaacaucaauacgccagaggguauuauccccgccuuauuugaaccugagcgcgaaaaguccgcggcaaucgauggggaguacagacugaggggcgaggcccggaagaccuucguggaacucaugcgucgcggagaccugccaguuuggcuuagcuauaaagucgcuucagagggcuuucaauacagugaucgaagaugguguuucgacggggaaaggaacaaucaggugcuggaggaaaacauggauguggagauuuggacaaaggagggagaacggaaaaagcuccgccccagaugguuggacgccaggacuuauucugacccucuggcucuacgggaguuuaaagaguucgcagccggucgaagauccgucagcggcgaucugauacucgagaucgggaaacuuccgcagcaccugacccagcgcgcucaaaaugccuuagacaacuugguuaugcugcauaauucagaacagggaggcagggcauaccggcacgcgauggaggagcucccagauacaauugaaacccugaugcuucuggcccucaucgcuguguugacuggugggguaacgcuguuuuucuuaaguggccguggacuaggcaaaaccagcauugggcugcucugcgugauggccuccucuguccuucuguggauggcaagcguggagccccauuggaucgcugccuccauaaucuuggaauuuuuccugaugguucuccugauuccugagcccgacaagcagagaacaccacaggauaaccaacuugcauauguggucaucggacuccuguuuaugauuuugacuguagccgcuaaugagaugggucuguuagaaaccacaaagaaagaccuaggcaucgggcacguggcgguugagaaccaccaucacgccgcaaugcuggauguggaccuccauccugcuucagccuggacccuuuacgccgucgcaacuacaauaauuacgcccaugaugaggcacaccaucgaaaacacuacagcuaauauuucucugaccgccaucgcgaaccaggcugccauauugaugggacuggauaagggcuggccaaucaguaaaauggacauuggugugccucuccuggcacuuggguguuacucgcaggucaauccguuaacccugacagccgcugugcucauguugguugcacauuaugccaucauuggccccggacugcaagcgaaggcuacucgcgaggcccagaaacggacggcagccggcaucaugaagaacccaaccguggaugggauaguagcuauugaccuagauccuguggucuacgacgccaaguucgaaaaacagcugggacagaucaugcuccuuauccugugcacaagccaaauuuugcugaugcgaacuaccugggcacucugugaguccaucacacuggcuaccggccccuuaacuacgcuuugggaggguucuccagggaaguuuuggaauacaaccauagccguuucaauggcgaacauuuucagaggaagcuaucuggccggcgcaggucucgcuuucucccuaaugaaaagucugggcgggggaaggcgcggcacuggggcccagggagaaaccuugggcgagaaguggaaacggcagcugaaucagcucucuaagagcgaauuuaacacauacaagagaucagguaucauggagguggaccguuccgaagcaaaagaggggcuuaagaggggagagacuaccaaacacgcugucagucggggcacagccaagcugcgcugguucguggaacgaaauuugguaaaaccugaggguaaggugauugaucugggcugcgggagaggaggcuggagcuauuacugugccgggcucaagaaaguuacggaagugaagggauauaccaaaggcggucccgggcacgaggaaccgaucccaauggcgacuuacggauggaacuuagucaagcugcauucuggcaaagacguguuuuucauaccucccgagaagugcgauacacuucugugugacaucggcgaguccucaccaaaucccaccauugaagaggggaggacucuacggguccucaaaaugguggaaccuuggcugcgcggaaaccaauuuugcaucaagauuuugaauccguacaugcccagcguuguagagacacuggagcagaugcagagaaagcacgguggcaugcucgugaggaacccacuuucgcgaaauucuacccaugaaauguauugggucaguugugggacgggaaacaucguguccgcuguuaauaugaccagccggaugcuguuaaaccguuucacaauggcacacagaaaaccuacuuacgagcgcgauguggaccugggcgccgguaccaggcacgucgcuguggaacccgagguagccaacuuggauauuaucgggcagcggauagaaaauauuaagcaugagcacaaaucaacauggcauuaugacgaggauaacccuuacaagacuugggcauaucacggauccuacgaagugaaaccaucuggcagcgccaguuccaugguuaauggcgucgugaagcuccugaccaagcccugggacgugaucccuauggucacacaaaucgcuaugaccgauacuacgccauuugggcagcagagaguuuucaaagagaagguggacacacgcacccccaaagcgaagaggggaacugcccaaauuauggaaguaaccgcaaaauggcuaugggguuuucuuagccgaaacaagaagccgcggauaugcacaagagaggaguucacgaggaaagugcgcucuaaugcugccaucggcgcagucuuuguggacgagaaccaguggaacucagccaaggaggcuguugaagaugagcguuucugggaccuggugcaucgggaaagagagcuccacaaacaggggaagugcgccaccugugucuauaacaugaugggaaaaagggaaaagaagcugggcgaguuugguaaagcgaaggggagucgcgcaauuugguacaugugguugggagcccgauuccuggaguucgaagcucucggcuuuaugaaugaggaucacugguucucccgggaaaacagccuuucuggcguggagggggagggacugcauaaauuagguuacauccugagagacauuucgaagaucccuggcgggaauauguaugccgaugacacugcaggaugggauacaaggauaaccgaagacgauuugcagaacgaggcucgcaucacugacauuauggaaccagagcacgcccuccuggcuaaaucaaucuuuaagcuaacauaccaaaauaaaguaguuagagugcagcggcccgccaagaacggcaccgucauggaugugauuagcaggcgugaccagcgagguuccggacaggugggaacauauggccuuaauacuuucaccaacauggaagcacaacugauccgccagauggagagugagggcauauuuucuccuagcgaacucgagacgccaaaccuggcggaaagagucuuggauugguuagagaaguacgggguugaacggcugaaaaggauggccauuuccggagacgacugcgugguaaagcccaucgaugaccgcuucgcuaccgcccucacagcacuuaaugauauggguaaagugagaaaggacaucccgcagugggagccuucaaaaggcuggaacgauuggcagcaaguccccuuuuguagucaucacuuccaccagcugauuaugaaggacgggcgggagauagugguuccaugcaggaaucaggaugagcuagugggacgagcucgugucucucagggcgccgguuggagccugagagagacugcaugucucgggaaguccuaugcccaaauguggcaguugauguacuuucaucgccgggaccugaggcuugcggcuaacgccaucugcucagcagugccuguagauuggauucccaccagcagaacaacuuggucuauccacgcccaucaccaguggaugaccacggaagacaugcuguccguuuggaaucgcguguggauugaggaaaacccauggauggaggauaaaacacauaucaguagcuggggagacguccccuaucucggcaagcgggaggaccaaugguguggcucguuaauagggcugaccgcuagggccacuugggcaacaaauauccagguggcuauuaaccagguucgaagauugaucggaaaugaaaacuaccuggauuacaugaccuccaugaaacgguucaagaaugagucugacccugaaggugcccucugguga

SEQ ID NO: 13962 - RNA, 9879 nt, Artificial Sequence
  derived and/or modified CDS sequence (opt3) from DENV-1__GU131794__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaagccaucaguugugggccacacuccugucccuaaccuucaucagaacuaccuuuucacugcacuaugcauggaaaacaauggcuauggugcuuagcauugucagucucuucccccuguguuugucuacuaccucccagaagacgacauggcugccgguauuacucggcagccuggggugcaagccucuuaccauguuucugaucgccgagaauaaaauauggggaaggaagucguggccauugaacgaagguaucauggccgugggcauuguuucaauccuccugucuagucuacugaaaaacgaugugccccuugcugggccucucauugcaggaggcaugcugaucgccuguuacgucauauccgguagcucugcggacuugagcuuagagaaggcugccgugguauccugggaggaagaggcagaacauucaggggccagucacaauauucugguggagguccaggaugacggaacuaugaaaaucaaggaugaagagcgagacgauacacucaccauccugcuuaaagcuacucuguuggcaguuagcggcguguauccccuaucuauuccagccacacuguucgugugguacuucuggcaaaagaagaaacagcgcuccggcguccucugggacaccccuucacccccagagguggaacgggcgguucuggaugacgggauauauagaaucaugcagaggggacuuuuaggucguagucagguaggcgugggggucuuucaagagaacguguuccauacgauguggcacguuacucgcggagcugugcugauguaccagggcaagcggcucgaaccgagcugggccuccgucaaaaaggacuugauuucuuacggugggggauggagacugcagggcucguggaauaccggcgaggaggugcagguaaucgcagucgaaccugggaaaaaccccaagaaugugcaaacagccccaggaaccuuuaagacaagcgagggugaaguuggcgcuauugcccucgauuucaaacccgggacuucaggauccccuaucgugaacagggagggcaagauagucggucuguaugggaauggagugguuaccacgaguggcacauacgugucugcaaucgcucaggccaaagcgagccaggaaggcccacuucccgagauugaggacgaagucuuucgaaagcggaaccugacuaucauggauuugcacccuggguccggaaaaacccgcagauaucuaccggccauugugagggaggcaaucaagcggaagcugcgaacacucauauuagcuccaaccagaguaguggccucagaaauggcugaggcacugaaagguaugcccauucgcuaccaaacuaccgccguuaagucugaacauacaggcaaagagaucgucgaccuuaugugccacgccacguucacuaugaggcugcucagcccugugcgugugccaaauuauaacaugaucauuauggaugaggcucauuuuaccgaccccaguuccaucgcggcacggggguacauaagcacaagagucggaaugggcgaagccgcugccauuuucaugaccgcaacuccuccggguucuguagaggccuuuccccagucaaaugcugugauccaggaugaagagagggacauuccagaacgcuccuggaacaguggguaugaguggaucacagauuucccuggaaagaccguuugguuugugcccagcauaaaaucgggcaaugacauugcgaacuguuugcgaaagaauggcaagagagucauccagcugucucggaaaacguucgauacugaguaccaaaagacaaaaaacaacgacugggacuacgugguuaccaccgauaucuccgaaaugggggccaauuucagggcagaccgcgugauugauccacguagaugccucaagccugucauccugaaagacggacccgagcgggugauucuugcugguccaaugccgguaacuguggccagcgcagcccagaggcgcggccgaauagggagaaaccacaauaaggaaggagaucaguauaucuacaugggccagccucuaaacaaugacgaggaucaugcucacuggacagaggccaagaugcuguuggacaacauuaauacccccgaagguaucaucccagcguuauuugagcccgaacgggagaaaucagcagccauugauggggaauauaggcugcgcggcgaggcuagaaagacauucguugagcucaugaggcggggagaccugccugucuggcuuaguuacaaaguggccucugaaggcuuucaauauuccgaucgucgcuggugcuucgacggggagcgaaacaaucaggugcuggaagagaacauggaugucgaaauauggacuaaggagggagagagaaaaaagcucaggccacggugguuggacgcucgcacguacagcgacccccuggcacuaagagaauuuaaagaguucgccgcugguaggcggucaaucaguggcgaucugauucucgaaaucgggaagcuuccucagcaccugacccagcgagcccaaaaugcauuagacaacuugguuaugcugcauaauagcgagcagggaggcagagcguaucgccacgccauggaagagcucccggauacaauugagacucugaugcuucuggcucucaucgccguguugaccggugggguaacacuguuuuucuuauccggcaggggacuaggcaagaccucuauagggcugcucugugugauggcaagcuccguccuucuguggauggcuucaguggaaccacauuggaucgccgcaucuauuaucuuggaguuuuuccugaugguucuccugauucccgaaccugaccggcagcguacuccccaggauaaccaacuugccuacguggucaucggacuccuguuuaugauauugacgguagcugcgaaugagaugggucuguuagagaccacaaaaaaggaccuaggcauugggcacguggccguugaaaaccaccaucacgcagcuaugcuggauguggaccuccauccagccagugccuggacucuuuacgcagucgcuaccacaaucauuaccccuaugaugagacacacuaucgagaacacaacggccaauauaucgcugaccgcgaucgcuaaccaggccgcaauuuugaugggacuggauaaaggcuggcccaucagcaagauggacauuggugugccacuccuggcccuugggugcuauucccaggucaauccuuuaacucugacagcugcagugcucauguugguugcccauuacgcgaucauaggcccgggacugcaagcuaaagccaccagggaagcacagaagcgcaccgccgcuggcauuaugaagaaccccacaguggaugggaucguagccaucgaccuagauccaguggucuaugacgcaaaauucgagaagcagcugggacagauuaugcuccuuauccuguguacuucucaaauauugcugaugcggacgaccugggcucucugcgaaucaauuacacuggccacuggcccuuuaaccacacuuugggaggguagccccgggaaauuuuggaauaccacuaucgcgguuuccauggccaacauuuuccgaggaaguuaccuggcaggcgcuggucucgccuucucucuaaugaagagccugggcgggggaagaaggggcacgggggcacagggagagacauugggcgaaaaauggaagcgccagcugaaucagcucucaaaguccgaguuuaacaccuauaaacggagugguaucauggaaguggacagaagcgaggcuaaggaagggcuuaaacguggagagacuaccaagcacgccgucucuaggggcacagccaaacugcggugguucguggagcgcaauuugguaaagccagaagguaaggugauagaucugggcugugggcgaggaggcugguccuacuauugcgcggggcucaaaaagguuacugaggugaaaggauacaccaagggcgguccugggcacgaagagcccaucccgauggcuacauacggauggaacuuagucaaacugcauucaggcaaggacguguuuuucauuccaccugaaaaaugugauacgcuucugugcgacaucggcgagagcucgcccaauccaaccauugaggaagggagaacucuaaggguccucaagaugguggagcccuggcugcggggaaaccaauuuuguaucaagauuuugaauccuuauaugccgucuguuguagaaacacuggagcagaugcagcgcaaacacgguggcaugcucgugagaaacccccuuaguaggaauuccacccaugagauguacugggucagcugcgggacuggaaacaucgugucagcaguuaauaugacaucccgaaugcuguuaaaccgguucaccauggcccaccguaagccaacguaugaaagagauguggaccugggcgcugguacccgccacgucgccguggagccugaaguagcaaacuuggauauaauugggcagaggaucgagaauaucaaacaugaacacaagucuacauggcauuacgacgaggauaaccccuauaaaacuugggccuaccacggaagcuaugaggugaagccuaguggcuccgcuagcucuaugguuaauggcgucgugaagcuccugaccaaaccaugggacgugauucccauggucacacaaauagcgaugacugauaccacaccuuuugggcagcagcggguuuucaaggaaaaaguggacaccagaacuccaaaggccaaacgcggaacggcacaaaucauggagguaacagcuaaguggcuaugggguuuucuuucaaggaacaagaaaccccgaauuuguacccgggaagaguucacuagaaaggugaggaguaaugccgcaaucggcgccgucuuuguggacgaaaaccaguggaauuccgcuaaagaggccguugaggaugaacgcuucugggaccuggugcaucgugagcgggaacuccacaagcaggggaaaugcgcgaccugcgucuacaacaugaugggaaagagagagaagaaacugggcgaauuugguaaggcaaaagggagcagggccauuugguacaugugguugggagcucgcuuccuggaguucgaggcccucggcuuuaugaaugaagaucacugguucucucgagagaacucgcuuucaggcguggaaggggagggacugcauaaguuagguuauauccugcgggacauaagcaaaaucccgggcgggaauauguacgcagaugacacagcuggaugggauacgagaauuaccgaggacgauuugcagaacgaagccaagaucacugacauuauggagccugaacacgcucuccuggccaaauccaucuuuaagcuaacauaucaaaauaagguaguuagggugcagcgcccagcaaaaaacggcaccgucauggaugugauaaguagacgggaccagagggguucugggcaggugggaacuuacggccuuaauacauucaccaacauggaggcgcaacugauucgucagauggaaagcgagggcaucuuuucccccucagagcucgaaacaccuaaccuggccgggcgagucuuggauugguuagagaagcauggaguugaacgccugaaaagaauggcuaucaguggugacgacugugugguaaagccaauugaugaccgguucgccacugcacucaccgcucuuaaugauaugggcaaagugaggaaggacauaccccagugggagccgucuaagggguggaacgauuggcagcaagucccuuuuugcagccaccacuuccaucagcugaucaugaaagacggacgcgaaauugugguucccuguagaaaucaggaugagcuagugggccgggccagggucucccagggugcaggguggucacugcgagagacggccugccucggaaagagcuaugcgcaaauguggcaguugauguacuuucaccguagagaccugcgccuugcugccaacgcaaucuguucugccgugccaguagauuggguuccuaccucccggacaacuuggaguauucaugcucaccaucaguggaugaccacagaagacaugcugagcguguggaauagggucuggaucgaggaaaaccccuggauggaggauaaaacucacauaucguccuggggcgacgugccauaucucggcaagagagaagaccaauggugcgggucuuuaaucggacugaccgcccgcgcaacgugggcuacaaauauucagguugccaucaaccaggugcggagguugcuggguaaugagaacuaccucgauuacaugaccucaaugaaacgauucaagaaugagagcgaccccgaaggcgcgcuuugguga

SEQ ID NO: 13963 - RNA, 9879 nt, Artificial Sequence
  derived and/or modified CDS sequence (opt3) from DENV-1__GU131796__SS-prME
agcgugacaaugcugcucaugcuuaugcccacagcacuggcuuuccacuugacuacgcgaggcggggaaccucauaugaucgucuccaagcaggaaaggggaaaaucuuuacuguuuaagacaucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccgauccugccgugcucaggaaacugugcgucgaagcuaagauuucuaacacgaccacagacagccgguguccaacucaaggagaggccacccuuguugaagaacaagaugcaaauuuugugugccgccgaacauucguagacagaggcugggguaacggguguggacuguuuggcaaaggcuccuugaugacuugcgcuaaguucaagugcgugaccaaacucgaggggaagaucguccaguacgaaaaucugaaauauucagugauaguuacagugcacaccggagaccagcaucaagucgguaacgagaguacugaacacggcacgacagccaccauuacuccccaggcgccuagcaccgagauccaguuaacagauuacggggcccugacccucgacuguucuccaaggacuggacuugauuuuaaugaaauggugcuguugacaaugaaggagaaauccuggcuaguacauaagcagugguuccuggaccucccgcugcccuggacgucaggcgcaagcaccagucaagagacuuggaaccggaaagaucuucugguuacauuuaagaccgcucacgccaagaaacaggaaguggucguguuggguucucaggagggggcuaugcacacagcccucacuggcgcaaccgaaauucaaacguccggaaccacaacuaucuucgccggccaucugaagugccguuuaaaaauggacaagcugacccuaaaagggaugagcuaugucauguguacaggaucguucaagcucgagaaggaaguggcugagacucagcacgguaccguucuggugcagaucaaauacgagggcacggaugcgccuugcaagauuccauuuucuacacaggacgaaaaagggguaacccaaaauggacgccuuauaacugcaaaccccaucgucacagauaaggagaaaccugugaauauugaagccgagccacccuucggcgaguccuauaucguuauaggugcuggggaaaaggccuugaagcugucaugguuuaaaaagggcaguagcauuggaaaaauguucgaggcaaccgccagaggcgcuaggcggauggccauccucggggacacugcaugggauuuuggauccaucgguggcguguucaccucugucgggaagcuggugcaucagauuuuuggaacagcguacggcguacuuuucagcggugugucauggacgaugaaaaucgggauuggcguucuguugaccuggcucggacugaacagucgauccacuagcuuaucuaugacauguauagcugucggccuggugacccuauaccucggggugaugguccaggccgacucaggaugcguuaucaauuggaagggccgcgaacugaagugugguagugggauuuuugugacaaacgaggugcacacuuggaccgaacaguauaaauuccaagcagacagcccgaagagacuuuccgccgcuaucggaaaagccugggaggagggcguaugcgguaucaggucugcaacgcgguuggaaaauauuauguggaagcagauaucgaacgagcugaaccauauccuccuggaaaaugauaugaaauuaacagucgugguuggcgacguggcugggauucuggcccagggaaagaaaaugauccgcccucagcccauggaguacaaguauagcuggaaguccuggggcaaagcgaagauuaucggggccgauguccaaaacaccacuuuuauaaucgacggaccaaauaccccugaaugucccgaugaccagagagcuuggaacauuugggagguggaggauuacggcuucgguaucuuuacaacuaauauuuggcuuaaauugagggacucauauacccagguuugcgaucaccgucucaugagugcagccaucaaggacucuaaagcugugcacgccgauaugggguacuggauagaaagcgagaagaacgaaacauggaagcuggcacgggcguccuucauugagguaaaaacguguaucuggccaaagucacauacccuauggagcaauggaguccuggaaucugagaugauuauccccaaaauauauggcgguccuaucucccagcacaacuaccgaccaggcuacuucacucaaacagccgggccguggcaucucggaaagcuggagcuugacuuugauuugugcgaaggcaccacugugguggucgacgagcacugcgggaauagaggacccagucugaggacaaccacgguuacuggcaaaauuauccacgaaugguguugccgcagcuguaccuuaccuccacuccgguucaagggugaggacgggugcugguauggaauggagauuagacccgugaaggaaaaagaggaaaaccugguaaagucuaugguguccgcuggcucaggugaggucgauaguuuuagccuuggccuguuguguaucucgauaaugauugaagaggugaugaggucccgcuggucucgaaaaaugcucaugacagggacccuggccguuuucuuucuacugaucaugggacagcucacuuggaaugaccugauccggcuuugcauuauggugggcgcaaacgcuagcgaucguauggggaugggaacaaccuacuuggcccugauggcaacauucaagaugagaccuauguuugccgucggcuuacucuucaggcgccugacuucacgggaggugcuucugcuaaccaucggucucagucugguugcuuccguggaauugccaaauucucuggaggaauuaggggacggacucgcgaugggcauuaugauacugaaacuucugacggauuuucagagccaucaauugugggccacacuccugucccuaaccuucaucaagacuaccucaagccugcacuaugcauggaagacaauggcuaugguccuuaguauuguaucucucuuuccccuguguuuguccacuaccagccagaaaacgacauggcugccgguguuacucggcucgcuggggugcaagccucuuaccauguuccugaucgccgagaacaaaauuuggggaagaaagucauggccauugaaugaagguaucauggccguuggcauagugucuauccuccugagugcucuacugaaaaacgacgucccccuugcagggccucucauugccggaggcaugcugaucgcguguuacgugauuuccgguagcucugcugauuugagcuuagagaaggccgcagagguauccugggaagaggaagccgagcauucaggggcuagucacaacauccugguggaaguccaggacgauggaacuaugaaaauaaaggacgaggagagggaugacacacucaccauucugcuuaaggcaacucuguuggccguuagcggcguguauccccuaucuaucccagcgacacuguuugugugguacuucuggcagaaaaagaaacaacgauccggcguccucugggauaccccuucacccccagaaguggagcgcgcuguucuggacgacgggaucuaucggauuaugcagagaggacuuuuagguaggagucagguaggcgugggggucuuccaggaaaauguguuucauacgauguggcacguuacucguggagccgugcugauguaccaaggcaagcgccucgagccgagcugggcauccgucaaaaaggauuugauaucuuacggugggggauggcggcugcagggcucguggaacaccggcgaggaagugcagguaaucgccgucgagccugggaagaaucccaaaaacgugcagacagcuccaggaaccuucaagacaagcgaaggugagguuggcgccauugcacucgacuuuaaacccgggacuucaggauccccuaucgugaauagagaaggcaagauugucggucuguaugggaacggagugguuaccacgaguggcacauacgugucugcuaucgcccaagcgaaagccagccaggagggcccacuucccgagauagaagaugaggucuucaggaagcgaaaucugacuaucauggacuugcacccuggguccggaaagacccggcgcuaucuaccggcaauugugagagaagcuaucaaaaggaagcugcggacacucauuuuagccccaacccgaguaguggcuucagagauggcagaagcccugaaagguaugcccaucagauaccagacuaccgccguuaagucugagcauacaggcaaagagauagucgaucuuaugugccacgcuacguuuacuaugcgccugcucagcccugugagggugccaaacuauaauaugauuaucauggacgaagcgcauuucaccgaucccaguuccaucgcagcccguggguacauuagcacacgggucggaaugggcgaggcugccgcaaucuuuaugaccgccacuccuccggguucuguagaggcuuucccccaaucaaacgcggugauacaggacgaggaaagagauauuccagagagguccuggaauaguggguaugaguggaucacagacuuuccuggaaagaccguuugguucgugcccagcauuaagucgggcaacgauaucgccaauuguuugcgcaaaaacggcaagcgagucauacagcugucuagaaaaacguuugacacugaauaccagaagaccaagaauaacgacugggauuacgugguuaccaccgacauuuccgagaugggggcaaacuuccgggcugauagggugaucgacccacgccguugccucaagccugucauccugaaggauggacccgaaagagugauucuugccgguccaaugccgguaacuguggcaagcgccgcucaacggaggggccgcaucgggcgaaaucacaacaaagagggagaccaguauauuuacaugggccagccucuaaauaacgaugaggaccaugcccacuggacagaagcgaagaugcuguuggauaauauaaacacccccgaggguaucauuccagcauuauucgaacccgagagagaaaaaucagccgcuaucgacggggaguaucggcugaggggcgaggcccgcaagacauuuguugaacucaugagaaggggagaucugccugucuggcuuaguuacaaaguggcuucugagggcuuccaguauuccgaccggcguuggugcuuugauggggaacgcaauaaccaagugcuggaggaaaauauggacgucgagaucuggacuaaggagggagaaaggaaaaagcucagaccaagaugguuggacgcacggacguacagcgauccccuggcccuacgcgaguucaaggaauuugcugccgguagaaggucaguuaguggcgaccugauucucgagauagggaaacuuccucagcaccugacccagcgggcacagaacgcguuagauaauuuggugaugcugcauaacagcgaacaaggaggccgagccuauagacacgcuauggaggagcucccggacacaaucgaaacucugaugcuucuggcccucauugcaguauugaccgguggggugacacuguucuuuuuauccggccgcggacuaggcaagaccucuaucgggcugcucugugucauggcuagcuccgugcuucuguggauggccucaguugagccacauuggauugcagccucuaucauauuggaguucuuucugauggugcuccugauccccgagccugauaggcagcggacuccccaggacaaucagcuugcuuacgucguaauuggacuccuguucaugaucuugacgguggcggccaacgagaugggucuguuagaaaccaccaaaaaggaucuaggcauugggcacguugcaguggagaaucaccaucacgcugccaugcuggacgucgaucuccauccagccagugcauggacucuuuacgcuguggccaccacaaucauaaccccuaugaugcgucacacuauugaaaacacaacggcgaacaucucgcugaccgcuauugccaaucaagcagccaucuugaugggacuggacaaaggcuggcccauaagcaagauggauaucggugucccacuccuggcucuugggugcuauucccaggugaacccuuuaacucugacagcagccguucucauguugguggcgcauuacgcuauuaucggcccgggacugcaggccaaggcaaccagagaggcccagaaaaggaccgcugccggcauuaugaagaaucccacaguagacgggaucguggcaauagaucuagacccagucguuuaugacgcuaaauuugaaaagcagcugggacagauuaugcuccuuauccuguguacuucucagaucuugcugaugcgcacgaccugggcccucugcgagucaauuacacuggcgacuggcccuuuaaccacacuuugggaggguagccccgggaaauucuggaacaccacuaucgccguguccauggcaaauauauuucggggaaguuaccuggcuggcgccggucucgcauucucucuaaugaaaagccugggcgggggacgaagaggcacgggggcucaaggagaaacauugggcgagaaguggaaaaggcagcugaaccagcucucaaaguccgaguucaauaccuauaaacgcagugguauuauggaggucgaucggagcgaagccaaggaggggcuuaaaagaggagagacuaccaagcacgccgugucucguggcacagcgaagcugaggugguuuguagaacggaacuuggugaaaccagaggguaagguuaucgaccugggcugugggcgcggaggcugguccuacuauugcgcugggcucaaaaaggugacugaagucaaaggauacaccaagggcgguccugggcacgaggaacccauuccgauggcaacauacggauggaauuuagugaaacugcauucaggcaaggaugucuucuuuaucccaccugagaagugugacacgcuucugugcgauauaggcgagagcucgcccaacccaaccaucgaagaggggcgaacucuaagagugcucaaaaugguugaacccuggcugaggggaaaucaguucuguauuaagaucuugaacccuuauaugccgucuguaguggagacacuggagcaaaugcagcggaaacacgguggcaugcucguccgcaauccccuuaguagaaacuccacccaugaaauguacugggugagcugcgggacuggaaauauuguuucagccgugaacaugacauccaggaugcuguuaaaucgauuuaccauggcucaccggaagccaacguaugagcgugacgucgaucugggcgccgguaccagacacguggcaguagaaccugagguggccaacuuggacaucauugggcagcgcaucgaaaacauaaaacaugagcacaagucuacauggcauuacgaugaggacaaucccuauaagacuugggcuuaccacggaagcuaugaaguuaaaccuaguggcuccgcgagcucuauggucaacggcguggugaagcuccugaccaaaccaugggaugucauucccaugguuacacagaucgccaugacugacaccacaccuuucgggcaacagaggguguuuaaggagaaaguagacacccggacuccaaaggcaaagagaggaacggcucagaucauggaagugacagccaaauggcuaugggguuuccuuucacgcaauaagaaacccaggauuuguacccgagaggaauuuacucggaaggucagaaguaacgcagccauaggcgcuguguucguugaugagaaucaauggaacuccgccaaagaggcgguggaagacgagagguuuugggaucugguccaucgcgaacgugagcuccacaagcaggggaagugcgcaaccugcguguacaauaugaugggaaaacgggaaaagaaacugggcgaguucgguaaggccaaagggagcagagcuaucugguacaugugguugggagccagguuucuggaguucgaagcacucggcuucaugaacgaggaccacugguuuucucgcgaaaauucgcuuucaggcguagagggggagggacugcauaaguuagguuauauucugcgagauaucagcaaaauuccgggcgggaacauguacgcugacgauacagccggaugggacacgcggaucaccgaagaugacuugcagaaugaggcuaagauaacugauaucauggaaccugagcacgcccuccuggcaaaguccauuuucaaacuaacauaucagaacaagguugugagaguccaaaggccagcgaaaaauggcaccgugauggacgugaucagucgcagagaucagcgggguucugggcaggucggaacuuacggccuuaacacauuuaccaauauggaagcccagcugauuaggcaaauggagagcgagggcaucuucucccccucagaacucgagacaccuaaccuggcugggcguguuuuggacugguuagaaaagcauggaguggagcgacugaaacgcauggccauaaguggugacgauuguguagugaagccaauugacgauagauuugcagcugcccucacugcacuuaacgacaugggcaagguccggaaagauaucccccagugggaaccgucuaagggguggaaugacuggcaacaggugccuuucugcagccaccacuuucaucaacugaucaugaaagauggaagggagauuguugugcccugucgcaaccaggacgagcuagucggcagagcccgggugucccagggugcgggguggucacugagggaaaccgcuugccucggaaagagcuaugcccagauguggcaauugauguacuuccaccgacgugaucugagacuugcagccaaugcuauauguucugccguaccaguugacugggugccuacgucccgcaccacauggaguauccaugcacaccaucaguggaugacuaccgaggauaugcugagcgucuggaaccggguguggauugaagagaaucccuggauggaagacaaaacacacaucucguccuggggcgacguuccauaucucggcaagagggaggaucaguggugcgggucuuuaauuggacugacugcuagagccaccugggcgacgaacauccaaguggcuauaaaucagguccgccgguugaucgguaacgagaauuaccuggacuacaugacaucaaugaagagguuuaaaaacgaaagcgaucccgagggcgcccucugguga

SEQ ID NO: 13964 - RNA, 9879 nt, Artificial Sequence
  derived and/or modified CDS sequence (opt3) from DENV-1__GU131797__SS-prME
agcgugaccaugcugcucaugcuuaugcccaccgcccuggcuuuccacuugacuacgagaggcggggaaccucauaugaucgucuccaagcaggaaaggggaaagucuuuacuguuuaagaccucagccgguguuaauaugugcacgcuaauugccauggaccucggcgaacugugugaagauacuaugaccuacaagugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucuccgcgggauguccuaugugauguguaccgggagcuucaagcuggagaaagaagucgccgagacgcagcacgguacagugcuuguucagauaaaguacgagggcaccgacgcuccuugcaagaucccauucucgacucaagaugaaaaaggggugacacagaacggaagauugauuaccgcgaaucccaucguaacugacaaggagaaaccugucaacauagaagcagagccacccuuuggcgagucuuauauugugaucggugccggggaaaaggcucugaaacucuccugguucaagaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgucaucaacuggaagggcagagaacuuaaaugugguucagggaucuucguuaccaaugaggugcacacguggacagaacaauauaaguuucaggccgacaguccgaagagguugagcgcagccauuggaaaggcuugggaggagggcgugugcgguauacgguccgccacccgccuggaaaacaucauguggaagcagauuucuaacgagcucaaucauauccuguuagaaaacgacaugaaauucacuguagucgugggcgauguugcagggauucuggcucagggaaagaaaaugaucagaccucaacccauggaguacaaguauucguggaaaagcuggggcaaggccaagauaaucggggcggacgugcagaauaccacauuuauuaucgauggaccaaacacuccugaaugucccgacgaucagagggccuggaauauuugggaggucgaggacuacggcuucgguaucuuuaccacaaacauauggcuuaaauugcgugauuccuauacacaggugugcgaccaccggcucaugucagcugcaauuaaggauaguaaagccguucacgcugacaugggguacuggaucgaaucugagaagaaugaaaccuggaaacuggcccgagcauccuucauugaggugaagacuuguaucuggccaaagucccauacacuauggucaaacggaguacuggaaagcgagaugauaauccccaaaauuuauggcgguccuaucucucaacacaauuacagaccaggcuacuucacccagacugcggggccguggcaucucggaaagcuggagcuugauuuugacuugugcgaaggcacaaccgucgugguggaugagcacugcgggaacaggggacccucccugcgcacgacuaccgucacaggcaaaauuauccacgaaugguguugccggaguuguaccuuaccuccacucagauucaggggugaggacgggugcugguauggaauggagauacgccccguuaaggaaaaagaggaaaaucugguaaagagcaugguaucugccggcuccggugagguggacucauuuagucuuggccuguuguguauuagcaucaugaucgaagaggucaugcgaucgcgguggucccguaagaugcucaugacugggacacuggcuguguucuuucuacugauuaugggacagcucaccuggaacgaucugaucagacuuugcauuaugguuggcgccaaugcaucugacaggauggggaugggaacaacuuacuuggcucugauggccaccuucaaaaugcgcccuauguuugcagugggcuuacucuuccggagacugacgagcagggagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaaaacaacuuuuucccugcacugugccuggaagaccauggcaauggugcuuucaauugucagccucuucccccugugcuugaguacgacaucucagaaaaccacuuggcugccgguauuacucggcucccugggguguaagccucuuacaauguuucugaucgcugagaauaagauauggggacgacgcagcuggccauugaacgaagguaucauggccgugggcauuguuucgauccuccugucaucucuacugaaaaacgaugugccccuugccgggccucucauugcuggaggcaugcugaucgcaugcuaugucauaagugguuccagcgccgacuugucuuuagagaaggcggcugaggugagcugggaagaggaagccgagcauuccggggcaucacacaauauucugguagaagugcaggaugacggaaccaugaaaaucaaggaugaggagcgggacgauacucucacaauccugcuuaaagccacccuguuggcugucaguggcguuuacccccuaagcauuccagcaacgcuguucgugugguauuucuggcaaaagaaaaagcagagaucuggcgugcucugggacacuccuucacccccagaagucgagagggccgugcuggaugacgggauauaccguaucaugcagcgcggacuuuuaggucggagccagguuggcguagggguguuucaagaaaacgucuuccauaccauguggcacgugacaagaggagcgguucugauguaucagggcaagaggcucgagccgaguugggcuagcgugaaaaaggacuugauuuccuacggugggggauggcgacugcagggcucuuggaauaccggcgaggaaguccaggugaucgccguagagccugggaaaaaccccaagaauguccaaacagcaccaggaacuuuuaaaacccccgaaggugaggugggcgccauugcucucgauuucaagccugggacgucgggaagcccaaucguuaaccgggaaggcaagauagugggucuguacgggaauggagucgugacaacuucaggcaccuauguuuccgccaucgcacaggcuaaagccagucaggagggcccccuuccugagauugaagacgagguguuucgcaagagaaaccugacaaucauggauuugcacccggggucuggaaaaaccaggcgguaccuaccagcgauuguccgagaagccaucaagagaaaacugcgcacucucauauuagcacccaccagggugguagcuagcgagauggccgaagcucugaaggguaugccuauucguuaucaaacaacggcagugaaguccgagcauacuggcaaagagaucguugaccuuaugugucacgccaccuucacaaugcggcugcucucaccagucagagugcccaauuacaacaugaucauuauggaugaagcccauuuuaccgacccuucuagcaucgcugcgaggggguauauaaguacucgcgugggaaugggcgaggcagccgcuauuuucaugacagccaccccgcccgguuccgucgaagcauuuccacagagcaaugccguaauccaggaugaggaacgagacauuccugagagaucuuggaacucaggguacgaguggaucacggauuuccccggaaagacugugugguuuguuccauccauaaaaaguggcaaugacauugcuaacugcuugcggaagaauggcaaaagggugauccagcugagccgcaagacauucgauaccgaauaucaaaagaccaaaaacaacgacugggacuacgucgugacuacagauaucucggagaugggggcgaauuuccgugccgacagaguuauugauccucggaggugccucaagcccgugauccugaaagacggaccagaacgcgucauucuugcagguccgaugccugugaccguagcuucugccgcacagcgaagaggccggauagggaggaaccacaauaaggagggagaucaguacaucuauaugggccagccccuaaacaaugacgaggaucaugcccacuggacagaagcuaaaaugcuguuggacaacauuaauacuccagaggguaucauccccgccuuauuugaaccugagcgcgaaaaguccgcggcaauugauggggaguacagacugaggggcgaggcccggaagacguucguggaacucaugcgucgcggagaccugccaguuuggcuuagcuauaaagucgcuucagagggcuuucaauacagugaucgaagaugguguuucgacggggaaaggaacaaucaggugcuggaggaaaacauggauguggagauauggaccaaggagggagaacggaaaaagcuccgccccagaugguuggacgccaggacauauucugacccucuggcucuacgggaguuuaaagaguucgcagccggucgaagauccgucagcggcgaucugauccucgagauugggaaacuuccgcagcaccugacucagcgcgcucaaaaugccuuagacaacuugguuaugcugcauaauucagaacagggaggcagggcauaccggcacgcgauggaggagcucccagauaccaucgaaacacugaugcuucuggcccucauugcuguguugaccggugggguaacucuguuuuucuuaaguggccguggacuaggcaaaacgagcaucgggcugcucugcgugauggccuccucuguccuucuguggauggcaagcguggagccccauuggauagcugccuccaucauuuuggaauuuuuccugaugguucuccugaucccugagcccgacaagcagagaaccccacaggauaaccaacuugcauauguggucauuggacuccuguuuaugaucuugacaguagccgcuaaugagaugggucuguuagaaacuaccaagaaagaccuaggcauagggcacguggcgguugagaaccaccaucacgccgcaaugcuggauguggaccuccauccugcuucagccuggacacuuuacgccgucgcaaccacuauuaucacacccaugaugaggcacacgauugaaaacaccacugcuaauaucucucugacagccauagcgaaccaggcugccaucuugaugggacuggauaagggcuggccaauuaguaaaauggacaucggugugccucuccuggcacuuggguguuacucgcaggucaauccguuaacccugaccgccgcugugcucauguugguugcacauuaugccauuaucggccccggacugcaagcgaaggcuacacgcgaggcccagaaacggacugcagccggcauaaugaagaacccaacgguggaugggauuguagcuaucgaccuagauccuguggucuacgacgccaaguucgaaaaacagcugggacagaucaugcuccuuauucugugcaccagccaaaucuugcugaugcgaacaacuugggcacucugugaguccauaacccuggcuacaggccccuuaaccacucuuugggaggguucuccagggaaguuuuggaauacgacaauugccguuucaauggcgaacaucuucagaggaagcuaucuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuacaagagaucagguauuauggagguggaccguuccgaagcaaaagaggggcuuaagaggggagagacaacuaaacacgcugucagucggggcaccgccaagcugcgcugguucguggaacgaaauuugguaaaaccugaggguaaggugaucgaucugggcugcgggagaggaggcuggagcuauuacugugccgggcucaagaaaguuacagaagugaagggauauacgaaaggcggucccgggcacgaggaaccgauaccaauggcgaccuacggauggaacuuagucaagcugcauucuggcaaagacguguuuuucaucccucccgagaagugcgauacucuucugugugacauuggcgaguccucaccaaaucccacaaucgaagaggggaggacccuacggguccucaaaaugguggaaccuuggcugcgcggaaaccaauuuugcauuaagaucuugaauccguacaugcccagcguuguagagacucuggagcagaugcagagaaagcacgguggcaugcucgugaggaacccacuuucgcgaaauucuacacaugaaauguauugggucaguugugggaccggaaacauuguguccgcuguuaauaugacgagccggaugcuguuaaaccguuucaccauggcacacagaaaaccuacauacgagcgcgauguggaccugggcgccgguacuaggcacgucgcuguggaacccgagguagccaacuuggauaucauagggcagcggauugaaaauaucaagcaugagcacaaaucaaccuggcauuaugacgaggauaacccuuacaagacaugggcauaucacggauccuacgaagugaaaccaucuggcagcgccaguuccaugguuaauggcgucgugaagcuccugacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcuaugggguuuucuuagccgaaacaagaagccgcggaucugcaccagagaggaguucacaaggaaagugcgcucuaaugcugccauuggcgcagucuuuguggacgagaaccaguggaacucagccaaggaggcuguugaagaugagcguuucugggaccuggugcaucgggaaagagagcuccacaaacaggggaagugcgccacgugugucuauaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcguggagggggagggacugcauaaauuagguuacauucugagagacaucucgaagauaccuggcgggaauauguaugccgaugacaccgcaggaugggauacuaggaucacagaagacgauuugcagaacgaggcucgcauuaccgacaucauggaaccagagcacgcccuccuggcuaaaucaauuuuuaagcuaacuuaccaaaauaaaguaguuagagugcagcggcccgccaagaacggcacagucauggaugugaucagcaggcgugaccagcgagguuccggacaggugggaaccuauggccuuaauacauucacuaacauggaagcacaacugauacgccagauggagagugagggcauauuuucuccuagcgaacucgagaccccaaaccuggcggaaagagucuuggauugguuagagaaguacgggguugaacggcugaaaaggauggccaucuccggagacgacugcgugguaaagcccaucgaugaccgcuucgcuacggcccucaccgcacuuaaugauauggguaaagugagaaaggacauuccgcagugggagccuucaaaaggcuggaacgauuggcagcaaguccccuuuuguagucaucacuuccaccagcugauaaugaaggacgggcgggagaucgugguuccaugcaggaaucaggaugagcuagugggacgagcucgugucucucagggcgccgguuggagccugagagagacagcaugucucgggaaguccuaugcccaaauguggcaguugauguacuuucaucgccgggaccugaggcuugcggcuaacgccauuugcucagcagugccuguagauuggauccccacuagcagaaccacauggucuauucacgcccaucaccaguggaugacuaccgaagacaugcuguccguuuggaaucgcguguggaucgaggaaaacccauggauggaggauaaaacgcauauaaguagcuggggagacguccccuaucucggcaagcgggaggaccaaugguguggcucguuaaucgggcugacagcuagggccaccugggcaacuaauauucagguggcuaucaaccagguucgaagauugauuggaaaugaaaacuaccuggauuacaugacauccaugaaacgguucaagaaugagucugacccugaaggugcccucugguga

SEQ ID NO: 13965 - RNA, 9879 nt, Artificial Sequence
  derived and/or modified CDS sequence (opt3) from DENV-1__GU131801__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggaagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagguauuggggcuggcgagaaagcccucaagcuguccugggugaagaaaggaucaaguaucggcaagaugguugaagcaacugccagaggggcuaggcggauggccauccuuggagacaccgcaugggauuucgguagcauuggcgggguguuuacauccgucggaaaacuggugcaucagaucuucggcacggcguacgguguauuguuuucuggggugagcuggaccaugaagauuggcauaggaguucuccugacuugguuaggccugaauucacgaaguacaucccuaagcaugaccuguaucgcugucgggcucgugacacuguaccuuggagugaugguccaggccgacucuggcugcguuauuaacuggaaaggucgcgaguugaagugugggucaggaaucuucgugacuaaugaagugcacaccuggacggagcaauauaaguuucaggcagauaguccgaaaagacugagcgccgcuaucggcaaggccugggaggaagguguaugcggcauuagguccgcaacacggcucgagaacauaauguggaaacagaucucuaacgaacugaaucauauuuuacuggagaacgacaugaaguucaccgucgugguuggggacguggcuggaauccuuguccagggcaaaaagaugauucgcccucaacccauggaauacaaauauucguggaagagcugggggaaggccaaaaucauaggagcggaugugcagaauuccacuuuuaucauugacggcccaaacaccccugagugucccgaugaccagagagccuggaauaucugggagguugaagauuacgguuucgggauuuuuacaacuaacaucugguugaagcucagggacucauauacccaggugugcgaucaccgucugaugagugcugcaauaaaagacucuaaggccguacacgcugauaugggauacuggauugagagcgaaaaaaaugagacauggaagcuagcccgggcauccuucaucgaagucaagacguguauuuggccaaaaucacauacccuguggagcaacggcgugcucgagucugagaugaucauacccaagauccacgguggcccuauuucccaacauaauuaucgaccaggguacuuuacucagacagcgggaccguggcaccugggcaaacuugaauuggacuucgaucugugcgaggggaccacuguggucguugacgaacacugcggaaacagaggccccaguuuaaggacaaccacggugacugguaagaucauucaugagugguguugccgcagcuguacccucccuccacugcgguucagaggggaggauggaugcugguacggcauggaaaucaggcccguaaaagagaaggaagagaaucuugugaagucuauggucuccgccgguucaggcgaaguggacaguuuuagccugggguugcucuguauaucgauuaugaucgaggagguuaugcgcucccgauggucucggaaaaugcugaugacaggaacccuagcuguguucuuucugcucaucaugggccagcugacuuggaacgaccuuauucguuugugcaucauggucggggccaaugcaagcgauagaaugggaaugggcacaaccuaucuggcuuuaauggccacauucaagaugaggccuauguuugcagugggucuccuguuccgccggcuuacuucaagagaaguucugcuacucaccauugggcugaguuugguggccuccgucgagcugccaaacucuuuagaagagcucggagacggccuggcuaugggcauaaugauccuuaaacuguugacggauuuucaaagcuaccagcucugggcgacacugcuaucccugaccuucauuaagacuaccuuuucacuucacuaugccuggaaaacaauggcaaugguacucagcaucgugagucuguuccccuugugucugucuacuaccucccagaagacgacaugguuaccgguucuccuggggagccuuggaugcaagccucugaccauguuuuugauugcugaaaauaaaaucugggguaggaagucguggccacucaacgagggcauaauggccguggggaucgucucaauucugcuaucuagucugcuuaaaaacgacgugccccucgccggaccucugaucgcuggcgguauguugauugcauguuacguaaucuccgggagcucugccgauuuaagccuggagaaggcggcugaaguguccugggaggaagaggccgaacauucaggagcaagucacaauauacucgucgagguucaggacgauggcacuaugaaaauuaaggacgaggaacgagaugacacacugaccauccuucugaaagccacuuugcuagcugugagcggcguguauccccugucuaucccagcaacacucuucgucuggcauuuuuggcaaaagaagaaacagcgcuccggggugcugugggauaccccuucacccccagagguugaacgggccguacuugacgauggaauuuacagaauaaugcagagggguuuacugggccguagucaggugggggucggaguguuccaagagaacguuuuccacacgauguggcacgugacucgcggcgcgguccucauguaucaggguaagcgguuggagccgagcugggcuuccgugaaaaaggaccugaucucuuacgggggaggcuggagauuucagggcucguggaauaccggggaagagguacaggucauugccguggaaccuggaaaaaaccccaagaauguucaaacagcaccagguaccuucaagacacccgagggcgaagugggggccaucgcucucgacuuuaaaccuggaacuagcggcucaccaauugucaacagggaggguaagaucguggggcuguacggaaauggcguugugaccacguccggcacauaugucagugccauagcacaggcuaaagccucucaggaggggccccuuccugaaaucgaggaugaaguguuccgaaagcggaaccugacuauuauggacuugcauccgggaagcgguaaaacccgcagauaccuaccagcgaucguaagggaggccauuaagcggaagcugcgaacacucaucuuagcacccaccagagugguugcuuccgaaauggccgaggcucugaaaggcaugccuauacgcuaucaaacuaccgcagucaagucagagcacacagggaaagaaauuguggaucuuaugugccaugccacguuuacuaugaggcugcucucuccagugcguguccccaauuacaacaugaucaucauggacgaggcccacuucaccgauccuagcaguauugcugcgcggggauauaucuccacaagaguaggcaugggugaagcagccgcuauauuuaugaccgccacuccgcccgggagcauggaggcauucccacagucuaaugccgugauucaggacgaagagagggauaucccugagcgcucauggaacuccggauacgaauggauuacagacuuucccggcaagaccguuugguucgugccaaguaucaaagcuggcaaugauauagcgaacuguuugcgaaagaaugggaagagagucauucagcugagccggaaaacguuugacacugaguaucaaaagacaaaaaacaacgauugggacuacgugguuaccaccgacaucucggaaaugggagccaauuucagggcagaucgcgugaucgacccucguagaugccucaagcccgucauucugaaagaugguccagagcgggugauccuugcuggcccgaugccuguaacuguggccucugcagcccagaggcgcgggcgaauuggaagaaaccauaauaaggagggcgaccaguacauauauaugggucagccccuaaacaaugaugaagaccacgcucacuggacagaggccaagaugcuguuggauaacaucaauaccccagaagggauuauccccgcguuauucgagccugaacgggagaaauccgcagccaucgacggcgaguacaggcugcgcggagaagcuagaaagacauuuguugagcucaugaggcggggcgaucugccagucuggcuuagcuauaaaguggccucagaaggguuccaauacagugaccgucgcuggugcuuugauggagagcgaaacaaucaggugcuggaagagaacauggacgucgagauuuggacuaaggaaggugagagaaaaaagcucaggccccggugguuggaugcucgcacguauucugacccucuggcacuaagagaauucaaagaguuugccgcuggcaggcgguccguuagcggggaccugauacucgaaaucggaaagcuuccgcagcaucugacccagcgagcccaaaaugcauuagauaacuuggugaugcugcacaauucagagcagggcgguagagcguaccgccaugccauggaggaacucccagacacaauugagacucugaugcuucuggcucucaucgccguauugaccgggggcgugacacuguucuuuuuaaguggaaagggccuagggaaaaccagcauuggacugcucugugucauggcauccucugugcuucuguggauggcuagcguugaaccccacuggaucgccgcauccauaaucuuggaguucuuucugauggugcuccugauuccugagcccgauaggcagcggacuccacaggacaaccaacuugccuaugucguaaucggucuccuguucaugauuuugacgguggcugcgaaugaaaugggccuguuagagaccacaaagaaagaucuagggaucggacacguugccguggaaaaccaucaccaugcagcuaugcuggacgucgaucuccacccugccucagccuggacucuuuacgcaguggcuaccacaauaauuacccccaugaugcgucauacuaucgagaacacaacggccaauauuucucugaccgcgaucgcuaaccaggccgcaauauugaugggccuggacaaggguuggccaaucaguaaaauggauauuggggucccucuccuggcccuuggcugcuacucgcaggugaauccguuaacucugacagcugcaguucucauguugguggcccacuaugcgaucauuggacccggccugcaagcuaaggccaccagagaagcacagaagaggaccgccgcugggaucaugaaaaacccaacaauagacggaauuguagccaucgaucuagacccuguggucuacgaugcaaaguuugagaaacagcugggccagaucaugcuccuuauucuguguacuagccaaaucuugcugaugcgcacgaccugggcucucugcgaguccauaacacuggccacuggucccuuaaccacacuuugggaagggucuccaggaaaguucuggaauaccacuauugcgguuucaauggccaacaucuuucggggcagcuaucuggcaggugcuggccucgccuucucccuaaugaaaagucuggggggaggccgaagagggacgggagcacagggcgagacauugggugaaaaguggaagaggcagcugaaucagcucucuaaaagcgaguucaacaccuacaagcgcucagggauuauggaaguggaccgguccgaggcuaaagagggacuuaagagaggcgaaacuaccaaacacgccgucagucgugguacagccaagcugaggugguuuguggagcggaauuugguaaagccugaaggcaaagugaucgaccugggguguggacgcggcggguggagcuauuacugcgcgggacucaagaaaguuacugaggugaagggcuauaccaaaggugggcccggacaugaagagccgauaccaauggcuacauacggcuggaacuuagucaagcugcacucuggcaaagauguguucuuuaucccucccgagaagugugacacgcuucugugcgauauuggggaauccucaccaaaucccaccaucgaggaaggacgaacucuaagaguccucaagaugguggagccuuggcugagggguaaccaauucuguauuaaaaucuugaauccguacaugcccagcguuguagagacacuggaacagaugcagcggaagcauggcgggaugcucgugcgcaacccacuuucgagaaauucuacccacgagauguauugggucaguugcggaacuggcaacauuguguccgcaguuaauaugacaagcaggaugcuguuaaaccgauuuaccauggcccaccggaaaccuacguacgaacgugacguggaucugggugcugggaccagacaugucgccguggagcccgaaguagcaaacuuggacaucauaggacagcgcauugagaauaucaagcacgagcauaaaucaacauggcacuaugaugaagacaacccuuacaagacuugggccuaucauggcuccuacgaggugaagccaucuggcagcgcuaguuccaugguuaauggggucgugaaacuccugaccaagcccugggaugugaucccuauggucacacaaauugcgaugacugacaccacaccauucggacagcagaggguuuuuaaagaaaagguggauacccggacucccaaagccaagagagguacggcacaaauaauggagguaacagcucgcuggcuauggggcuuccuuagcaggaacaagaaaccgcgaaucuguacccgggaagaguuuacuagaaaggugaggucuaaugccgcaauuggggccgucuucguggacgagaaccaguggaauucagcuaaagaagccguugaggacgaucgcuuuugggaccuggugcaccgugaacgggagcuccacaagcagggaaaaugcgcgaccugcgucuauaacaugaugggcaagagagaaaagaaacugggugaguucgggaaggcaaaaggaaguagggccaucugguacaugugguugggcgcucgcuuucuggaguucgaagcccucggcuucaugaaugaggaucauugguuuucccgagaaaacagccuuucugggguggagggagagggucugcacaaguuaggcuacauucugcgggacaucucgaaaauaccugggggaaauauguaugcagaugacacagcuggcugggauacgagaaucaccgaagacgauuugcagaacgaggccaagauuacugacaucauggaaccagagcaugcucuccuggccaaaucaauuuucaagcuaacauaccaaaauaagguaguuagggugcagcgccccgcaaaaaacgguaccgucauggaugugaucagcagacgggaccagaggggguccggacaggugggcacuuauggccuuaauacauuuaccaacauggaagcgcaacugauacgucagauggagagugaggggauuuuccucccuaacgaacuggagacaccaaauuuggccggacgagucuuagauuggcuggaaaaguacgguguugagcgccucaaaagaauggcuaucucuggcgacgacugugugguaaagcccaucgaugaccgguuugccacugcacuuaccgcucugaacgauauggggaaagugaggaaggacauuccgcagugggaaccuagcaagggauggaaugauuggcagcaaguccccuucugcucccaccacuuucaucagcuaauaaugaaagacggccgcgagaucgugguuccauguagaaaccaggaugagcuggugggucgggccagggucucacagggggcaggauggagucuccgagaaacggccugcuugggcaagucuuaugcgcaaauguggcagcugauguacuuccaccguagagaccuucgccuggcugccaaugcaauuuguagcgccgugccuguagauuggguucccaccucccggacaacuuggucaauccaugcucaccaucaguggaugaccacagaggacaugcucagcguguggaacagggucuggauugaagagaauccauggauggaagauaaaacuagaaucucuuccugggaggacgugcccuauuuaggcaagcgcgaggaccaauggugcgggagucugauaggauugaccgcccgggcaacgugggcuacaaacauccagguugccauuaaucaggugaggcgacugaucgguaacgaaaauuacagcgauuacaugaccucgaugaaaagauuuaagaacgaguccgaaccugagggcgcgcucugguga

SEQ ID NO: 13966 - RNA, 9879 nt, Artificial Sequence
  derived and/or modified CDS sequence (opt3) from DENV-1__GU131804__SS-prME
agcgugaccauguuccugaugcucaugcccacagcacuugcuuuucaccugacuacgcggggaggggaaccucauaugaucgucuccaagcaggaaaggggaaaaucuuuguuauucaagaccucagccgguguuaacaugugcacacugauugccauggaccuaggcgaacucugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuggcaccccaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcugcccuggacuuccggcgccucaacaagccaagagaccuggaaucggcaggaccuucugguaacauuuaaaacugcacacgcuaagaagcaggaaguuguggucuuggguagucaagagggggccaugcacaccgcucucacgggcgccaccgaaauccagacaucuggaacuaccacaauuuucgcaggccaucugaaaugccguuuaaagauggauaaacugacucuaaaggggauguccuaugugauguguaccgguagcuucaaacucgagaaggaacuggccgagacgcagcacggaacaguccuugugcagauaaaguacgagggcaccgacgcuccuugcaaaaucccauuuucgacucaagaugaaaaggggguuacacagaacggacgcuugauuaccgcgaaucccaucgugacugacaaagagaagccuguaaacauagaagcagagccacccuucggcgagucuuauauugucaucggugccggggaaaaagcucugaagcucuccugguuuaagaaaggcucaaguaucggaaagauguucgaggccaccgcaagaggcgccaggcggauggcuauucugggggauacagccugggacuuuggaagcaucgguggcguguucacguccguugggaaacuugugcaucagauuuuuggaaccgcauacggcguccuguucucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuuugucaccaaugagguucacacguggacagaacaauauaaguuccaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguuuacugugguagucggcgauguggcagggauucuggcucagggcaagaagaugauccgcccucaacccauggaguacaaauauucguggaaaagcuggggcaaggccaagauaaucggggcggacguucagaauaccacauucauuaucgauggaccaaacacuccugaaugucccgacgaucagagagccuggaauauuugggagguggaggacuacggcuuugguaucuucaccacaaacauauggcuuaaguugagggauuccuauacgcaggucugcgaccaccgucucaugucagcugcaauuaaagauaguaaggccgugcacgcugacaugggguacuggaucgaaucugagaaaaaugaaaccuggaagcuggcccgggcauccuucauugagguuaagacuuguaucuggccaaaaucccauacacuauggucaaacggagugcuggaaagcgagaugauaauccccaagauuuauggcgguccuaucucucaacacaauuaccgaccaggcuacuuuacccagacugcggggccguggcaucucggaaaacuggagcuugauuucgacuugugcgaaggcacaaccguagucguggaugagcacugcgggaacagaggacccucccugaggacgacuaccgugacaggcaagauuauccacgaaugguguugccgcaguuguaccuuaccuccacuccgguuuagaggugaggacgggugcugguauggaauggagauaaggcccgucaaagaaaaggaggaaaaucugguuaagagcauggugucugccggcuccggugagguagacucauucagucuuggccuguuguguauuagcaucaugaucgaagaggugaugcgcucgcgauggucccggaaaaugcucaugacugggacacuggcugucuuuuuccuacugauuaugggacagcucaccuggaacgaucugauccgucuuugcauuauggugggcgccaaugcaucugacagaauggggaugggaacaacuuacuuggcucugauggccaccuuuaagaugaggccuauguucgcaguuggcuuacucuuucgccggcugacgagcagagaggugcuucugcuaacaauaggucucucacuggucgccaguguggaauugccaaacucccuggaggaauuaggggauggacucgcuaugggcaucaugauucugaaacuucugaccgacuuccaaucucaucaguugugggcgacucuccugagccuaaccuuuaucaagacaacuuucucccugcacuaugccuggaaaaccauggcaaugguucuuucaauugugagccucuuuccccuguguuugaguacgacaucucagaagaccacuuggcugccggucuuacucggcucccuggggugcaagccucuuacaauguuccugaucgcugagaauaaaauauggggaaggcgaagcuggccauugaacgaagguaucauggccguaggcauugugucgauccuccugucaucucuacugaagaacgauguuccccuugccgggccucucauugcuggaggcaugcugaucgcauguuacgugauaagugguuccagcgccgacuugucuuuagagaaagcggcugaggucagcugggaagaggaagccgagcauuccggggcaucacacaauauucugguggaaguacaggaugacggaaccaugaagaucaaagaugaggagcgcgacgauacucucacaauccugcuuaaggccacccuguuggcugugaguggcgucuauccccuaagcauuccagcaacgcuguucguuugguacuuuuggcagaaaaagaagcagcggucuggcgugcucugggacacuccuucacccccagaaguggagagagccguccuggaugacgggauauauaggaucaugcagcguggacuuuuaggucgcagccaggugggcguugggguauuccaagaaaacguguuucauaccauguggcacgucacacggggagcggugcugauguaccagggcaaaagacucgagccgaguugggcuagcguuaagaaagacuugauuuccuacggugggggauggaggcugcagggcucuuggaauaccggcgaggaagugcaggucaucgccguggagccugggaagaaccccaaaaauguacaaacagcaccaggaacuuucaagacccccgaaggugaggucggcgccauugcucucgauuuuaagccugggacgucgggaagcccaaucgugaaccgagaaggcaaaauaguuggucuguaugggaauggaguggucacaacuucaggcaccuacguguccgccaucgcacaggcucgggccagucaggagggcccccuuccugagauugaagacgagguuuuccgcaagagaaaccugacaaucauggauuugcacccggggucuggaaaaaccaggcgguaucuaccagcgauugugcgagaagccaucaagagaaaacugcgcacucucauauuagcacccaccagggucguggcuagcgagauggccgaagcucugaaggguaugccuauucguuaccaaacaacggcaguaaaguccgagcauacuggcaaagagaucguggaccuuaugugccacgccaccuuuacaaugcggcugcucucaccaguuagaguccccaauuauaacaugaucauuauggaugaagcccauuucaccgacccuucuagcaucgcugcgaggggguacauaaguacucgcgugggaaugggcgaggcagccgcuauuuuuaugacagccaccccgcccgguuccguggaagcauucccacagagcaaugccgucauccaggaugaggaacgagacauuccugagagaucuuggaacucaggguaugaguggaucacggauuuucccggaaagacuguaugguucgugccauccauaaaaaguggcaaugacauugcuaacuguuugcggaagaauggcaaaaggguuauccagcugagccgcaagacauucgauaccgaauaccaaaagaccaaaaacaacgacugggacuacguggucacuacagauaucucggagaugggggcgaauuuucgugccgacagagugauugauccucggaggugccucaagcccguuauccugaaagacggaccagaacgcgugauucuugcagguccgaugccugucaccguggcuucugccgcacagcgaagaggccggauagggaggaaccacaauaaggagggagaucaguauaucuacaugggccagccccuaaacaaugacgaggaucaugcccacuggacagaagcuaaaaugcuguuggacaacauuaauacuccagaggguaucauccccgccuuauucgaaccugagcgcgaaaaguccgcggcaauugauggggaguauagacugaggggcgaggcccggaagacguuuguagaacucaugcgucgcggagaccugccaguguggcuuagcuacaaaguugcuucagagggcuuccaauauagugaucgaagauggugcuuugacggggaaaggaacaaucagguccuggaggaaaacauggauguggagauauggaccaaggagggagaacggaaaaagcuccgccccagaugguuggacgccaggacauacucugacccucuggcucuacgggaguucaaagaauuugcagccggucgaagauccgugagcggcgaucugauccucgagauugggaaacuuccgcagcaccugacucagcgcgcucaaaaugccuuagacaacuuggucaugcugcauaauucagaacagggaggcagggcauaucggcacgcgauggaggagcucccagauaccaucgaaacacugaugcuucuggcccucauugcuguuuugaccgguggggugacucuguucuuuuuaaguggccguggacuaggcaaaacgagcaucgggcugcucuguguaauggccuccucugugcuucuguggauggcaagcgucgagccccauuggauagcugccuccaucauuuuggaguucuuucugauggugcuccugaucccugagcccgacagacagaggaccccacaggauaaccaacuugcauacguugugauuggacuccuguucaugaucuugacagucgccgcuaaugagaugggucuguuagaaacuaccaagaaggaccuaggcauagggcacgcggccguagagaaccaccaucacgcagcuaugcuggauguggaccuccauccugccucagccuggacacuuuacgcaguugcuaccacuauuaucacacccaugaugcgccacacgauugaaaacaccacugccaauaucucucugacagcgauagcuaaccaggccgcaaucuugaugggacuggauaaaggcuggccaauuaguaagauggacaucggugugccucuccuggcccuugggugcuauucgcaggucaauccguuaacccugaccgcugcagugcucauguuggucgcccauuacgcgauuaucggccccggacugcaagcuaaagccacacgggaggcacagaagcgaacugccgcuggcauaaugaaaaacccaacgguggaugggauuguugccaucgaccuagauccugugguauaugacgcaaaguuugaaaagcagcugggacagaucaugcuccuuauucuguguaccagccaaaucuugcugaugagaacaacuugggcucucugcgaguccauaacccuggccacaggccccuuaaccacucuuugggaggguucuccagggaaauucuggaauacgacaauugcggugucaauggccaacaucuucaggggaagcuaccuggcaggcgcuggucucgccuuuucccuaaugaagagucugggcgggggacgccggggcaccggggcacagggagaaacuuugggcgagaaauggaagagacagcugaaucagcucucuaaaagcgaguucaacaccuauaagcguucagguauuauggaggucgacagguccgaagcuaaggaggggcuuaaacggggagagacaacuaagcacgccguuagucgcggcaccgccaaacugcgaugguuuguggaaagaaauuuggucaagccugaggguaaagugaucgaucugggcugugggaggggaggcuggagcuacuauugcgcggggcucaagaagguaacagaagugaaaggauacacgaagggcggucccgggcacgaggaaccgauaccaauggcuaccuacggauggaacuuaguuaaacugcauucuggcaaggacguguucuuuaucccucccgagaaaugugauacucuucugugcgacauuggcgaguccucaccaaaucccacaaucgaagaggggcggacccuacgcguccucaagaugguggaaccuuggcugagaggaaaccaauucuguauuaaaaucuugaauccguauaugcccagcgucguggagacucuggagcagaugcagaggaagcacgguggcaugcucguucgaaacccacuuucgagaaauucuacacaugaaauguacuggguaaguugcgggaccggaaacauuguguccgcagucaauaugacgagccguaugcuguuaaacagauuuaccauggcccaccgcaagccuacauaugagagggauguggaccugggcgcugguacucggcacguugccguggaacccgaggucgcaaacaucgauauaauugggcagagaaucgaaaauaucaaacaugagcacaagucaaccuggcauuacgacgaggauaacccuuauaaaacaugggccuaccacggauccuaugaagugaagccaucuggcagcgcuaguuccaugguaaauggcgugguuaaauugcucacuaagcccugggacgucauuccuauggugacccaaauagcgaugacagauaccacuccauucgggcagcagcgcguguuuaaggagaaagucgacacgaggacacccaaggccaaacgaggaaccgcacaaaucauggaaguuacugcuaaguggcugugggguuuccuaagccggaacaaaaagccgagaauuuguaccagggaggaauuuacacgcaaggugcguucuaaugccgcaaucggcgccguauucguggacgagaaccaguggaacucagcuaaagaggccgucgaagaugagcgguuuugggaccuugugcauagagaaagggagcugcacaagcaggggaaaugcgcgacgugcguuuacaacaugaugggaaagcgcgagaaaaagcucggcgaguucgguaaggcaaaagggagucgagccauuugguacauguggcugggagcucgguucuuggaguuugaagcccugggcuucaugaaugaggaucacugguuuuccagagaaaacagccucucuggcguggagggggagggacuucauaagcuggguuauaucuuaagggacauaucgaaaaucccuggcgggaauauguacgcagaugacaccgcuggaugggauacucgcauuacagaagacgaucugcagaacgaggccagaaucaccgacauuauggaaccagagcacgcuuugcucgccaagucaaucuucaaacugacuuaucaaaauaaggucgugcggguacagaggcccgccaaaaauggcacaguuauggaugugauaagccgucgagaccagcgcgguuccgggcaggucggaaccuacggccuaaauacauuuacuaacauggaagcgcaacuuauuagacagauggagagugagggcaucuucucuccuagcgaacuggagaccccaaaccucgccgaacgggugcuggauugguuggagaaguaugggguggaaagguuaaagcgcauggcuaucuccggagacgacugugucguuaaacccauugaugacagauuugccacggcacugaccgcucucaaugauauggguaaggugcggaaagacauaccgcagugggagccuucaaagggcuggaacgauuggcagcaaguacccuucugcagucaucacuuucaccagcuuaucaugaaagacgggagggagauuguggucccaugucgaaaucaggaugaacuggugggacgugccagaguuucucagggcgcagguuggagccuacgcgagacagccugccuggggaaguccuacgcgcaaauguggcagcucauguauuuccaucggagggacuugagacuggcugccaacgcaaucuguucagccgugccugucgauuggauucccacuagccgcaccacauggucuauccacgcucaucaccaguggaugacuaccgaagacaugcuuuccguguggaaucggguauggauagaggaaaacccauggauggaggauaagacgcauaucaguagcuggggagacguucccuaccugggcaaaagggaggaccaauggugcggcucgcucauuggguuaacagcccgagcaaccugggcuacuaauauccagguggccauuaaccaggucagacggcugaucggaaaugaaaacuacuuggauuauaugacauccaugaagagguuuaaaaaugagucugacccugaaggugcgcugugguga

SEQ ID NO: 13967 - RNA, 9879 nt, Artificial Sequence
  derived and/or modified CDS sequence (opt3) from DENV-1__GU131805__SS-prME
uccgugaccaugcugcucaugcuuaugcccacagcacuggcuuuccacuugacuacgcggggcggggagccucauaugaucgucuccaagcaggaaaggggaaagucuuuacuguuuaagaccucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccgauccugccgugcucaggaaacugugcauugaagcuaagaucucuaacacgaccacagacagccgguguccaacucaaggagaggccacccuugucgaggaacaggaugcaaauuuuguuugccgccgaacauucguggacagaggcugggguaacggguguggacuguuuggcaaaggcuccuugaugacuugcgcuaaguucaagugcguaaccaaacucgaggggaagauagugcaguacgaaaaucugaaauauucagucauugugacaguucacaccggagaccagcaucaaguggguaacgagaguacugaacacggcacgacagccaccaucacuccccaggcgccuagcccagagauucaguuaccggauuacggggcccugacccucgacuguucucccaggccuggacuugauuuuaaugaaaugguccuguugccaaugaaggagaaauccuggcuagugcauaagcagugguuccuggaccucccccugccuuggacaucaggcgcaagcaccagucaagagacuuggaaccggaaagaucuucuggguacauuuaagacggcucacgccaaggaacaggagguaguuguguuggggucucaggaaggcgcuaugcacaccgcccucacuggagcaacagagauccaaaccuccggcacaacuaccaucuucgccgggcaucugaaaugccguuuaaagauggacaaacugacgcuaaagggaaugagcuaugucauguguaccgguucguucaaacucgaaaaggagguggcugagacacagcacggcacuguccuggugcagauuaaguacgaagggaccgaugcgccaugcaaaauacccuuuucuacacaggacgagaagggaguuacucaaaauggccgccuuaucaccgcaaacccgauugugacggauaaagaaaagccuguaaauaucgaggccgagcccgcuuucggugaauccuauauagucauuggggccggcgagaaagcauugaagcugucaugggugaagaaaggaaguagcaucggcaagauguuugaagccacagcuagaggggccaggcggauggcaauccucggagacaccgcgugggauuucgguuccauuggcgggguuuuuacuucugugggaaaacugguccaucagaucuucggcacagcuuacggugugcuuuuuagcgggguaucauggaccaugaagauuggcauaggagugcuguugacuuggcucggccugaacagucgauccaccagcuuaucuaugacauguaucgccguugggcuggucacgcuauaccucggagugauggugcaggcagacucaggcugcgucauuaauuggaaaggucgcgagcugaagugugggaguggaaucuucggcaccaacgaaguucacacuuggacagagcaguauaaguuucaagccgacagcccaaaaagacuuuccgcugccaucgguaaggcaugggaggaaggcgugugcgggauuaggucugcuacccgguuggagaauauaauguggaaacagaucucgaacgaacugaaccauauucuccuggagaaugccaugaaguuaacagugguagucggagauguggcgggcauccuggcccaggggaaaaagaugauucgcccucagcccauggaauacaaauauagcuggaaguccuggggaaaggcuaaaaucauaggcgcagacguucaaaacacuaccuucaucauugaugguccaaauacgcccgaguguccugacgaucagagagccuggaacaucugggagguggaagacuacggguuuggaauuuucacaaccaauaucuggcuuaaguugagggauucauauacucaggucugcgaccaccgucucaugagugcugccauaaaagauucuaaggcagugcacgcggacaugggcuacuggauugagagcgagaagaaugagccauggaagcuggcccgggcuuccuuuaucgaaguuaagaccuguauuuggccgaaaucacauacacuauggagcaauggugugcuggagucugagaugaucauacccaagaucuauggcgggccuauuucccagcacaacuaccgaccaggauacuucacucaaaccgccggccccuggcaucucgggaaacuggaacuugauuucgacuugugcgagggaacaacgguagucguggaugaacacugcggcaauagagguccuagucugaggaccacuacagugccagggaagaucauucacgagugguguugccgcagcuguaccuuacccccgcuccgguuuaaaggagaggacggcugcugguaugguauggaaaucucuccugucaaggagaaggaagagaaccugguuaaauccauggugucagcaggcaguggggaaguagacagcuucucgcuuggacuguuguguauauccauuaugaucgaggaggugaugagaucuagguggagccgcaagaugcucaugacuggcccacugcccgucuuuuuccuacugaucauggggcagcucccuuggaaugaucugauucgacuuugcaucauggugggagcuaacgccucagaccggaugggcauggguacacccuacuuggcacugauggccaccuuuaaaaugcguccaauguucgcuguuggguuacucuuuagaaggcugacgagucgcgaaggacuucugcuaacuauuggccucucccugguggcgucugucgaguugccuaauagccuggaagaguuaggcgaugggcucgccaugggaauaaugauccugaaacuucugaccgacuuccagucccaucaauugugggcaacacuccuggcucuaaccuuuauuaaaacuacauucucacuggauuaugccuggaagaccauggccauggugcuuagcaucguuagucucuuuccccuguguuugucuacaacuucccagaagaccacguggcugccaguguuacucgguagccugggcugcaaaccgcuuacaauguuccugauugcugaaaacaagaucugggggcggaaaucguggccuuugaaugagggaauaauggcagucggcaucguaucaauucuccugucugcccuacugaagaacgacgugccccuugcggguccacucaucgcugggggaaugcugauugccuguuacguuaucaguggcuccagcgcagauuugucuuuagagaaagccgcugaagugagcugggaggaagaggcagaacacuccggcgggucacauaacauacuggucgaggugcaggacgauggaaccaugaagauuaaagacgaggaaagagaugccacucucaccauccugcuuaaggcgacacuguuggcuguaagugguguguauccccuaagcaucccugccacucuguuugucugguacuucuggcagaagaaaaagcaaaggucuggcguucucugggacaccccaucacccccugagguggaacgagcagugcuggaugacgggauuuaucgcauaaugcagcggggacuuuuaggcagaagccaggucgguguggggguuuuccaggagaauguauuucacacgauguggcaugugacaaggggagccguccugauguaccaaggcaaacgucucgagccgaguugggcuagcgugaagaaagacuugaucuccuacggcgggggauggcgccugcaggguucuuggaacaccggcgaagagguucaggugauugccgucgaaccagggaagaaucccaagaacgugcagacugcaccuggaacauucaaaaccucggagggcgaaguaggugcuaucgcccucgauuuuaagccagggacuagcggaucacccauugucaaucgggagggcaaaaucgugggccuguaugggaacggaguugugacaaccuccgguacguacgucagugcgauagcccaagcaaaggcuucucaggagggcccucuuccggaaaucgaggacgaaguguucagaaaaaggaaucugacuauuauggauuugcaccccgggagcggaaagacccgacgguaucuaccagccaucguucgcgaggcuauuaagagaaaacugaggacacucaucuuagcaccuacccggguggucgccuccgaaauggccgaggcucugaagggcaugcccauacgauaccagacaacugcggugaaaucagagcacaccgguaaggaaauuguagaccuuaugugccaugcaacguuuacaaugagacugcucucuccagugcgcguuccuaacuauaauaugaucaucauggaugaggcccacuucacugaccccagcaguauugcugccaggggguacaucuccacccgugucggaaugggcgaagcagccgcuauauuuaugacagcgaccccaccgggcagcguggaggccuucccucaaucuaacgcagugauucaggaugaagaacgggacauccccgagagaucauggaacuccggguaugaauggauuacugauuuuccaggaaaaaccgucugguucguacccaguaucaagagcgguaacgacauagcuaauuguuugaggaagaacggcaaacgcgugauucagcugucgcgaaagacauuugauacggaguaccagaaaacuaagaauaacgacugggacuacguugugaccacagauaucucugaaaugggggccaacuucagagcagaccgggucaucgauccuaggcgcugccucaaaccagugauucugaaggacggacccgagcguguuauccuugccggcccuaugccggugaccgucgcuuccgccgcgcaaagacgggguaggauugggcgcaaucauaacaaggagggcgaucaguauauauacaugggacagccacuaaauaacgacgaagaucacgcacauuggacugaggccaaaaugcuguuggacaauaucaacacacccgaaggcauuaucccugcuuuauucgagcccgaacgagaaaagagcgccgcuaucgauggggaguauagacugcggggagaagcaaggaaaaccuuuguggagcucaugcgcagaggugaccugccaguauggcuuucauacaagguggccagugaaggcuuccaguauucugauaggcgguggugcuuugacggggagcguaauaaccaaguucuggaagagaauauggaugucgagauuuggacgaaagaaggagagcgcaagaaacuccgaccuagaugguuggacgcuaggacuuacuccgacccccuggcccuacgggaguucaaggaguuugcagcgggccgcagaagcgugucaggugaucugauacucgaaaucgggaaacuuccacagcaccugacacagagggcccagaacgcuuuagacaauuuggugaugcugcacaacagugagcaaggcggacgggccuaucgacaugcaauggaggaacucccugauaccauugagacccugaugcuucuggcucucaucgccgucuugacuggcgggguuacacuguucuuuuuaagcggaagaggucuaggcaaaaccuccauugggcugcucugugugauggcaucuagcguacuucuguggauggccuccguggaaccgcacuggaucgcugcgucaauaaucuuggaguucuuucugaugguccuccugauucccgagccagaccgccagaggacaccucaggauaaucagcuugccuacgugguuaucggacuccuguucaugauuuugacuguggcagcuaacgaaaugggccuguuagagacgaccaagaaagaccuagguaucgggcaugucgccguagaaaaucaccaccaugccgcaaugcuggauguggaccuccaccccgcuucugccuggacacuuuacgcgguugcuacuaccauaauuacaccaaugaugcggcauaccaucgagaacacuacggccaacauuagucugaccgcaaucgccaaucaagcugcaauauugaugggccuggauaagggauggccuaucucgaaaauggacauuggcgugccccuccuggcccuugggugcuauagccaggucaacccguuaacacugacugcggcugugcucauguuggucgcccacuacgcaaucauuggaccaggccugcaggccaaggcuacccgugaagcccaaaagagaacagcagcugguaucaugaaaaauccuaccguggaugggauaguugccauugaccuagaucccgugguauaugacgcgaaguuugagaaacagcugggacagaucaugcuccuuauccuguguacuucccagauuuugcugaugaggacaacgugggcccucugcgagucuaucacccuggcaacuggcccauuaacaacccuuugggaagguucacccggcaaguucuggaacaccacaauagcugugagcauggccaauauuuuucgcggguccuaccuggcaggagcuggccucgccuucagucuaaugaaaucucuagggggaggccggcgagguacuggggcccaaggagagacguugggcgaaaaguggaagagacagcugaaccagcucagcaaaucagaguucaauaccuauaagagguccgguaucauggaagucgaccgcagugaggcgaaagagggccuuaagagaggggaaacaacuaaacaugcuguuagcagaggaaccgcaaagcugcguugguuuguggagaggaacuuggucaagccugaaggcaaagugauugaucugggguguggacggggcgguuggucuuacuauugcgccgggcucaagaaaguaacagaggugaagggauacaccaaaggcggcccggggcacgaagaacccaucccaauggcuacuuacggauggaauuuaguuaagcugcacuccgguaaagacguguucuuuauaccucccgagaagugugauacgcuucugugcgacaucggcgaaucaagcccuaacccaacaauugaggaagggcgcacccuacgaguccucaagaugguggagcccuggcugagaggaaaucaguucuguaucaaaauuuugaacccuuauaugccaucggucguggagacucuggaacaaaugcagaggaagcauggcgguaugcucguucggaauccccuuucucgcaacaguacccacgagauguacuggguauccugcgggacaggaaauaucgugagcgccgucaacaugacuucaagaaugcuguuaaauagguuuaccauggcacaucgaaaaccgacauaugaacgggauguggaccugggcgccggcacgcgucacguugcuguggagccugaagucgcgaacuuggauauuaucgggcagagaauagagaacauuaagcacgagcauaaauccaccuggcacuacgacgaagauaauccauauaagacuugggccuaccauggaucuuaugaggugaagcccagcgguagugcauccagcaugguaaacggcgugguuaaacuccugacaaagccuugggacgucaucccaauggugacccagaucgcuaugacugauacaacccccuucgggcaacagcgcguguuuaaagaaaaggucgacacgaggaccccgaaagccaagcggggaacagcacagauuauggagguuacugccaaguggcuauggggcuuccuuucuagaaauaaaaagccucgcauauguaccagggaagaguuuacacgaaaagugcggucaaacgcugccaucggugcgguauucguggacgagaaucaauggaacagugcaaaggaagccgucgaggaugaaagauuuugggaccuggugcacagggagcgcgaacuccauaaacaggggaagugcgcuacuugcguuuacaauaugaugggaaagcgugagaaaaagcugggcgaguucggcaaagccaaggggucccgggcaauuugguacaugugguugggagcuagauuucuggaguucgaggcccucgguuucaugaacgaagaucacugguuuagcagggaaaauucucuuucgggcguggagggggaaggacugcacaaauuaggcuauauccugcgcgacauuucaaagauccccggugggaacauguacgcugaugacaccgccggaugggauacacgaauaaccgaggacgauuugcagaaugaagcaaaaaucacugacauuauggagccagaacaugcgcuccuggccaagagcaucuucaagcuaacguaucagaacaaagucgugcggguacaaagaccugcuaagaauggcacaguuauggaugugauuuccaggcgcgaccagagaggcagugggcaggucggaaccuacggucuuaacacuuuuaccaauauggaggcccagcugauccggcaaauggagucugaaggcauauucagccccuccgagcucgaaacaccaaaccuggcagggaggguguuggauugguuagagaaacacggaguggaacgucugaagcgaauggcuauuucaggcgacgacugugucguuaaacccaucgaugaccgcuuugccgcagcccucacggcgcuuaacgauauggguaaggugagaaaggacaucccucagugggagccaaguaaaggguggaaugauuggcagcagguaccguucugcucucaucacuuucaccaacugauuaugaaggacggacgggagauagugguccccuguaggaaccaggaugagcuggugggccgcgcuagaguuagccagggcgccggguggucccugcgggagaccgcaugccucggaaaaucauaugcccagauguggcaauugauguacuuccauaggcgagaccugcgucuugcugccaaugcaaucuguagcgcugugccugucgauugggugccaacuucuagaacaaccugguccauucacgcccaucaccaguggaugacuacagaagacaugcugaguguauggaaccgcguuuggaucgaggaaaaucccuggauggaggauaagacccauauuagcucguggggugacgugccuuaucucggcaaacgggaggaccaguggugcggguccuuaaucggacugacagcgagggcuacuugggccaccaacauacaagucgcaaucaaucaggugagacgcuugauuggcaacgaaaauuaccuggauuacaugacgucuaugaagcgguuuaagaacgagucagacccagaaggugcccucugguga

SEQ ID NO: 13968 - RNA, 9879 nt, Artificial Sequence
  derived and/or modified CDS sequence (opt3) from DENV-1__GU131806__SS-prME
agcgugaccauguuccugaugcucaugcccacggcccuugcuuuucaccugacuacgcggggcggggaaccucauaugaucgucuccaagcaggaaaggggaaaaucuuuguuauucaagaccucagccgguguuaauaugugcacacugauugccauggaccugggcgaacucugugaagauacuaugaccuacaaaugcccacggauaacagaaaccgaaccggacgauguggacuguuggugcaaugcgacugauacaugggugaccuaugggacguguagucaaacuggagagcaccgccgagacaagcguagcguggcucuggcaccacaugucggccuuggucuggagaccagaacagaaacuuggauguccucugagggggcauggaaacagauccagaggguggaaaccugggccuugcggcacccuggauuuacaguuauugcucucuuccuggcacaugccaucggcaccucgauuacgcagaagggcaucauauuuauccugcucauguuagugacuccaucaauggcuaugcgcugcgucgggauuggaagcagagauuucguggagggucugaguggcgccacauggguagacguugugcuugagcacggguccugugucaccacuauggcgaaggauaaacccacauuggacaucgaacugcuaaagaccgaggugacgaacccugcagugcucaggaaacugugcauugaagccaagaucucuaauaccacaacugauagccgguguccaacccaaggagaggcuacacuugucgaagaacaggacgccaacuuuguuugccgccgaacuuucguggauagaggcugggguaauggguguggacuguuuggcaaaggcuccuugauaaccugcgcaaaguucaagugcguaacaaaacucgaggggaagauugugcaguacgaaaaccugaaauauucagucaucgugaccguucacacuggagaccagcaucaaguggguaaugagaguacggaacacggcacaaccgcuacuauuacaccccaagccccuaccaccgagauccaguuaacugacuacggggcgcugacacucgauuguagcccaaggacgggacuugacuuuaacgaaaugguccuguugaccaugaaggagaaaucuuggcuagugcauaagcagugguuccuggaucucccgcuggccuggacuuccggcgguucaacaagccaagagaccuggaaucggcaggaccuuguaguuacauuuaaaacugcacacgggaagaagcaggaaguggucgugcugggcagucaagagggagcuaugcacaccgccuugacgggcgcuaccgaaauccagacaucugggacuaccacaauuuucgccggacaucucaaaugccgucugaagauggauaaauuaacucugaaggguauguccuaugucauguguaccggcagcuucaaacuagagaaggaacucgcagagacgcagcacgggacagugcugguucagauaaaguacgagggaaccgacgcccccugcaaaaucccuuuuucgacucaagaugaaaagggcgugacacagaacggucgccuuauuaccgcuaauccaaucguaacugacaaagagaagcccgucaacauagaagcggagccuccauucggggagucuuauauugugaucggcgcaggagaaaaagccuugaagcuguccugguuuaagaaaggcucaaguaucgggaagauguucgaggcuaccgccagaggagcaaggcggauggccauucucggugauacagcuugggacuuuggcagcaucgggggaguuuucacguccgugggcaaacugguccaucagauuuuugguaccgccuacggggugcuuuucucuggcguaagcuggacuaugaagauaggaaucggcgugcuguugacauggcucgggcuaaauucacgaaguaccuccuuaagcaugacauguauugcaguuggacuggucacucuauaccucggcgugauggugcaggcggauucugguugcgucaucaacuggaaagggcgcgaacugaaguguggaucaggcaucuuuguuaccaaugaggugcacacguggacagaacaauauaaguuccaggcugacagucccaaaagacuuagcgccgcaauugguaaggccugggaggagggcgugugcgggauaagguccgcuacccgguuggaaaacaucauguggaaacagauuucuaacgagcugaaucauauccuccuggaaaacgacaugaaguuuacuguagucgugggagauguugccggcauuuuagcacaggggaaaaagaugauccgcccgcaaccuauggaguacaaauauucguggaaaagcuggggaaaggcuaagauaaucggcgccgacgugcagaauaccacauucauuaucgauggucccaacacuccagaauguccugacgaucagagagcguggaauauuugggaggucgaggacuacggguuuggaaucuucaccacaaacauauggcugaaacuuagggauuccuauacacaggugugcgaccaccguuugaugucagccgcuauuaaagauaguaaggcaguucacgccgacaugggcuacuggaucgaaucugagaaaaaugaaaccuggaagcucgcucgggccagcuucauugaggugaagacuuguaucuggcccaaaucccauacacuguggucaaacgguguacuagaaagcgagaugauaaucccaaagauuuauggcgggcccaucucucaacacaauuaccgaccuggauacuuuacccagacugcaggcccauggcaucuggcgaaacucgagcuggauuucgaccuuugcgaagggacaaccgucgugguggaugagcacugcggaaacagaggcccguccuugaggacgacuaccgucacagguaagauuauccacgaaugguguugccgcaguuguacccugcccccuuuacgguuuagaggggaggacggaugcugguauggcauggagauaaggccaguuaaagaaaaggaggaaaaucucguaaagucgaugguaucugccgguuccggcgagguggacucauucagucuggggcuucuguguauuagcaucaugaucgaagaggucaugcgcucgcgauggucccggaaaauguugaugacuggaacacucgcuguguuuuuccugcuaauuaugggccagcugaccuggaacgaucucauccgucugugcauuaugguuggggccaaugcaucugacagaaugggaaugggcacaacuuaccuugcuuugauggccaccuuuaagaugaggcccauguucgcagugggucuguuauuucgccggcucacgagcagagagguccugcuucugacaauagggcuaucacucguggccaguguugaacugccuaacuccuuggaggaacugggagauggcuuagcuaugggcaucaugauucucaaacugcuuaccgacuuccaaucucaucagcugugggcgacuuugcucagccugaccuuuaucaagacaacuuucucccuacacuaugccuggaaaaccauggcaauggugcugucaauugucagccuuuuuccacucugucugaguacgacaucucagaagaccacuugguugcccguacuguuagggucccucggaugcaagccgcugacaauguuccuuaucgcugagaauaaaauaugggguaggcgaagcuggccucugaacgaaggcaucauggccguggggauuguuucgaucuugcucucaucucugcuaaagaacgaugugccacuggccggaccccuuauugcuggcgguaugcucaucgcauguuacgucauaaguggguccagcgccgaccugucuuuggagaaagcggcugaggugagcugggaagaggaagccgagcauuccggaccuucacacaauauuuuaguagaagugcaggaugacggccccaugaagaucaaagaugaggagcgcgacgauacccugacuauccuccugaaggcaacacuucuggccgucaguggcguuuauccauugagcauuccugcuacccuauucgugugguacuuuuggcagaagaagaagcagcggucuggggugcugugggacacgcccuccccaccggaagucgagagagcagugcucgaugacggaauauauaggaucaugcagcguggucugcuuggccgcucacagguugggguaggaguguuccaagaaaacgucuuucauacuauguggcacgugacccggggcgccguuuuaauguaccaggguaaaagacuggagccuaguugggcgagcgugaagaaagaccucauuuccuacgggggaggcuggagguugcagggcucuuggaauacaggggaggaaguccaggugaucgcuguagagcccggaaagaaccccaagaauguccaaaccgcccccgguacauucaagacuccugaaggcgaggugggggcaauugcccuggauuuuaagccaggaaccucgggcagccccaucguuaaccgagaagguaaaauacucgggcuguauggaaauggcguggucacgacaucaggcacuuacguguccgcuaucgcccaggcacgggcuagucaggaggggccucuuccggagauugaagacgagguuuuccgcaagagaaaccugaccaucauggauuugcacccaggaucugguaaaacaaggcgguaucuacccgccauugugcgagaagcgaucaagagaaaacugcgcacccucauauuagccccuacuagggucguggcaagcgagauggcugaagcccugaagggcaugccaauucguuaccaaaccacagcuguaaaguccgagcauacggggaaagagaucguggaccuuaugugccacgcaacuuuuaccaugcggcugcucucacccguuagagucccuaauuauaacaugaucauuauggaugaagcccauuucacagacccgucuagcaucgccgcuaggggauacauaaguacccgcgugggcaugggugaggcggcagccauuuuuaugacugcuacacccccaggguccguggaagccuucccucagagcaaugcagucauccaggaugaggaacgagacauucccgagagaucuuggaacucaggauaugaguggaucaccgauuuuccaggcaagacgguaugguucgugccuuccauaaaaaguggcaaugacauugccaacuguuugcggaagaaugggaaaaggguuauccagcugagccgcaagacuuucgauacagaauaccaaaagaccaaaaacaacgacugggacuacguggucaccacugauaucucggagaugggagcuaauuuucgugcggacagagugauugauccccggaggugccucaagccaguuauccugaaagacgguccggaacgcgugauucuugccggcccuaugcccgucacaguggcaucugcugcccagcgaagagggcggauaggaaggaaccacaauaaggagggcgaucaguauaucuacaugggucagccacuaaacaaugacgaggaucaugcacacuggaccgaagccaaaaugcuguuggacaacauuaauacacccgaggggaucaucccugcuuuauucgaaccagagcgcgaaaaguccgccgcgauugauggcgaguauagacugaggggagaggcacggaagacuuuuguagaacucaugcgucgcggcgaccugcccguguggcuuagcuacaaaguugccucagagggguuccaauauagugaucgaagauggugcuuugacggagaaaggaacaaucagguccuggaggaaaacauggauguggagauauggacgaaggagggugaacggaaaaagcuccgcccuagaugguuggacgcuaggaccuacucugacccgcuggcccuacgggaguucaaagaauuugcugcaggccgaagauccgugagcggggaucugauccucgagauuggaaaacuuccacagcaccugacacagcgcgcccaaaaugcuuuagacaacuuggucaugcugcauaauucagaacagggcgguagggccuaucggcacgcaauggaggagcuccccgauacuaucgaaacccugaugcuucuggcgcucauugccguuuugacagggggcgugacccuguucuuuuuaaguggacguggccuagggaaaacuagcaucggacugcucuguguaauggcuuccucugugcuucuguggauggccagcgucgagccucauuggauagcagcuuccaucauuuuggaguucuuucugauggugcuccugauccccgagccagacagacagaggacgccucaggauaaccaacuugccuacguugugauuggucuccuguucaugaucuugaccgucgcagccaaugagaugggccuguuagaaacaacuaagaaggaccuagggauaggacacguagcuguggagaaccaccaucacgcggccaugcuggauguugaccuccaucccgcaucagcuuggacccuuuacgccguggccacaaccauuaucacuccaaugaugcgccacacaauugaaaacacgaccgcaaauaucucucugacugcuauagccaaccaggcggcuaucuugaugggccuggauaaagguuggccuauuaguaagauggacaucggggucccgcuccuggcccuuggcugcuauagccaggugaaucccuuaacacugaccgcagccguccucauguugguggcucauuacgcaauuaucggaccaggccugcaagccaaagcgacccgggaggcucagaagcgaacagccgcagggauaaugaaaaacccuacuguugauggaauuguggccaucgaccuagaucccguaguguaugacgcuaaguuugaaaagcagcugggccagaucaugcuccuuauucuguguacgagccaaaucuugcugaugagaaccacaugggcccucugcgaguccauaacucuggcaaccgguccauuaacaacccuuugggaggggucuccuggaaaauucuggaauacuacgauugcugucucaauggccaacaucuucaggggcagcuaccuggcgggugccggccucgcauuuucccuaaugaagagucuagggggaggccgccgggggacaggagcucagggcgaaaccuugggugagaaauggaagagacagcugaaucagcucucuaaaagcgaguucaacacuuauaagcguucagggauuauggagguugacagguccgaagccaaggagggacuuaaacggggcgagaccacaaagcacgcagugagucgcgguacugcuaaacugcgaugguuugucgaaagaaauuuggugaagcccgagggcaaaguaaucgaucugggguguggaaggggcggguggagcuacuauugcgccggacucaagaaggugaccgaaguuaaaggcuacacaaagggugggccgggacacgaggaaccaauaccuauggccacguacggcuggaacuuagugaaacugcauucuggcaaggacgucuucuuuauucccccagagaaaugugauacccuucugugcgacaucggggaguccucacccaauccuacuaucgaagagggacggacacuacgcgugcucaagauggucgaaccguggcugagagguaaccaauucuguauuaaaaucuugaaucccuauaugccaagcgugguugagacccuggagcagaugcagaggaagcacggcgggaugcucguacgaaacccucuuucgagaaauucuacucaugaaauguacugggugaguugcggaacaggcaacauugucuccgcggugaauaugaccagccguaugcuguuaaacagauuuacgauggcucaccgcaagcccaccuaugagagggauguugaccugggugcagggacacggcacguggccgucgaaccugagguggcuaacuuggauaucauaggacagagaauugaaaauaucaaacaugagcacaagucaacuuggcauuacgacgaggauaacccauauaaaaccugggccuaccacggcuccuaugaaguaaagcccucuggcagcgcaaguuccauggugaaugggguugucaaacuccugacaaagccuugggacgugaucccaauggugacucaaauugccaugaccgauacaacccccuucggacagcagcgcgucuuuaaggagaaaguugacacuaggacgccgaaggcuaaacgagguacagcgcaaauaauggaagugaccgccaaguggcuauggggcuuccuuagccggaacaaaaagccuagaaucuguacuagggaggaauuuacccgcaagguacguucuaaugcagcuauuggggccguguucgucgacgagaaccaguggaacucagcaaaagaggccguggaagaugagcgguuuugggaccugguucauagagaaagggagcuccacaagcagggaaaaugcgcuacaugcguguacaacaugaugggcaagcgcgagaaaaagcugggugaguucgggaaggccaaaggaagucgagcgaucugguacaugugguugggcgcacgguuccuggaguuugaagcccucggcuucaugaaugaggaucacugguuuuccagagaaaacagccuuucuggggucgagggagagggucugcauaaguuaggcuauauucugagggacaucucgaaaauaccagggggaaauauguacgcugaugacacggccggcugggauacccgcaucacugaagacgauuugcagaacgaggcaagaauuacagacaucauggaacccgagcacgcucuccuggccaagucaauuuucaaacuaaccuaucaaaauaaggugguacggguucagaggccugcuaaaaacgguacugugauggaugucaucagccgucgagaccagcgcggguccggacaggugggcacauacggccuuaauaccuuuacaaacauggaagcccaacugauaagacagauggagagugaggggauuuucucuccaagcgaacucgagacucccaaccuggcagaacggguguuggauugguuagagaaguauggagucgaaaggcugaagcgcauggcgaucuccggugacgacuguguugugaaaccgaucgaugacagauuugccaccgcucucacggcccuuaaugauaugggcaagguacggaaagacauuccucagugggagcccucaaagggguggaacgauuggcagcaagugccauucugcagucaucacuuucaccagcugauaaugaaagacggaagggagaucgucgugccuugucgaaaucaggaugagcugguuggccgugcaagagugucucagggugcuggguggagccugcgcgagaccgccugccucggaaaguccuacgcacaaauguggcaguugauguauuuccaucggagggaccugagacuugccgcgaacgcuauuuguucagccguccccguggauuggaucccaacaagccgcacuaccuggucuauucacgcacaucaccaguggaugacaacugaagacaugcuguccguauggaaucggguuuggaucgaggaaaaccccuggauggaggauaagacccauauaaguagcuggggcgacgugccuuaccucggcaaaagggaggaccaauggugcgggucguuaaucggacugacggcccgagcuacaugggccaccaauauucaggucgcaaucaaccaggugagacgguugauugguaaugaaaacuaccuggauuauaugacuuccaugaagagguuuaaaaaugagucugacccagaaggcgcucucugguga

SEQ ID NO: 13969 - RNA, 9879 nt, Artificial Sequence
  derived and/or modified CDS sequence (opt3) from DENV-1__GU131807__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugccccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagccugaggugaccaacccagcagugcugaggaaacuuugcauugaagccaagaucucuaauacgaccacagauagccggugucccacucaaggagaggcuacccuggucgaagagcaggacgccaacuucguuugccgccgaacauuuguggauagaggcugggguaauggguguggauuguucggcaaaggcucccucauaacuugcgcaaaguuuaagugcguaaccaaacuggaggggaagauugugcaguacgaaaacuuaaaauauucagucaucgugacaguucacaccggagaccagcaucaaguggguaaugagaguacugaacacggcacgacagcuaccauuacuccucaggccccaaccacagagauccagcugaccgacuacggggcgcucacucuugauuguagcccgaggacaggacuggacuucaacgaaauggucuuggugacgaugaaggagaaaucuuggcuaguacauaagcagugguuucuggaucucccccugccuuggaccuccggcgccucaacuagccaagagacauggaaucggcaggaccuucugguuaccuucaaaacagcacacgcuaagaagcaggaaguggucguguuggguagucaagagggggccaugcacacugcucucaccggcgccacggaaauccagaccucuggaacaacuaccauuuuugcaggccaucugaaaugccguuuaaagauggauaaacugacacuacgcgggauguccuaugucauguguacuggaagcuucaagcucgagaaagaaguggccgagacccagcacgguacgguucuggugcagauaaaguacgagggcacagacgcuccaugcaagauccccuucucgacccaagaugaaaaagggguaacucagaacggaagacuuauuacagcgaauccuaucgucaccgacaaggagaaaccagugaacauagaagcagagcccccguuuggcgagucuuauauuguuaucggugccggggaaaaggcuuugaaacuguccugguucaagaagggcucaaguaucggaaaaauguuugaggccacugcaaggggcgcccggcgaauggcuauucucggggauaccgccugggacuucggaagcaucgguggcguguuuacauccgucgggaagcuggugcaucagauuuucggaccugcauacggcguacuuuuuucuggugugagcuggcccaugaaaauagggaucggcguucuguugacguggcucggacugaauucacgcaguaccuccuuaagcaugacuuguauugcggucggccuggugacacuauaccucggggugaugguccaggcugauucuggaugcguuaucaacuggaagggcagagaacugaaaugugguucagggaucuucgugaccaaugaggugcacacauggacugaacaauauaaguuucaggccgacaguccaaagaggcuuagcgcagccauuggaaaagcuugggaggagggcguaugcgguauacgguccgccacccgcuuggaaaacaucauguggaagcagauuucuaacgagcugaaucauauccuccuggaaaacgacaugaaauucacggucgugguuggcgauguggcagggauuuuagcucagggaaagaaaaugaucagaccucaacccauggaguacaaguauucguggaaaagcuggggcaaggccaagauaaucggggcggacguccagaauacaaccuuuauuaucgauggaccaaacacucccgaauguccugacgaucagagggccuggaauauuugggagguggaggacuacggcuucgguaucuuuaccacaaacauauggcugaaacuucgugauuccuauacucagguuugcgaccaccgguugaugucagcugcaauuaaggauaguaaagccgugcacgcugacaugggguacuggaucgaaucugagaagaaugaaaccuggaaacucgcccgagcaagcuucauugagguaaagacauguaucuggccaaagucccauacgcuguggucaaacggaguccuagaaagcgagaugauaaucccgaaaauuuauggcggucccaucucucaacacaauuacagaccuggcuacuucacccagacugcggggccauggcaucugggaaagcucgagcuggauuuugaccuuugcgaaggcacaaccgugguggucgaugaccacugcgggaacaggggacccuccuugcgcacuacaaccguuacgggcaaaauuauccacgagugguguugccggaguuguacucugccuccauuaagauucaggggugaagacgggugcugguauggaauggagauacgccccgugaaggagaaagaagagaaucucguaaagagcauggugucugccggcuccggugaagucgauucauuuagucugggccuucuguguauuagcaucaugaucgaggaagugaugcgaucgcgguggucccguaagauguugaugaccgggacacucgcuguuuucuuucugcuaauuaugggacagcugaccuggaacgaccucaucagacugugcauuauggugggcgccaaugcaucugauaggauggggaugggaacuacauaccuugcuuugauggccaccuucaaaauacgcccgauguuugcagucggccuguuauuccggagacucacaagcagggaggugcugcuucugacuaucggucuaucacucguugccaguguggagcugccuaacuccuuggaagagcugggggacggauuagcuaugggcauuaugauccucaagcugcuuaccgauuuucaaucucaucagcugugggcgacguugcucagccugacauucauuaaaaccacuuuuucccuacacugugccuggaagaccauggcaaugguccugucaaucguaagccuuuucccacucugccugaguacaacuucucagaaaaccacgugguugcccgugcuguuaggcucccucggguguaagccucugacaauguuucuuauagcugaaaauaagaucuggggacgacgcagcuggccccugaacgaggguauuauggccguuggcaucgugucgauuuugcucucaucucugcuaaaaaacgacgucccacuggccgggccucuuaucgcuggaggcaugcucauagcaugcuaugugauuagugguuccagcgccgaucugucuuuggaaaaggcggcugagguaagcugggaggaagaggccgaacauuccggggcaucacacaauaucuuaguggagguccaggacgauggaaccaugaaaaucaaggacgaagagcgggaugacacucugacaauucuccugaaagccacccuucuggcuguuaguggcguguaccccuugagcauaccagcaacucuauucgugugguauuucuggcaaaagaaaaagcagagaucuggcguccugugggauacaccguccccucccgagguggaaagggccguucucgacgacgggaucuaccguauuaugcagcgcggacugcuuggucggucacagguaggcgugggggucuuucaagagaacguguuccauaccauguggcacguuacgagaggagcgguguuaauguaucagggcaagaggcuggaaccaaguugggcuagcgucaaaaaggaucucaucuccuacggugggggauggcgauugcagggcucuuggaauacuggcgaggaggugcagguaauugccgucgaacccgggaaaaacccuaagaaugugcaaaccgcaccaggaacauuuaaaacccccgagggugaaguuggcgccaucgcucuggacuucaagccugggacaucgggaagcccgauagugaaccgggagggcaagaucgucggucucuacgggaauggagugguuacuaccucaggcacguauguguccgccauugcacaggcuaaagccagucaggaaggcccacugcccgagaucgaggaugaagucuuucgcaagagaaaccuuacaauuauggaccugcacccugggucuggaaaaacuaggcgguacuugccagcgaucgugcgagaggccauaaagagaaaacuacgcacccugauucucgcacccacaaggguaguggcuagcgaaauggccgaggcuuuaaaggguaugccuauccguuaucaaaccacugcaguuaaguccgaacauaccggcaaagagaucgucgaucugaugugucacgccacauucacgaugcggcuucugucaccggugagagugcccaauuacaacaugauuaucauggacgaggcccauuuuacugauccaucuagcauagcugcgaggggguauauuaguacccgcgucggaaugggcgaagcagccgcuaucuucaugacagccaccccucccgguuccguagaggcauuuccacagagcaaugccgugauucaggacgaagagcgagauaucccugaaagaucuuggaacucaggguacgaguggauaacugacuuccccggaaagacaguuugguuugugccauccauuaaaaguggcaaugauaucgcuaacugccuccggaagaauggcaaaagggucauccaguugagccgcaagaccuucgacacggaguaucaaaagacuaaaaacaacgacugggauuacgugguuacaaccgacauuucggaaaugggggcgaauuuccgugccgauagagugaucgacccgcggaggugccugaagccugucauucucaaagauggacccgagcgcgugauacuggcagguccaaugcccguaaccguggcuucugccgcacagcgaagaggccggaucgggaggaaccacaauaaggaaggagaccaguacauuuauaugggccagccucuuaacaaugaugaggaccaugcccacuggacugaggcuaaaaugcuacuggauaacaucaauacaccagaagguaucauucccgccuuguuugagccugaacgcgagaaguccgcggcaauagacggggaauacagauuaaggggcgaggcccggaagaccuucguugagcugaugcgucgcggagaucucccggucuggcugagcuauaaaguggcuucagaaggcuuucaauacagugaccgaagaugguguuucgauggggagaagaacaaucaggugcuugaagagaacauggacgucgaaaucuggacaaaagagggagagaggaagaaacugcggccacgcuggcucgacgccagaacuuauucugaucccuuggcucugagggaauuuaaggaguucgcagccggucggcgauccguuagcggcgaccuaauucuggaaaucgggaaacucccucagcaccuuacgcagagagcucaaaaugcccuggauaacuuagugauguugcauaauucagagcagggaggccgcgcauacaggcacgcgauggaagagcugcccgacaccauugagacacucaugcugcuugcccugaucgcuguacucacugguggggugaccuuguuuuuccugaguggccggggauuaggcaagacaagcauagggcuacugugcgucauggccuccucugugcuccuuuggauggcaagcguugaaccacauuggaucgcugccuccauuauccuggaguuuuucuugauggugcugcucauuccugaacccgauaagcagcguaccccacaggacaaccaacuggcauaugucguaaucggacuucucuuuaugauacugacuguggccgcuaaugagauggguuugcuggagacgaccaaaaaggauuuaggcauugggcacguugcgguggaaaaccaccaucacgccgcaaugcuagacgucgaucugcauccugcuucagccuggacacucuacgccguggcaacuaccaucauuacaccgaugaugagacacaccaucgagaacacuacagcuaauauaucucuuacggccaucgcgaaccaggcugccauucugaugggauuggacaaaggcuggcccaucaguaagauggauauuggugucccacugcucgcacugggguguuacucgcaggugaauccucuuaccuuaacugccgcuguucugaugcucguggcacauuaugccaucauaggccccggauugcaagcgaaagcuacaagggaagcccagaagcgcaccgcagccggcauuaugaagaacccaaccguagacgggaucguggcuaucgaucuggacccugucguuuacgacgccaaauucgagaagcagcuaggacagauuaugcugcucauccuuugcacaagccaaauacuguugaugcggacuacgugggcacugugugaauccauuacccucgcuacaggcccccugacuaccuuaugggaggguucuccggggaaauuuuggaauacaaccaucgccgugucaauggcgaacauuuuccgaggaagcuaucuugccggcgcaggucuggcuuucucccucaugaagagucuaggcgggggaagaaggggcacuggggcccagggagagacgcugggcgaaaaauggaagcgccaguugaaucagcugucuaagagcgaguuuaacacauacaaacggucagguaucauggaagucgauagauccgaggcaaaggaagggcucaaacguggagagaccacuaagcacgcugugaguaggggcaccgccaaacuucggugguucguagagcgcaaucuggugaagccagaagguaagguuauagacuugggcugcgggcgaggaggcuggagcuauuacugugccgggcugaaaaaggugacagaggucaaaggauauacuaagggcgguccugggcacgaagagcccaucccaauggcgaccuacggauggaaccucgugaaauuacauucuggcaaggaugucuuuuucauucccccugaaaaaugcgacacacugcuuugugauaucggcgaguccucaccgaaucccacgauugaggaagggagaacccugagggugcuaaagaugguugagccauggcuccggggaaaccaauuuugcaucaagauucugaauccuuacaugcccagcguaguggaaacuuuggagcagaugcagcgcaaacacgguggcaugcuggucagaaacccucucucgaggaauucuacacaugagauguauugggugaguugugggaccggaaacaucguuuccgcugugaauaugacuagccgaaugcuucugaaccgguucacaauggcacaccguaagccaaccuacgaaagagacgucgauuuaggcgccgguacgcgccacguggcuguagagcccgaaguggccaaccuggacauaauugggcagaggaucgagaauaucaaacaugaacacaagucaaccuggcauuaugaugaggacaacccuuacaaaacaugggcauaucacggauccuacgagguuaagccaucuggcagcgccaguuccauggucaauggcguggugaaguugcucacuaaacccugggaugucauuccgaugguuacccaaauagcuaugacagacacuaccccuuuugggcagcagcggguguucaaggaaaaaguagacacaagaaccccaaaggcgaaacgcggaacugcccaaaucauggaggugacggcaaaguggcugugggguuuucuaagcaggaacaagaaaccccgaauuugcacacgggaagaguucaccagaaaggucaggucuaaugcugccaucggcgcaguguuuguugaugaaaaccaguggaauucagccaaagaggcuguggaggacgaacgcuucugggaucuuguccaucgugagcgggaacugcacaagcaggggaaaugcgccacuuguguguauaacaugaugggaaagagagagaagaaacucggcgaauuugguaaggcgaaagggaguagggcaauuugguacauguggcugggagcccgcuucuuggaguucgaggcucugggcuuuaugaaugaagaccacugguucucccgagagaacagccucucuggcguagaaggggagggacuucauaagcuggguuacaucuuacgggauauaucgaaaaucccuggcgggaauauguaugccgacgauaccgcaggaugggacacaagaauuacggaggaugaccugcagaacgaagcuaggaucaccgauauuauggagccagaacacgccuugcucgcuaagucaaucuuuaaacugacuuaccaaaauaagguugugcgcguccagagacccgccaagaacggcacagugauggacgugauaagccggagggaucagcgugguuccgggcaggucggaaccuauggccuaaauacuuucacaaacauggaggcacaacuuauucgacagauggaaagugagggcaucuuuucuccgagcgagcuggaaaccccuaaccucgcggagcgcguucuggacugguuggaaaaauacgggguggagagauuaaagcggauggccaucuccggagacgauugcguagugaaacccauugacgauagguucgcuacagcccugacugcacucaaugacauggguaagguccgcaaagauauaccacagugggaaccuucaaagggcuggaacgacuggcagcaagugcccuuuuguagucaucacuuccaccagcuuaucaugaaggaugggagagagauuguugugccaugccggaaucaggacgagcuggucggaagggcucgagugucucagggcgccgguuggagccuacgugaaaccgcaugucuggggaaauccuaugcccaaauguggcagcucauguacuuucauagacgcgauuugcggcuggcggcuaacgccaucugcucagcaguacccguugacuggauuccuacgagcaggaccacauggucuauccacgcccaucaccaguggaugacuaccgaggauaugcuuuccguguggaauagagucuggauagaagagaacccauggauggaagacaagacacauaucaguagcuggggagacgugccguaucugggcaaacgcgaggaucaaugguguggcucgcucauuggguuaacugcucgggccaccugggcaacgaauauccagguugcuauuaaccaggugaggcgacugaucggaaaugagaacuacuuggacuacaugacauccaugaagagauucaaaaaugaaucugaucccgagggugcccugugguga

SEQ ID NO: 13970 - RNA, 9879 nt, Artificial Sequence
  derived and/or modified CDS sequence (opt3) from DENV-1__GU131811__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaaucggagagcaccgccgagacaagcguagcguggcccuggcaccccaugucggccuuggucuggagacgagaacugaaaccuggauguccucugagggggccuggaaacagauucagaggguggaaacaugggcuuugcggcacccuggauuuacuguuaucgcacucuuccuggcccaugcuauuggcaccucgaucacacagaagggcauaaucuuuauucugcucauguuagugaccccaucaauggccaugcgcugcgucgggaucggaagcagagauuucguggagggucugaguggcgcgacguggguagacguugugcuugagcacggguccugugucacuacaauggcaaaggauaaacccaccuuggacauugaacugcuaaagacugaggugacaaacccugccgugcucaggaaacugugcaucgaagcuaagauaucuaauaccacgaccgauagccgguguccaacacaaggagaggccacucuugucgaagagcaggacgcaaacuuuguuugccgccgaaccuucguggauagaggcugggguaauggguguggacuguuuggcaaaggcuccuugauuacaugcgcuaaguucaagugcguaacuaaacucgaggggaagaucgugcaguacgaaaaccugaaauauucagucauugugaccguucacacaggagaccagcaucaaguggguaaugagaguaccgaacacggcacuacggccacaaucaccccccaggcgccuagcacugagauccaguuaaccgacuacggggcccugacacucgauuguucuccaaggaccggacuugacuuuaacgaaaugguccuguugacuaugaaggagaaauccuggcuagugcauaagcagugguuccuggaucucccgcugcccuggacaucaggcgcaagcacgagucaagagaccuggaaucggcaggaccuucugguaacuuuuaaaacagcucacgccaagaagcaggaaguuguggucuuggguucucaagagggggcuaugcacaccgcccucacaggcgcaacugaaauucagaccuccggaacgaccacaauauucgccggccaucugaaaugccguuuaaagauggauaaacugacucuaaaggggaugagcuaugugauguguaccggaucguucaaacucgagaaggaagucgcugagacacagcacgguacugugcugguucagaucaaguacgagggcaccgacgcgccuugcaaaauuccauuuucuacgcaagaugaaaagggggugacacagaacggacgccuuaucaccgcaaaucccauaguaacugacaaagagaagccugucaacauugaagccgagccacccuucggcgaguccuauaucgugaucgguguuggggaaaaagcuuugaagcugucaugguuuaagaaaggcaguagcauuggaaagauguucgagacaaccgccagaggcgcaaggcggauggccauccucggggauacugcuugggacuuuggauccauugguggcguguucaccucugucgggaaacuggugcaucagauauuuggaacagccuacggcguacuuuucagcggugugucauggacgaugaagaucgggauuggcguucuguugaccuggcucggacugaauagucgauccacuagcuuaucuaugacauguaucgcagucggccuggugacccuauaccucggggugaugguccaggcggauucaggaugcguuaucaacuggaaaggccgcgaacugaagugugguagugggauuuuugugacaaaugaggugcacacuuggaccgaacaauauaaguuccaggcugacagcccgaaaagacuuuccgccgcaauaggaaaggccugggaggagggcguaugcgguaucaggucugcuacgcgguuggaaaacauuauguggaaacagaucucgaacgagcugaaucauauucuccuggaaaacgacaugaaguuaacagucgugguuggcgauguggccgggauccuggcacagggaaaaaagaugauacgcccucaacccauggaguacaaauauagcuggaaguccuggggcaaggcuaaaaucauuggggccgacguccagaauaccacuuuuaucauugauggaccaaacaccccugaaugucccgacgaucagagagcguggaauaucugggagguggaggacuacggcuucgguauauuuacaacuaacauuuggcuuaaguugagggauucauauacccagguuugcgaccaccgucucaugagugccgcuaucaaagauucuaaggcagugcacgccgacaugggguacuggauugaaagcgagaaaaaugaaacauggaagcuggcucgggccuccuucaucgagguaaagacguguauauggccaaaaucacauacccuauggagcaacggaguccuggaaucugagaugaucauucccaagaucuauggcgguccuauuucccaacacaauuaccgaccaggcuacuucacucagacagcagggccguggcaucucggaaaacuggagcuugauuuugacuugugcgaaggcaccacugugguggucgaugagcacugcgggaacagaggacccagucugaggacaaccacgguuacuggcaagaucauacacgaaugguguugccgcagcuguaccuuaccuccacuccgguucaaaggugaggacgggugcugguauggaauggagauuagacccgugaaggaaaaggaggaaaaucugguaaaaucuaugguguccgcgggcucaggugaggucgacaguuuuagccuuggccuguuguguaucucgaucaugauugaagaggugaugaggucccgcuggucucgaaagaugcucaugacagggacccuggccguuuucuuucuacugaucaugggacagcucacuuggaacgaucugauucggcuuugcauaauggugggcgcuaaugccagcgaccguauggggaugggaacaaccuacuuggcacugauggcuacauucaaaaugagaccuauguuugccgucggcuuacucuucaggcgccugacuucacgggaggugcuucugcuaaccaucggucucagucugguugcauccguggaauugccaaacucucuggaggaauuaggggauggacucgccaugggcauuaugauccugaagcuucugacggacuuucaaagccaucaguugugggcuacacuccuguccaugaccuucauuagaacuaccuuuucacuacacuaugcguggaaaacaauggccaugguccugagcaucguaagucuuuucccccucugucugucuacuaccucccagaagacgacaugguugccggugcuguuaggcagccucgggugcaagccucugaccauguuucuuauagcagagaauaaaaucuggggaaggaagucguggccacugaacgaagguauuauggcuguuggcaucgugucaauuuugcucucuagucugcuaaaaaacgaugucccccuggccgggccucuuaucgccggaggcaugcucauagcuuguuacgugauuuccgguagcucugcagaccugagcuuggagaaggccgcgguaguguccugggaggaagaggcugaacauucaggggccagucacaauaucuuagucgagguucaggaugacggaacuaugaaaaucaaggaugaagagcgagacgauacacugaccauucuccugaaagcaacucuucuggccgugagcggcguguaucccuugucuauaccagcuacacuauucgucugguacuucuggcaaaagaagaaacagcgcuccggcgugcugugggacaccccuucacccccagagguugaacgggcaguacucgaugacgggaucuauagaauuaugcagaggggacugcuuggucguagucaggugggcgucgggguguuucaagagaacguuuuccauacgauguggcacgugacucgcggagccgucuuaauguaccagggcaagcggcuggaaccgagcugggcguccgugaaaaaggaccucaucucuuacggugggggauggagauugcagggcucguggaauaccggcgaggagguacaggucauugcuguggaaccugggaaaaaccccaagaauguucaaacagccccaggaaccuuuaagacaagcgagggugaagugggcgcaaucgcccuggauuucaaacccgggacuucaggauccccuauagucaacagggagggcaaggugguuggucucuaugggaauggaguggucaccacgaguggcacauacgugucugcuaucgcccaggcaaaagcuagccaggaaggcccacugcccgagauugaggacgaaguauuucgaaagcggaaccuuacuaucauggaucugcacccuggguccggaaaaacccgcagauauuugccggccauugugagggaggcgaucaagcggaagcuacgaacacugauacucgccccaaccagaguugucgcaucagaaauggcugaggccuuaaaagguaugcccauucgcuaccaaacuaccgcugugaagucugaacauacaggcaaagagaucguggaccugaugugccacgcaacguucacuaugaggcuucugagcccuguccguguaccaaauuauaacaugaucauuauggaugaggcccauuuuaccgaccccaguuccaucgccgcucggggguacauaagcacaagagugggaaugggcgaagcggcagccauuuucaugaccgcuacuccuccggguucuguugaggccuuuccccagucaaaugcagugauccaggaugaagagagggacauuccagaacgcuccuggaacaguggguaugaguggaucacagauuucccuggaaagaccgucugguuugugcccagcauaaaaucgggcaaugacauugccaacugucuccgaaagaauggcaagagaguuauccaguugucucggaaaacguucgauacugaguaccaaaagacaaaaaacaacgacugggacuacguggucaccaccgauaucuccgaaaugggggcuaauuucagggcggaccgcgugauugauccacguagaugccugaagccuguaauccucaaagacggacccgagcgggugauucuggccgguccaaugccgguuacugucgcaagcgcugcccagaggcgcggccgaauagggagaaaccacaauaaggaaggagaucaguauaucuacaugggccagccucuuaacaaugacgaggaucaugcacacuggacagaggccaagaugcuacuggacaacauuaauacccccgaagguaucaucccagcuuuguuugagcccgaacgggagaaaucagccgcgauugauggggaauauagguuacgcggcgaggcaagaaagacauucguggagcugaugaggcggggagaccucccuguguggcugaguuacaaagucgccucugaaggcuuucaauauuccgaucgucgcuggugcuucgacggggagcgaaacaaucagguucuugaagagaacauggauguggaaauauggacuaaggagggagagagaaaaaagcugaggccacgguggcucgacgcucgcacguacagcgaccccuuggcccugagagaauuuaaagaguucgcugcagguaggcggucaguaaguggcgaucuaauccuggaaauugggaagcucccucagcaccuuacccagcgagcccaaaaugcucuggacaacuuagugauguugcauaauagcgagcagggaggcagagccuaucgccacgcaauggaagagcugccggauacaaucgagacucucaugcugcuugcgcugauugccguccucaccgguggggugacauuguuuuuccuguccggcaggggauuaggcaagaccucuaucgggcuacuguguguuauggcuagcuccgugcuccuuuggauggccucagucgaaccacauuggauagcagcuucuaucauucuggaguuuuucuugaugguacugcucauccccgaaccugaccggcagcguacuccccaggauaaccaacuggccuacgugguuauuggacuucucuuuaugauccugacgguggcagccaaugagauggguuugcuggagaccacaaaaaaggacuuaggcauagggcacgucgcuguggaaaaccaccaucacgcggccaugcuagaugucgaccugcauccagcaagugcuuggacucucuacgccguggccaccacaauuaucaccccuaugaugagacacacuauugagaacacaacggcaaauaucucgcuuaccgcuauagccaaccaggcggcuauccugaugggauuggauaaaggcuggcccauuagcaagauggacaucgguguuccacugcucgcccuggggugcuauucccaggugaauccucuuacuuuaacagcagccguacugaugcucguggcucauuacgcaauuaucggcccgggauugcaagccaaagcgaccagggaagcucagaagcgcaccgccgcaggcauaaugaagaaccccacagucgaugggauuguugccaucgaccuggauccaguggucuaugacgcuaaauucgagaagcagcuaggacagaucaugcugcucauucuuuguacuucucaaauccuguugaugcggacgaccugggcccugugcgaaucaauaacacucgcaacuggcccucugaccacauuaugggaggguagccccgggaaauuuuggaauaccacuauugcuguguccauggccaacaucuuccgaggaaguuaccuugcgggcgccggucuggcauucucucucaugaagagccuaggcgggggaagaaggggcacgggggcucagggagagacacugggcgaaaaauggaagcgccaguugaaucagcugucaaaguccgaguuuaacaccuauaaacggagugguauuauggaaguagacagaagcgaggccaaggaagggcucaaacguggagagacuaccaagcacgcagugucuaggggcacagcuaaacuucggugguucguugagcgcaaucuggugaagccagaagguaaggucaucgauuugggcugugggcgaggaggcugguccuacuauugcgccgggcugaaaaaggugacugaggucaaaggauacaccaagggcgguccugggcacgaagagcccauaccgauggccacauacggauggaaccucgugaaauuacauucaggcaaggacguuuuuuucaucccaccugaaaaaugugauacgcugcuuugcgacauuggcgagagcucgcccaauccaaccaucgaggaagggagaacucugaggguacuaaagaugguggagcccuggcuccggggaaaccaauuuuguauuaagauccugaauccuuauaugccgucugucguggaaacauuggagcagaugcagcgcaaacacgguggcaugcugguuagaaacccccucaguaggaauuccacccaugagauguacugggugagcugcgggacuggaaacauugucucagcggugaauaugacaucccgaaugcuucugaaccgguucaccauggcucaccguaagccaacguaugaaagagauguagacuuaggcgcagguacccgccacguggccguugagccugaagucgcuaaccuggauaucauagggcagaggauugagaauaucaaacaugaacacaagucuacauggcauuacgacgaggauaaccccuauaaaacuugggccuaccacggaagcuaugaggugaagccuaguggcuccgcaagcucuauggugaauggcgucguuaaguugcucaccaaaccaugggacgugauccccaugguaacacaaauugccaugacugauaccacaccuuuugggcagcagcggguguucaaggaaaaagucgacaccagaacuccaaaggcuaaacgcggaacggcgcaaauaauggaggugacagccaaguggcugugggguuuucuaucaaggaacaagaaaccccgaaucuguacccgggaagaguucacuagaaagguuaggaguaaugcagcuauuggcgccguguuugucgacgaaaaccaguggaauuccgcaaaagaggccguggaggaugaacgcuucugggaccuuguacaucgugagcgggaacugcacaagcaggggaaaugcgcuaccugcguuuacaacaugaugggaaagagagagaagaaacucggcgaauuugguaaggccaaagggagcagggcgaucugguacauguggcugggagcacgcuucuuggaguucgaggcccugggcuuuaugaaugaagaucacugguucucucgagagaacucgcucucaggcguggaaggggagggacuucauaagcuggguuauauuuuacgggacaucagcaaaauaccgggcgggaauauguacgcugaugacacagccggaugggauacgagaaucaccgaggacgaucugcagaacgaagcaaagauuacugacaucauggagccugaacacgcuuugcucgccaaauccauuuuuaagcugacauaucaaaauaaggucgugagggugcagcgcccagcuaaaaacggcaccgucauggauguuaucaguagacgggaccagagggguucugggcaggugggaacuuacggccuaaauacauucaccaacauggaggcccaacuuauacgucagauggaaagcgagggcauuuuuucccccucagagcuggaaacaccuaaccucgcagggcgagcgcuggauugguuggagaagcauggaguagaacgcuuaaaaagaauggccaucaguggugacgacuguguggucaagccaaucgaugaccgguucgcuacugcccugaccgcacucaaugauaugggcaaagugaggaaggacauuccccagugggagccgucuaagggguggaacgauuggcagcaaguuccuuuuugcagccaccacuuccaucagcuuauaaugaaagacggacgcgaaaucgugguccccuguagaaaucaggaugagcuggugggccgggcuaggguaucccagggugccggguggucacuacgagagacggcaugccugggaaagagcuaugcccaaauguggcagcucauguacuuucaccguagagacuugcgccuggcggcuaacgccauuuguucugcaguuccaguggauugggucccuaccucccggacaacuuggaguauccaugcccaccaucaguggaugaccacagaagacaugcuuagcguguggaauaggguuuggauugaggaaaaccccuggauggaggauaaaacucacaucucguccuggggcgacgugccauaucugggcaagagagaagaccaauggugcgggucucucauaggauuaaccgcucgcgccacgugggcaacaaauauccaggucgcuauuaaccaggugcggaggcuguuggguaaugagaacuaccuggauuacaugaccucaaugaaacgauucaagaaugagagcgaccccgaaggcgcccucugguga

SEQ ID NO: 13971 - RNA, 9882 nt, Artificial Sequence
  derived and/or modified CDS sequence (opt3) from DENV-1__JF937615__SS-prME
agcgugaccaugcugcucaugcuuaugcccacugcccuggcuuuccacuugacuacgagaggaggggaaccucauaugaucgucuccaagcaggaaaggggaaaaucuuuacuguuuaagaccucagccgguguuaauaugugcacacuaauugccauggaccucggcgaguucugugaagauacuaugaccuacaaaugcccacggaucaccgaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccgauccugccgugcucaggaaacugugcauugaagcuaagaucucuaacacgaccacagacagccgguguccaacucagggagaggccacccuugucgaagaacaggaugcaaauuuuguuugccgccgaacauucguggacagaggcugggguaacggguguggacuguuuggcaaaggcuccuugaugacuugcgcuaaguucaagugcguaaccaaacucgaggggaagauagugcaguacgaaaaucugaaauauucagucauugugacaguucacaccggagaccagcaucaaguggguaacgagaguacugaacacggcacgacagccaccaucacuccccaggcgccuagcaccgagauucaguuaacagauuacggggcccugacccucgacuguucuccaaggacuggacuugauuuuaaugaaaugguccuguugacaaugaaggagaaauccuggcuagugcauaagcagugguuccuggaccucccgcugcccuggacgucaggcgcaagcaccagucaagagacuuggaaccggaaagaucuucugguaacauuuaagaccgcucacgccaagaaacaggaaguuguggucuuggguucucaggagggggcuaugcacacagcccucacuggcgcaaccgaaauccaaacguccggaaccacaacuaucuucgccggccaucugaagugccguuuaaaaauggacaagcugacccuaaaagggaugagcuaugugauguguacagauucguucaagcucgagaaggaagucgcugagacucagcacggaaccgugcugguucagauuaaauacgaggguacggacgcgccuugcaagauaccauuuucuacacaggaugaaaaaggcgugacccaaaaugggcgccuuaucacugcaaaccccauuguaacagacaaggagaaaccugucaauaucgaagccgagccacccuucggagaguccuauauagugauuggcgcuggugaaaaggccuugaagcugucaugguuuaaaaaggggaguagcaucggcaaaauguucgaggcaaccgccagaggagcuaggcggauggccauccucggcgauacugcaugggacuuuggguccauuggagguguuuucaccucugugggcaagcugguccaucagaucuuugggacagcguacggagugcuuuucagcggcguaucauggacgaugaaaauugguauaggggugcuguugaccuggcucggccugaacagucgauccacuagcuuaucuaugacauguaucgcuguuggacuggucacccuauaccucggcgugauggugcaggccgacucagggugcgucauuaauuggaagggacgcgaacugaaguguggcagugguaucuuuguuacaaacgaggugcacacuuggaccgaacaguauaaauuccaagcagauagcccgaagagacuuuccgccgcuaucgggaaagccugggaggagggagugugcggcauuaggucugcaacgcgguuggaaaauauaauguggaagcagaucucgaacgagcugaaccauauucuccuggaaaaugacaugaaauuuacaguagucgugggugauguugcuggcaucuuagcccaggggaagaaaaugauucgcccucagcccauggaguacaaguauagcuggaaguccuggggaaaagcgaagaucauaggcgccgacgugcaaaacaccacuuucaucauugaugggccaaauaccccugaaugucccgacgaucagagagcuuggaacaucugggaggucgaggacuacggauuuggcauuuucacaacuaauaucuggcugaaacuuagggauucauauacccaggugugcgaccaccguuugaugagugcagccauaaaggauucuaaagcuguucacgccgacauggguuacuggauugaaagcgagaagaacgaaacauggaagcucgcacgggcguccuucaucgaggugaaaacguguauuuggccaaagucacauacccuguggagcaaugggguacuagaaucugagaugaucauacccaaaaucuauggaggcccuauuucccagcacaacuaccgaccagguuacuuuacucaaacagccggcccguggcaucuggggaagcucgagcuggauuucgaccuuugcgaaggaaccacugucgugguggacgagcacugcggcaauagagggcccaguuugaggacaaccacggucacuggaaaaaucauucacgaaugguguugccgcagcuguacccugccuccauuacgguuuaagggcgaggaugguugcugguaugggauggagaucagacccguuaaggaaaaagaggaaaaccucgugaagucuaugguauccgcuggaucaggcgagguggacaguuucagccugggucuucuguguauaucgauuaugaucgaagaggucaugaggucccgcuggucucgaaaaauguugaugacaggcacccucgccguguuuuuccugcuaaucauggggcagcugacuuggaaugaucucauucggcugugcaucaugguuggagcaaacgcuagcgaccguaugggcauggggacaaccuaccuugccuugauggcaacauuuaagaugagaccuauguucgccgugggacuguuauuuaggcgccucacuucacgggagguccugcuucugaccauuggccuaagucucguggcuuccguugaacugccaaauucuuuggaggaacugggugauggguuagcgaugggaauaaugauccucaaacugcuuauugacuuccagagccaucaacugugggccacguugcucucccugacauuuaucaagaccacuuucucacuacacuaugcauggaagaccauggcuauggugcugagcauugucagucuuuuuccccuccugccgguacaugauuugccuaaaaagacaacuuggcugccaguguuacucggcucucugggcuguaaaccccuuaccauguuccugaucgccgagaacaagauaugggggagaaaauccuggccuuugaaugaaggaaucauggccguugguauugugagcauccuccugucggcucuacugaagaacgacgucccccuugcaggcccacucauugccgggggaaugcugaucgcgugcuacgugauaucaggcucuagugcugauuuguccuuagagaaagccgcagagguaagcugggaagaggaagccgagcacucuggugcuagccauaacauucugguggaaguccaggacgaugggacgaugaagaucaaggacgaggagagggaugacacacucaccauccugcuuaaagcaacucuguuggccguuuccggaguguauccucuaucaauucccgcgacacuguucgugugguacuuuuggcagaagaaaaagcagcgaaguggcguccucugggacaccccaagcccgccugaaguggagcgcgcuguucuggaugacggcauauaucggaucaugcaaagagggcuuuuaggaaggucucagguaggugugggcgucuuccaggaaaauguguuucacacuauguggcacguuacacguggggccgugcugauguaccagggaaaacgccucgagcccuccugggcaucagucaagaaggauuugauuaguuacggcgguggguggcggcugcaaggaagcuggaacaccggcgaggaagugcagguaaucgccgucgagccaggcaaaaaucccaagaacgugcagacggcuccugggacuuucaaaaccuccgaaggagagguuggugccauugcacucgacuuuaagccaggcacaucugggucgcccaucgugaauagagaaggaaaaauagucggccuguaugguaacggggugguuaccacaagcggaacuuacgugucagcuaucgcccaggcgaaggccucccaagagggcccucuuccggagauugaagaugaggucuucaggaagcgaaaucugaccaucauggacuugcauccaggcagugggaaaacgcggcgcuaucuacccgcaauugugagagaagcuaucaagaggaaacugcggacacucauauuagccccuacucgaguaguggcuucugagauggcagaagcccugaagggaaugccaauuagauaccagaccacagccguuaaaagcgagcacaccgguaaggagaucgucgaucuuaugugucaugcuacuuuuaccaugcgccugcucucccccgugagggugccuaacuauaauaugaucauuauggacgaagcgcacuucacagauccgucaucuaucgcagcccguggcuacauaagcacgcgggucgggaugggagaggcugccgcaauuuuuaugacugccacacccccaggcaguguagaggcuuucccucaguccaacgcggugauccaagacgaggaaagagauauucccgagaggagcuggaacucugguuaugaguggaucacagacuuuccagggaagaccguuugguucgugccuucaauaaaauccggaaacgacauugccaauugcuugcgcaagaacggcaaacgagucauccagcugaguagaaagacuuucgauacagaauaccagaaaaccaagaauaacgacugggauuacgugguuacgacugacaucagcgagaugggcgcaaacuuucgggcugauagggugauugacccccgccguugucucaagccagucauccugaaagaugggccggaaagagugauucuugccggaccuaugcccguaacaguggcaucggccgcucagcggaggggucgcauaggccgaaaucauaacaaggagggggaccaauauaucuacaugggacagccacuaaauaacgaugaggaccacgcccacuggaccgaagcgaaaaugcuguuggauaauauuaacacccccgagggcaucaucccugcauuauucgaaccagagagagaaaagucugccgcuauugacggugaguaucggcugcgcggggaagccaggaaaacuuuuguugaacucaugagaaggggcgaucugcccgucuggcuuuccuacaagguggcuagcgagggauuccaguauucagaccggcguuggugcuuugacggcgaacgcaauaaccaggugcuggaggaaaauauggaugucgagauauggacaaaagagggggaacgaaagaagcucagaccuaggugguuggacgcacggaccuacagugauccgcuggcccuacgcgaguucaaagaauuugcugccggaagaaggucuguuuccggugaccugauccucgagauuggcaaacuuccacaacaucugacacagcgggcacagaacgcguuagauaauuuggugaugcugcacaacagcgaacaagggggacgagccuauagacaugcuauggaggagcuccccgacacuaucgaaacgcugauguuccuugcccugauugcaguacucaccggcggugugacauuguuuuuccugucagggcgcggcuuaggaaaaacaaguaucggccuacugugcgucauggcuagcuccgugcuccuuuggauggccucuguugagccucacuggauagcagccagcaucauucuggaauuuuucuugauggugcugcucauccccgagccagauaggcaacggaccccucaggacaaucagcuggcuuacgucguaauugggcuucucuuuaugauccugacaguggcggccaacgagaugggauugcuggaaaccacuaagaaagauuuagguauaggccacguugcaguggagaaucaucaccaugcugccaugcuagacgucgaucugcaccccgccuccgcauggacgcucuacgcuguggccaccacaauuaucacuccaaugaugcgucauaccauugaaaacacaaccgcgaacaucucacuuacugcuauagccaaucaggcagccauccugaugggguuggacaagggauggccuauuucuaagauggauaucggcgucccgcugcucgcucuggguuguuauagucaagugaacccccuuacauuaacggcagccguucugaugcucguggcgcacuacgcuauuaucgggccaggcuugcaggccaaagcaaccagagaggcccagaagaggacugcugccggaauaaugaaaaauccuacaguagacggcauuguggcaaucgaccuggaucccgucguuuaugacgcuaaguucgaaaaacaacuagggcagaucaugcugcucauucuuugcaccucgcagauccuguugaugcgcaccacaugggcccugugugagagcauaacucucgcgacgggaccacugaccacauuaugggagggcuccccugguaaguucuggaacacuaccauugccgugucuauggcaaauaucuuucgggggucauaccuugcuggagccggccuggcauucagccucaugaagucccuagguggcgggcgaagaggaacaggcgcucagggggaaacccugggagagaaauggaagaggcaauugaaccagcugaguaaaucugaauuuaauacuuauaagcgcagcggcauuauggaggucgaucggucagaagccaaagagggucucaagagaggggagacgacaaagcacgccgugucccguggaaccgcgaaacuuaggugguucguagaacggaaccuggugaagcccgagggcaaaguuaucgacuuggguugcggccgcgggggauggaguuacuauugugcuggccugaagaaagugacugaagucaagggguacaccaaaggaggcccgggucaugaggaaccaauaccuauggcaacauacggguggaaucucgugaaguuacacagcggaaaggaugucuuuuucauacccccagagaaaugcgacacucugcuuugugauauuggcgagucuucccccaacccuaccaucgaagagggccgaacacugagagugcuaaagaugguugaaccguggcucagggggaaucaguuuugcauuaaaauccugaaccccuauaugccaucaguaguggagacguuggagcagaugcaacggaagcauggagguaugcugguccgcaauccucucagcagaaacucgacccacgaaauguacugggugucuuguggcacugggaauauuguuagugccgugaacaugacauccaggaugcuucugaaucgauucaccauggcucaccggaaacccacuuaugagcgugacgucgauuuaggagccggcacaagacauguggcaguagaaccugagguggccaaccuggacaucauaggucagcgcauugaaaacaucaagcacgagcauaagagcaccuggcacuacgaugaggacaauccauauaaaacgugggcuuaccaugggucauaugaaguuaagcccuccggaucugcgagcaguauggucaacggcguggugaaauugcucaccaagccuugggacgucaucccaaugguuacacagauugccaugacugauaccacacccuuuggccagcaaaggguguucaaagagaagguagacacucggaccccgaaggcaaaaagagggacagcucagauaauggaagugaccgccaaguggcuguggggauuucuaucccgcaauaaaaagccuaggaucugcacucgagaggaguucacgcggaaagucagaagcaacgcagccauuggugcuguguuuguugaugagaaucaguggaacucugccaaggaggcgguggaagacgagagguucugggaucuuguccaccgcgaacgugagcugcacaagcaaggcaaaugugcaacaugcguguacaauaugauggggaagcgggagaagaagcucggagaguucggcaaagccaaggguucaagagcuaucugguacauguggcugggggccagguuuuuggaguucgaagcacugggauuuaugaacgaggaccauugguucagucgcgaaaauucccucagcggcguagagggcgaggggcuucacaaacugggauauauuuuacgagauaucucuaagauaccagguggcaacauguacgcugacgauaccgccgggugggacacucggaucaccgaagaugaccugcagaaugaggcuaagauuacagauaucauggaacccgagcaugccuugcucgcaaaaucgauuuuuaagcugacguaucagaacaaaguugugagaguccagaggccugcgaagaauggaaccgugauggacgugaucucacgcagagaccaacggggcagcggucaggucgggacuuacggacuaaacacauucaccaauauggaagcccagcuuauaaggcagauggaguccgagggcauuuuuaguccaucugaacuggagacucccaaccucgcuggccguguucuggauugguuggaaaaacacgggguggagcgauuaaagcgcauggccaucagcggagacgauugcguagugaagccgaucgacgauagauucgcagcugcccugacagcacucaacgacauggguaaaguccggaaggauauuccucaaugggaacccuccaaaggcuggaaugacuggcaacaggugccauuuuguucacaccauuuccaccagcuuauaaugaaggaugggagggagaucguugugccuugccgcaaccaagacgagcuggucggcagagcacgggugagucagggcgcggguuggucucuaagggaaaccgcuugucuggggaaaagcuaugcccagauguggcagcucauguacuuucaucgacgugauuugagacuggcagccaaugcuauuugcuccgccguacccguugacugggugccaacaucacgcacuaccuggagcauccacgcacaucaccaauggaugacgaccgaggacaugcuuucugucuggaaccggguguggauugaagagaaucccuggauggaagauaagacacacaucuccaguuggggagacguuccuuaucugggcaagagggaggaucagugguguggcagccucauaggguuaacugcuagagccaccugggcgacaaacauccagguggcuauuaaucaaguccgccggcugaucggaaacgagaauuacuuggacuacaugacuucgaugaaaagguucaagaacgaauccgauccagagggugcccugugguga

SEQ ID NO: 13972 - RNA, 9879 nt, Artificial Sequence
  derived and/or modified CDS sequence (opt3) from DENV-1__GU131814__SS-prME
agcgugaccaugcugcucaugcuuaugcccacagcccuggcuuuccacuugacuacgagaggaggggagccucauaugaucgucuccaagcaggaaagaggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaagacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcugugaguggcgucuauccccugagcauaccagcaacgcucuuuguuugguacuucuggcagaaaaagaagcagcggucuggcgugcugugggacacuccuucacccccagaaguggagagagccguccuugaugacgggaucuauaggauuaugcagcguggauuacugggucgcagccaggugggcguugggguauuccaagaaaacguguuucauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaaccccaaaaauguacaaacaacuccaggaaccuucaagacgcccgaaggugaggucggcgcaaucgcccuggauuuuaagccugggacaucgggaagcccaauagugaaccgagaaggcaaaaucguuggucuuuaugggaauggaguggucacuaccucaggcacauacguguccgcuauugcccaggcaaaggcuagucaggagggcccccugccugagaucgaagacgagguuuuccggaaacgcaacuugaccauuauggaucuacacccggggucuggaaagacuagaagguaucugccagccaucgugcgggaagcgauaaaacgaaagcucagaaccuuaauucuggcccccacacgcgucguggcaagcgagauggcugaagcccuuaaggguaugccuaucagguaccaaacgacugcuguaaaauccgagcauaccggcaaggagaucguggaccugaugugccacgcaacauuuaccaugcgucucuugucaccaguucggguccccaauuauaacaugauuaucauggaugaagcccauuucacugacccuucuagcauagccgcuagaggguacauuaguacaagggugggaaugggcgaggcggcagccaucuuuaugaccgcuacgccgcccgguuccguggaagccuucccacagagcaaugcagucauucaggaugaggaacgcgacaucccugagcgaucuuggaacucaggguaugaguggauaacugauuuucccggaaaaacaguaugguucgugccauccauuaagaguggcaaugacaucgccaacugucugaggaaaaauggcaagcggguuauccagcucagcaggaagaccuuugauaccgaauaccagaaaacuaagaacaacgacugggacuacguggucacaaccgauauuucggagaugggggcuaauuuccgcgcggaccgugugaucgauccuagacggugccugaaacccguuauucuuaaggacggaccagaaagggugauacuagccgguccgaugccugucacaguggcaucugcugcccagcgccgaggcagaaucgggcggaaccacaauaaagagggagaucaguauauuuacaugggccagccccugaacaaugacgaggaucaugcacacuggacugaagccaagauguuguuagacaacaucaauacgccagaggguaucauucccgcucuguucgaaccugagagggaaaaguccgccgcgauagauggggaguaucgccucagaggcgaggcaaggaaaaccuuuguagaacugaugcggcguggagaccuuccaguguggcugagcuacaagguugccucagagggcuuccaauauagugaucgccgauggugcuuugacggggaaagaaacaaucagguccucgaggaaaacauggauguggagaucuggacaaaagagggagaaaggaagaaauugcggccccgcuggcuggacgcuagaacuuacucugacccucuagcccugagggaguucaaggaauuugcugcaggucggcgauccgugagcggcgaucucauucuugagaucgggaaacugccgcagcacuuaacccagagagcccaaaaugcuuuggacaaccuggucaugcuccauaauucagaacagggaggccgcgccuauaggcacgcaauggaggagcugccagauacaauugaaacccuuaugcugcucgcguugaucgccguucugacugguggggugacguuauucuuucuaaguggccggggacugggcaagaccagcauagggcuccuuuguguaauggcuuccucugugcuguuguggauggccagcgucgagccccauuggaucgcagcuuccauuauccuggaguucuuucucauggugcugcuuauuccugagcccgaccgucagagaacaccacaggauaaccaacucgccuacguugugaucggacuguuguucaugauacugacugucgcagccaaugagauggguuuacuagaaaccacaaagaaagaccugggcauugggcacguagcugugggaaaccaccaucacgcggccaugcucgauguugaccuucauccugcaucagcuuggacccuguacgccguggccacuacaaucauuacgcccaugaugaggcacaccaucgagaacacuacagcaaauauaucuuugaccgcuaucgccaaccaggcggcuauucugaugggccucgauaaggguuggccaaucaguaaaauggacauuggggucccucugcuugccuuaggcugcuauagccaggugaauccgcugacccucacagcagccgucuugaugcugguggcucauuacgcaaucauaggacccggccuacaagccaaggcgacucgcgaagcucagaaacggacggccgcagggauuaugaagaacccaaccguugauggaaucguggccaucgaccuggauccuguaguguaugacgcuaaguuugagaaacagcucggccagauuaugcuucugaucuuguguacaagccaaauacugcucaugcgaacuaccugggcccugugcgaauccauuacauuagcaaccgguccccuuacuacgcugugggaggggucuccaggaaaguucuggaauacaaccaucgcugucucaauggccaacauuuuuagaggcagcuaccucgcgggugccggccuagcauucucccugaugaaaagucuagggggaggcaggcgcgggacuggagcucagggcgagacccugggugaaaaguggaaacggcagcucaaucagcuuucuaagagcgaguucaacacauauaagagaucagggaucauggaaguugaccguuccgaggccaaagaaggacugaagaggggcgagacuaccaaacacgcagugagucgggguacagcuaaguugcgcugguuugucgagcgaaaucuggugaaaccugaaggcaagguaauagaucucggguguggaagaggcggguggagcuacuauugcgccggauuaaagaaagugacggagguuaagggcuacaccaaaggugggcccggacacgaagaaccgaucccaauggccacuuacggcuggaaccuggugaaacuucauucuggcaaagacgucuucuuuauuccucccgaaaagugugauacacugcuaugcgacaucggggaguccucaccaaaucccaccauugaggaaggaaggacucuccgggugcugaaaauggucgagccuugguugcgcgguaaccaauucuguaucaagauucugaauccguauaugcccagcgugguugaaacacucgagcagaugcagagaaagcacggcgggaugcuuguaaggaacccacugucgcgaaauucuacccaugagauguacugggugaguugcggaacgggcaacaucgucuccgcggugaauaugaccagccggauguuacugaaccguuuuacaauggcucacagaaaaccuacuuaugaacgcgauguugacuugggugcagggaccaggcacguggccgucgagcccgaaguggcuaaccucgauauaauuggacagcggaucgagaauaucaagcaugaacacgagucaacauggcauuacgacgaggauaacccuuauaaaacuugggccuaccacggcuccuaugaaguaaagccaucuggcagcgcaaguuccauggugaaugggguugucaaacugcuaaccaagcccugggacgugauuccuauggugacacaaauagccaugaccgauacuacgccauucggacagcagagagucuuuaaggagaaaguugacacacgcacccccaaggcuaaaagggguacugcgcaaaucauggaagugaccgccaaguggcuuuggggcuuccugagccgaaacaaaaagccgcggauuuguacaagagaggaauuuacgaggaagguacgcucuaaugcagcuaucggggccguguucgucgacgagaaccaguggaacucagcaaaagaggccguggaagaugagcguuuuugggaccucguucaucgggaaagagagcugcacaagcagggaaaaugcgcuaccugcguguacaacaugaugggcaagagggagaaaaaguugggugaguucgggaaggccaaaggaagucgcgcgauuugguacauguggcugggcgcacgauuucucgaguucgaagcccuuggcuucaugaaugaggaucacugguuuucccgggaaaacagccugucuggggucgagggagaggguuuacauaagcugggcuauaucuugagagacauaucgaaaaucccugggggaaauauguacgcugaugacacugccggcugggauacaaggauuaccgaagacgaucuccagaacgaggcacgcaucacugacauuauggaaccagagcacgcucugcuagccaagucaaucuucaaacuuacauaucaaaauaaggugguaagaguucagcggcccgcuaaaaacgguaccgugauggaugucauaagcaggcgugaccagcgaggguccggacaggugggcacauacggccugaauacuuuuaccaacauggaagcccaacucauucgccagauggagagugaggggaucuucucuccuagcgaacuggagacgccaaacuuggcagaaagaguguuagauuggcuggagaaguauggagucgaacggcucaagaggauggcgaucuccggugacgacuguguugugaaacccauugaugaccgcuuugccaccgcucuuacagcccugaaugauaugggcaagguaagaaaagacauaccgcagugggagccuucaaagggguggaacgauuggcagcaagugcccuucugcagucaucacuuucaccagcuaaucaugaaagacggacgggagauugucgugccauguaggaaucaggaugaacugguuggccgagcacgugugucucagggugcuggguggagccucagagagacugccugcuugggaaaguccuacgcacaaauguggcagcugauguauuuccaucgccgggaccuuaggcuggccgcgaacgcuaucuguucagccgucccuguggauuggauucccaccagcagaacaacuuggucuauccacgcacaucaccaguggaugaccacggaagacaugcucuccguauggaaucgcguuuggauagaggaaaacccauggauggaggauaagacacauaucaguagcuggggcgacgugcccuacuuaggcaaacgggaggaccaauggugcgggucgcugauuggauugaccgccagggcuacuugggccacaaauauccaggucgcaauuaaccaggugcgaagacugaucgguaaugaaaacuaccucgauuauaugaccuccaugaagcgguuuaaaaaugagucugacccugaaggcgcucuuugguga

SEQ ID NO: 13973 - RNA, 9879 nt, Artificial Sequence
  derived and/or modified CDS sequence (opt3) from DENV-1__GU131815__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugccccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagagcaggacgccaacuucguuugccgccgaacuuuuguggauagaggcugggguaauggguguggauuguucggcaaaggcucccucauaaccugcgcaaaguuuaagugcguaacaaggcuggaggggaaaauugugcaguacgaaaacuuaaaguauucagucaucgugaccguucacacuggagaccagcaucaaguggguaaugagaguacggaacacggcacaaccgcuacuauuaccccccaggccccuacaaccgagauccagcugacugacuacggggcgcucacacuugauuguagcccacggacgggacuggacuucaacgaaauggucuugcuaaccaugaaagagaagucuuggcuggugcauaaacagugguuucucgaucugccgcuucccuggacuuccggcgccucaacaagccaagagaccuggaaucgucaggaccuguugguaacauucaagacugcacacgcuaaaaagcaggaaguugugguccucgguagucaagagggggccaugcacaccgcucugacgggcgccaccgaaauccagacaucuggaacuaccacaauuuuugcaggccauuuaaagugccgccugaaaauggauaagcuaacucucaaagggauguccuaugugauguguaccggaagcuucaagcuggagaaagaagucgccgagacgcagcacgguacagugcuuguucagauaaaguacgagggcaccgacgcuccuugcaagaucccauucuugacucaagaugaaaaaggggugacacagaacggaagacugauuaccgcgaaucccaucguaacugacaaggagaaaccugucaacauagaagcagagccacccuuuggcgagucguauauuaccaucggugccggggaaaaggcucucaaacugucuugguucaagaagggcuccucaaucggaaaaauguuugaggccacagcaaggggcgcccggcgaauggcuauucuuggggauacggccugggacuucggaaguaucgguggcguguuuaccagcguugggaagcuggugcaucagauuuucggaacugcauacggcgucuuguuuuccggugugucuuggacaaugaaaauagggaucggcguacuccugaccugguuaggacugaauagccgcucaacaagucuauccaugacuuguauugcggugggccucguuacccuguaccuuggggucauggugcaggcugauagcggaugcgugaucaacuggaagggcagagaauugaaaugugguucugggaucuucgucacgaaugagguucacacauggaccgaacaauauaaguuucaggccgacucaccgaagaggcugagugcagccauuggaaaagcuugggaggagggcgugugcgguauacggagcgccacucgccucgaaaacaucauguggaagcagauuuccaacgagcugaaucauaucuuacuggaaaacgacaugaaauucaccgugguagucggcgauguggcagggauucuugcucagggaaagaaaaugaucagaccucaacccauggaguacaaguauucuuggaaaucguggggcaaggccaagauaaucggggcggacguucagaauacaacuuuuauuaucgauggaccaaacaccccugaaugucccgacgaucagagggccuggaauauuugggagguggaggacuacggcuucgguaucuuuacaacgaacauaugguugaaacuccgugauagcuauacccaggucugcgaccaccggcugauguccgcugcaauuaaggauucaaaagccgugcacgcugacaugggguacuggaucgaaagugagaagaaugaaacuuggaaacuagcccgagcaucuuucauugagguuaagacauguaucuggccaaagagccauacccugugguccaacggagugcucgaaucagagaugauaauccccaaaauuuauggcgguccuaucagccaacacaauuacagaccaggcuacuucacucagacagcggggccguggcaucugggaaagcuugaguuggauuuugaccugugcgaaggcaccacgguagucguggaugagcacugcgggaacaggggacccucuuuacgcacuaccacagugaccggcaaaauuauccacgaaugguguugccgguccuguacucucccuccacugagauucaggggugaggacgggugcugguauggaauggagauacgccccgucaaggaaaaagaggaaaaucuuguuaagaguauggugagcgccggcucuggugagguagacuccuuuucacugggcuugcucuguauuaguaucaugaucgaagaggugaugcgaagccgguggucgcguaagaugcugaugacagggacccuagcugucuucuuucugcucauuaugggacagcugacauggaacgaucuuaucagauugugcauuauggugggcgccaaugcauccgacaggauggggaugggaacuaccuaccuggcuuuaauggccacguucaaaaugcgcccuauguuugcaguuggccuccuguuccggagacuuacaucuagggaggugcugcuacucaccauaggucugagcuuggucgccucaguggaacugccaaacaguuuagaggaacucggggauggacuggcuaugggcaucaugauucuuaagcuguugacugacuuucaaucccaucagcucugggcgacccugcuaucucugacauucaucaaaacuaccuuuagccuucacuaugccuggaagacgauggcaaugguucucuccauugugucacuguuccccuugugucugagcacaaccagucagaaaacuacaugguuaccgguccuccugggcucucuugggugcaagccucugaccauguuuuugaucgcugagaauaagauauggggacgacgcuccuggccacucaacgaagguaucauggccguaggcauugugagcauccugcuaucgucacugcuuaaaaacgauguuccccucgccgggccucugauugcuggaggcauguugaucgcauguuacgugauaucugguaguuccgccgacuuaagccuggagaaggcggcugaggucucuugggaagaggaagccgagcauagcggggcaucccacaauauucucguggaaguacaggaugacggaacuaugaaaaucaaggaugaggagcgggacgauacacugaccauccuucugaaagccacguugcuagcugcaucaggcguguauccccugaguauuccagccacucucuucgucugguacuucuggcaaaagaaaaagcagagaagcggcguucugugggacaccccuucucccccagaaguggagagggcggugcuugaugacgggauauaucguaucaugcagcgcggauuacugggucggucccaggucggcguggggguuuuucaagaaaacguauuccauacaauguggcacgugaccagaggagcuguccucauguaccagggcaagagguuggagccgucaugggccagugugaaaaaggaccugauuagcuacggugggggauggcgacuccagggcuccuggaauacaggcgaggaaguucaggugaucgcagucgagccugggaaaaaccccaagaaugugcaaacugccccaggaaccuuuaaaacgcccgaaggugagguaggcgcuauugcccuggauuucaagccugggacaucuggaucgccaaucgucaaccgggaaggcaagauagugggucuuuaugggaauggaguugugacuaccagcggcacauacgucucagcaaucgcucaggccaaagcgucccaggagggcccccugccugagauugaagacgagguguuucgcaagagaaacuugaccaucauggaucuacacccggggaguggaaaaacuaggcgguaucugccagccauuguucgagaagcaaucaagagaaaacuccgcaccuuaauacuggcucccacaaggguggucgccucugagauggcugaagcacuuaaggguaugccuauucguuaccaaacgacugccgugaagagcgagcauaccggcaaagagaucguagaccugaugugccacgccacauucaccaugcggcucuuguccccagugagaguucccaauuauaacaugaucauuauggaugaagcucauuuuacugacccuucaucugucgcggcaaggggguacaucagcacacgcgugggaaugggcgaggccgcugccauauucaugaccgcaacgccgcccgguaguguggaagccuuuccacaguccaaugcugucauucaggaugaggaacgagacaucccugagagaagcuggaacucuggguaugaguggauuacugauuuccccggaaagacaguaugguuugugccaucaaucaaauccggcaaugacauagcgaacugucugcggaagaauggcaaaaggguuauucagcucagucgcaagaccuucgauaccgaauaccaaaagacuaaaaacaacgacugggacuacguggucacaaccgauaucagcgagaugggggccaauuuccgugcagacagagugaucgauccucggaggugccugaagcccguuauucuuaaagacggaccagaacgcgugauccuagcugguccgaugccugucacaguggccucggcagcccagcgaagaggccggauugggaggaaccacaauaaggagggagaucaguauauauacaugggccagccccugaacaaugacgaggaucaugcucacuggacugaagccaaaauguuguuagacaacaucaauacgccagaggguauuauccccgcgcuguuugaaccugagcgcgaaaagucugcagccaucgauggggaguauagacucaggggcgaggcucggaagaccuucguagaacugaugcgucgcggagaccuuccaguguggcuguccuacaaaguugccagcgagggcuuucaauauucagaucgaagauggugcuucgacggggaaaggaacaaucagguccucgaggaaaacauggauguggagauuuggacaaaggagggagaacggaaaaaguugcgccccagauggcuggacgcuaggacuuacagugacccucuagcacugcgggaguuuaaagaauucgccgcuggucgaagaucuguguccggcgaucucauacuugagaucgggaagcugccgcagcacuuaacccagcgcgcccaaaaugcauuggacaaccuggucaugcuccauaauagcgaacagggaggcagggcguaucggcacgccauggaggagcugccagauacaauugaaacccuuaugcugcucgcuuugaucgccguucugacugguggggugacguuauuuuuccuaucaggccguggacugggcaaaaccaguauugggcuccuuuguguaauggcaagcuccgugcuguuguggauggcuucugucgagccccauuggaucgccgcaagcauaauccuggaauuuuuccucauggugcugcuuauuccugagcccgacagacagaggacaccacaggauaaccaacucgccuacguugugaucggacuguuguuuaugauucugacugucgcugcgaaugagauggguuuacuagaaaccacaaagaaggaccugggcaucgggcacguagccgcagagaaccaccaucacgcugccaugcucgauguggaccuucauccugccuccgcauggacccuguacgcuguugccacuacaauaauuacgcccaugaugcgccacaccaucgaaaacacuacagcgaauauuucauugaccgcuaucgccaaccaggcagccauacugaugggacucgauaaaggcuggccaaucucuaagauggacauuggugugccucugcuugcuuuagggugcuauagucaggucaauccgcugacccucacagcagccguguugaugcuggucgcgcauuacgcuaucauuggccccggacuacaagccaaagcaacucgggaggcccagaagcgaacggcugccggcaucaugaaaaacccaaccguggaugggauaguugcaauugaccuggauccugugguauaugacgcuaaguucgaaaagcagcucggacagaucaugcuucugaucuuguguacaucgcaaauucugcucaugagaacuaccugggcccugugcgagagcaucacauuagcgaccggcccccuuacuacgcugugggaggguuccccagggaaauuuuggaauacaaccauagccgugucuauggcaaacauuuucaggggaucauaccucgcuggcgccggucuagcauucagccugaugaaguccuugggcgggggacgccggggcacuggggcucagggagaaacccugggcgagaaauggaagagacagcucaaucagcuuaguaaaucugaauuuaacacauauaagcguagcgguaucauggaggucgacaggucagaagccaaggaggggcugaaacggggagagacuaccaagcacgccguuucccgcggcacagcgaaauugcgaugguucguggaaagaaaucuggucaagccugaggguaaagugauugaucucggcugugggaggggaggcuggaguuacuauugcgcuggguuaaagaagguaacggaagugaaaggauacaccaagggcggucccgggcacgaggaaccgaucccaauggcaacuuacggauggaaccugguuaaacuucauagcggcaaggacguguuuuucauaccucccgagaaaugugauacacugcuaugcgacaucggcgagucuuccccaaaucccaccauugaagaggggcggacucuccgcguccugaagaugguggaaccuugguugagaggaaaccaauuuuguaucaaaauucugaauccguauaugcccucagucguggagacacucgagcagaugcagaggaagcacgguggcaugcuuguucgaaacccacugagccggaauucgacccaugaaauguacuggguaucuugcgggacgggaaacaucgugagugccgucaauaugaccucccguauguuacugaacagauucacaauggcucaccgcaagccuacuuaugagagggauguggacuugggcgccgguacccggcacguugcaguggaacccgaggucgccaaccucgauauuaucgggcagagaauagaaaauauuaaacaugagcacaagagcacauggcauuacgacgaggauaacccuuauaaaacuugggcuuaccacggaucauaugaagugaagccauccggcucugcgagcaguaugguaaauggcgugguuaaacugcuaaccaagcccugggacgucaucccuauggugacacaaaucgccaugaccgauacuacgccauuugggcagcagcgcguguucaaggagaaagucgacacaaggacccccaaggcaaaacgaggaacugcucaaauuauggaaguuaccgccaaguggcuuugggguuuucugucccggaacaaaaagccgagaauauguacaagggaggaauucacgcgcaaggugcguagcaaugcagccaucggcgcuguauuuguggacgagaaccaguggaauucugccaaagaggcggucgaagaugagcgguucugggaccucgugcauagagaaagggagcugcacaagcaggggaaaugcgcaaccugcguuuacaacaugaugggaaagcgcgaaaaaaaguugggcgaguuugguaaggccaaagggucacgagcuauuugguacauguggcugggagcccgguuccucgaguucgaagcacuuggcuuuaugaaugaggaucacugguucaguagagaaaacucccugagcggcguggagggggagggauuacauaagcuggguuauaucuugagggacauuucuaaaaucccuggcgggaauauguacgcugaugacacugccggaugggauacacgcauaaccgaagacgaucuccagaacgaggcuagaaucacugacauuauggaaccagagcacgcccugcuagcaaagucgaucuuuaaacuuacauaucaaaauaaggucgugcggguacagaggcccgcgaaaaacggcaccguuauggaugugauuucacgucgagaccagcgcgguagcgggcaggucggaacauacggccugaauacuuucaccaacauggaagcccaacucaucagacagauggaguccgagggcauauuuaguccuucugaacuggagacgccaaacuuggcugaacggguguuagauuggcuggagaaguaugggguggaaaggcucaagcgcauggccauuagcggagacgacugugucguuaaacccaucgaugacagauucgcaaccgcucuuacagcccugaaugauauggguaaggugcggaaagacaucccgcagugggagccuuccaagggcuggaacgauuggcagcaaguacccuuuugcucacaucacuuccaccagcuaauuaugaaagacgggagggagauaguggucccaugucgaaaucaggaugaacuggugggacgugcaagaguuagucagggcgccgguuggucucuccgcgagacugcgugcuuggggaagagcuacgcucaaauguggcagcugauguauuuucaucggagggaccuuagacuggccgcaaacgccaucuguuccgcugugccugucgauuggauucccaccucacgcacaacuuggagcauccacgcccaucaccaguggaugaccacggaagacaugcucucuguguggaaucggguauggauugaggaaaacccauggauggaggauaagacacauaucuccaguuggggagacguucccuacuuaggcaaaagggaggaccaauggugcggcagccugauaggguugaccgcacgagcuacuugggccacaaauauccagguggcgauuaaccaggucagacggcugaucggaaaugaaaacuaccucgauuauaugaccucgaugaagagguucaaaaaugaguccgacccugaaggugcucuuugguga

SEQ ID NO: 13974 - RNA, 9879 nt, Artificial Sequence
  derived and/or modified CDS sequence (opt3) from DENV-1__GU131818__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaacaugugcacucuaauugccauggaccucggcgaguucugugaagauacuaugaccuacaaaugcccacggauaacugaggcggaaccggacgauguggacuguuggugcaaugcuaccgauacuuggguaaccuaugggaccuguagucaaacgggagagcaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcaccucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacgaccauggcaaaagauaagcccacuuuggacaucgaacugcuaaaaacagaggugaccaacccugccgugcuccggaagcugugcauugaagcuaaaaucucuaauacgaccacagauaguagguguccaacucaaggagaggccacccuugucgaagaacaggacgcaaacuuuguuugccggcgcacauucguggaucgaggcugggguaauggguguggacuguuuggcaagggcuccuugauaacuugcgcuaaguucaaaugcguaaccaagcucgaggggaaaacagugcagcacgaaaaccugaaguacucagucauugugaccguucauacuggagaccagcaccaaguggguaaugagaguacggaacauggcacaaccgccacuaucacaccccaggcgccuagcacagagauucaguuaaccgacuauggggcccugacucucgauuguucuccaagaacaggacuugacuuuaacgaaaugguccuguugacgaugaaagagaaguccuggcuagugcacaaacagugguuccuggaucucccgcugcccuggaccucaggcgcaagcacaagccaagagacauggaauaggaaggaccuucugguaaccuuuaagacagcucacgccaaaaagcaggaaguuguggucuuggguucucaggagggggcuaugcauacugcccucaccggcgcaacggaaauccaaaccuccggaacaacuaccaucuucgccggccaccugaaaugccgguuaaagauggauaaacugacacuaaaggggacuagcuacgugauguguaccggaucguucaagcucgagaaagaagucgcugagacgcagcaugguacagugcugguucagauuaaguaugagggcaccgacgcgccuugcaaaauaccauuuucuacucaggaugaaaagggggugacacaaaacggacgucuuaucaccgcaaaucccauuguaacugacaaagagaagccugucaacaucgaagccgagccacccuucggcgaguccuacauagugauuggugcuggggaaaaggccuugaaacugucaugguuuaagaaaggcaguagcaucggaaagauguucgaggcaaccgcccgcggcgcuagaaggauggccauccucggggauacagcaugggacuuuggauccauugguggcguuuucacgucuguggggaaacugguccaccagaucuuuggaaccgcguauggcgugcuuuucagcgguguaucauggacuaugaagauugggauaggcgugcuguugacauggcucggacugaauagucgguccaccagcuuaucuaugacauguaucgcuguuggccuggucacucuauaccucggggugauggugcaggccgauucaggaugcgucauuaacuggaagggccgagaacugaaaugugguagugggaucuuuguuaccaaugaggugcauacguggacagaacaguacaaguuccaagcagacagcccgaaacgccuuuccgccgcuaucggaaaggccugggaggagggcgugugcgguauuagaucugcaaccagguuggaaaacauaauguggaaacagaucucgaacgagcugaaucacauucuccuggaaaacgacaugaaguuuacuguagucgugggcgauguugcugggaucuuagcccagggcaagaagaugauucggccucagcccauggaguauaaguacagcuggaaauccuggggcaaggcgaaaaucauaggggccgacgugcaaaauaccacauucaucauugauggaccaaacacuccugaaugucccgacgaucagcgcgcuuggaauaucugggaggucgaggacuauggcuuugguauuuucaccacaaacaucuggcugaaacuuagagauucauacacacaggugugcgaccacagguugaugagugcagccauaaaagauucuaaggcuguucaugccgacaugggguauuggauugaaagcgagaagaaugaaaccuggaaacucgcacgugcguccuucaucgaggugaagacuuguauuuggccaaaaucacacacacuguggagcaacggaguacuagaaucugagaugaucauacccaagaucuacggcgguccuauuucccagcauaauuaucggccaggcuacuuuacccaaacugccgggccguggcaccugggaaaacucgagcuggauuucgaccuuugcgaaggcacaaccgucgugguggaugagcacugcgggaaccgaggacccaguuugagaacgacuaccgucacaggcaagaucauucaugaaugguguugcaggagcuguacccugccuccauuacgcuuuaagggugaggacgggugcugguacggaauggagauccggcccguuaaagaaaaggaggaaaaucucgugaaaucuaugguauccgcuggcucaggugagguggacaguuucagccugggccuucuguguauaucgauuaugaucgaagaggucaugagauccagguggucucgcaagauguugaugacugggacacucgccguguuuuuccugcuaaucaugggacagcugaccuggaacgaucucauucgacugugcaucaugguuggcgcaaaugcuagcgaccggauggggaugggaacaacuuaucuugccuugauggcaaccuuuaaaaugcguccuauguucgccgugggccuguuauuuagaaggcucacgucacgcgagguccugcuucugacaauuggucuaagucucguggcuuccguugaacugccaaacucuuuggaggaacugggggauggauuagcgaugggcauaaugauccucaagcugcuuaccgacuuccagagccaccaacugugggccacuuugcucucccugaccuuuauuaagacaacuuucucacuacauuacgcauggaaaaccauggcuauggugcugagcaucgucagucuuuuuccccucugucugucuacgacaucccagaagaccacuugguugccgguacuguuaggcagccucgggugcaaaccucugacaauguuccuuauugccgagaauaagaucuggggacggaaaucguggccacugaacgaagguauaauggccgugggcaucguuucaauuuugcucucuagucugcuaaagaacgaugugccccuggcugggccucuuaucgcaggaggcaugcucauugccuguuaugucaucuccgguagcucugcggaccugagcuuggagaaagcugccgagguguccugggaagaggaagcagagcacucaggggccagucauaauauauuaguagaagugcaggaugacggaaccaugaagauuaaggaugaggagagagacgauacucugacaauccuccugaaagcuacccuucuggcagucagcggcguuuaccccuugucuaucccagccacgcuauucgugugguauuuuuggcagaagaaaaagcaaagguccggcgugcugugggacacuccuucacccccagaagucgagcgagcggugcucgaugacgggauuuaccgcauaaugcagcggggacugcuugguagaagucagguuggcguagggguguuccaggaaaacgucuuucacaccauguggcacgugacaaggggagcuguuuuaauguaucaaggcaaacgucuggagccgagcugggccuccgugaagaaggaccucaucucuuacggugggggauggcgcuugcagggcucguggaauaccggcgaggaaguccaggugauugcaguagagccugggaaaaaccccaagaauguccagacagccccaggaacuuucaaaaccagcgaaggugaggugggcgcuaucgcccuggauuuuaagcccgggacgucaggauccccuauuguuaaccgggaaggcaaaaucgugggucucuacgggaauggagucgugacaacaaguggcaccuauguuucugcaauagcucaagccaaggcgagccaggagggcccacugcccgagaucgaagacgagguguucagaaagaggaaccuuacaauuauggaucugcauccuggguccggaaaaacccgacgguacuugccggccaucguccgcgaagcaauuaagagaaaacuaaggacucugauccucgcuccaacccgggugguagccucagagauggcugaagcauuaaaggguaugcccauacgauaucagacaacggccgugaaaucugagcacacuggcaaggagauuguugaccugaugugccaugccaccuuuacaaugagacuucugagcccuguccgcgugccaaauuacaacaugaucaucauggaugaagcucacuucaccgaccccaguuccauugcggcaaggggguauaucagcacucgugugggaaugggcgaggccgcugccauauuuaugacagcaaccccuccggguucugucgaagccuucccccaaucaaaugcuguaauucaggaugaggaacgggacaucccagagagauccuggaacaguggguacgaguggauuacggauuuuccuggaaagacugugugguucguucccagcaucaaaucgggcaaugacauagcgaacugucucaggaagaauggcaaacgcgugauucaguugucucgaaagacauucgauaccgaauaucagaaaaccaagaacaacgacugggacuacgucgugacuacagauaucuccgagaugggggccaauuuuagagcagaccggguuaucgauccaaggcgcugccugaagccugugauucucaaagacggacccgaacgugucauccuggcugguccaaugccggugaccguagccagcgcagcccaaagacggggcaggauugggcgcaaccauaauaaggagggagaucaguacauauauaugggccagccucuuaacaaugacgaggaucacgcucacuggacagaagccaaaaugcuacuggacaacaucaauacucccgaggguauuaucccagcguuguucgaacccgagcgagaaaagucagcagccaucgauggggaguacagauuacggggcgaggcuaggaaaacguuuguggaacugaugcgcagaggagaccucccuguuuggcugaguuauaaggucgccucugagggcuuccaguacuccgauaggcgguggugcuuugacggggaacguaacaaucaagugcuugaggaaaacauggauguggagauuuggaccaaagagggagaacgcaagaagcugcgaccaagauggcucgacgcuaggacauauagcgaccccuuggcacugcgggaguucaaagaauuugccgcuggucgcagaucagucaguggcgaucuaauacuggagaucgggaagcucccucagcaucuuacucagagggcccagaaugcacuggacaacuuaguuauguugcacaauagcgaacaaggaggccgggcguaccgacaugccauggaggagcugccggauaccauugaaacacucaugcugcuugcucugaucgccgugcucaccggugggguaacuuuguucuuucuguccggcagaggauuaggcaaaacgucuauugggcuacugugugugauggcaagcuccgcucuccuuuggauggccucagucgagccacacuggaucgcagccucuauaauccuggaguucuuuuugauggugcugcucauucccgagccugaccgccagaggacaccccaggauaaccagcuggcuuauguugugaucggacuucucuucaugauucugacagucgcggccaaugagauggguuugcuggaaacuaccaagaaagacuuaggcaucgggcacguagcaguggagaaccaucaccaugcugccaugcuagauguugaccugcacccagccagugcauggacacucuacgcuguggccaccacuauaauuacaccuaugaugcggcauacgaucgaaaacaccacugcgaauauuucgcuuacagcuaucgccaaccaagcagccauacugaugggauuggauaagggcuggcccaucagcaagauggacauuggugucccacugcucgcucuggggugcuacucccaggugaauccucuuaccuuaaccgcagccguccugaugcucguggcgcacuaugcuaucauuggcccgggauugcaggccaaagcaacacgugaggcccaaaagagaacugcugccggcaucaugaaaaaccccacgguugaugggauaguggcaauugaccuggauccaguaguguacgacgcuaaguuugaaaaacagcuaggacagaucaugcugcucguccuuuguaccucucagauccuguugaugaggacaacuugggcccugugcgagucaauuacccucgcgacaggcccucugaccacuuuaugggaggguagccccgggaaguucuggaauacgacaaucgccguuuccauggcaaacauauuccgcggaaguuaucuugcuggcgccucucuggcauuuagccucaugaagucacuagguggcgggcggcgaggaaccggcgcucaaggggaaacucugggagagaaauggaagagacaguugaaucagcuguccaaaagugaguucaacaccuacaagaggagcggcauuauggagguggaccgcucugaagccaaagagggucucaagagaggggaaacaacuaagcacgccgucucccggggaaccgcgaaacuucguugguuuguggaaaggaaucugguaaagccagagggcaaagugaucgauuuggguuguggcagaggcggguggucauauuacugcgcugggcugaagaaaguuacagaagugaagggguauacgaaaggaggcccuggucaugaggaacccauuccgauggcaaccuacggguggaaccucgucaaguuacacagcggaaaggacguguucuuuaucccaccugagaaaugugauacucugcuuugcgacauaggcgagucgucucccaauccaacaaucgaagagggccgcacccugcgaguccuaaagaugguggaacccuggcucagagggaaccaguucuguauuaaaauccugaauccuuacaugccgaguguuguagagacuuuggagcaaaugcagaggaagcauggagguaugcuggugcggaacccccucucccgcaauagcacacacgaaauguauugggucucaugcggcaccgggaacauuguguccgccguuaauaugacgucuagaaugcuucugaacagguuuaccauggcucaccgaaaaccaacauacgagcgggauguggacuuaggagccggcacucgucaugucgcaguggaaccugagguagccaaccuggauaucauuggucagagaaucgaaaauauaaagcacgagcauaagagcaccuggcacuaugacgaggauaaccccuacaaaacaugggcuuaucaugggaguuacgaagugaagccuuccggaagcgcgucuucaaugguuaauggcgucgugaaauugcucacuaagccaugggacgugauucccauggucacccagaucgccaugacagauaccacuccuuucggccaacagcgcguuuuuaaagagaagguggacacgaggacaccaaaggcaaaacgggggaccgcucagaucauggaaguaacugccaaguggcuguggggauuccuaaguagaaacaaaaagccccgcauuuguaccagggaggaauuuacacgaaaagugcgguccaaugcagccauaggugcugucuucguggacgagaaccaauggaauagcgccaaggaggcgguugaagaugagagauuuugggaccuugugcacagggaacgcgagcugcacaagcagggcaaaugcgcaacgugcgucuauaacaugauggggaagcgugagaaaaagcucggagaguucggcaaagccaaggguucucgggcuaucugguacauguggcugggggccagauucuuggaguuugaagcacugggauucaugaaugaggaucauugguuuucgagggaaaacucacucagcggcguggagggcgaggggcuucacaaacugggauacauuuuacgcgacaucuccaagauuccggguggcaauauguaugcugaugacaccgccgggugggauacucgaaucacagaagacgaucugcagaacgaggcuaagauaaccgacaucauggaaccugagcaugccuugcucgcaaaaaguauuuucaagcugacuuaccagaauaaaguaguucgggugcaaagaccagcgaagaacggaacagucauggaugugaucucuaggcgcgaccagagaggcagcggucagguggggaccuauggacuaaauacauuuacuaacauggaagcccagcuuauucggcaaauggaguccgaggaaaucuucucacccagugagcuggaaaccccuaaccucgcuggcaggguccuggauugguuggagaaacacggcguugaacguuuaaagcgaauggccauaucuggggacgacugugugguaaagccaauugaugaccgcuuugcaacggcucugaccgcccucaaugauaugggaaaagugagaaaggacaucccccagugggagccgagcaaagguuggaacgauuggcagcaggucccuuucugcucccaccauuuucaccaacuuaucaugaaggacggccgggagauugugguucccuguaggaaucaggaugaacugguggggcgcgcaagagucucacagggagccggcuggagccuaaaagagacagcgugccuggguaagucuuacgcucagauguggcaacucauguauuuccaucggagggacuugcgacuggccgcaaacgccauauguuccgcugugccaguagauuggguuccuacaagucguaccacauggagcauccacgcccaucaccaguggaugacuaccgaagacaugcuuucgguguggaauagagucuggauugaggaaaaccccuggauggaggauaagacgcacaucuccucuuggggagacgugccauaccugggaaaacgcgaggaccaguggugcggcucacucauuggcuuaacagcacgggcuaccugggccacuaauauccaaguugcgauaaaccaggugaggagacugaucgggaaugaaaacuauuuggauuacaugacaagcaugaagcgcuuuaaaaaugagagugaccccgaaggagcucugugguga

SEQ ID NO: 13975 - RNA, 9879 nt, Artificial Sequence
  derived and/or modified CDS sequence (opt3) from DENV-1__GU131820__SS-prME
agcgugaccaugcugcucaugcuuaugcccacagcacuggcuuuccacuugacuacgagaggaggggaaccucauaugaucgucaccaagcaggaaaggggaaaauccuuacuguuuaagacaucugccgguguuaauaugugcacucuaauugcaauggaccucggagaacugugugaagauaccaugacauacaaaugcccacggauaaccgaagcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauuuucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggcagcuucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaagaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggccagcuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggccuuggugagguggacuccuuuucacugggcuugcucuguauuaguaucaugaucgaagaggucaugaggagccgcuggucgcgaaagaugcugauggcugggacccuagccguguuccugcuccugauuaugggacagcuuacuuggaacgauuugauccggcugugcauuaugguuggcgcaaaugcuuccgaccguauggggaugggaacaaccuauuuagcccucauggcaacauuuaaaaugagaccuauguucgccgugggccugcuuuuuaggcgccugacuucucgggagguccuacuccugaccauagguuugagccugguggcuucaguugaauuaccaaacagucucgaggaacugggggauggacuugcgaugggcaucaugauucugaaguugcucacggacuuccaaucccaccagcugugggccacacuacugucucuuaccuuuaucaaaacuacccucagccugcauuacgcauggaagacaauggcuaugguguuguccauugucucacuguuccccuuaugucucagcacuaccagucagaagacgacauggcugccgguacuucugggcucuuuggggugcaaaccucucaccauguuucugaucgccgagaauaagauauggggaagaaaauccuggccacuaaacgaagguaucauggccgugggcguugugagcauucugcuuucgucacuccugaagaacgauguccccuuggcugggccuuuaaucgcaggaggcaugcugauugccuguuaugugaucucugguaguuccgcggaccucagccuggagaaagcugccgagguaucuugggaagaggaagcagagcacagcggggccucccauaauauacuuguggaaguccaggaugacggaacuaugaagauuaaagaugaggagagggacgauacacugaccaucuugcuaaaggcuacucugcucgcaaucucaggcguuuacccccugaguauuccagccacacuuuucgugugguauuuuuggcaaaagaaaaagcagcgaagcggcguguuaugggacaccccuucucccccagaagucgagcgcgcggugcuggaugacgggauauaccggaucaugcagagaggacucuuggguaggucccagguuggcguagggguguuccaagaaaacgucuuccacacgauguggcacgugacucguggagcuguucugauguaucagggcaaacgccucgagccgucaugggccagugugaagaaagaccugauuagcuacggugggggauggcggcuucagggcuccuggaauaccggcgaggaaguccaggugaucgcaguagagccugggaagaaccccaagaauguccaaacagccccaggaaccuuuaaaacacccgaaggugaggugggcgcuauugcccuggauuucaagccugggacuucuggaucgccaaucguuaacagagaaggcaaaauaguggguuuguacgggaauggagucgugaccacgagcggcacauauguuucagcaaucgcucaggccaaggcgucccaggagggcccccuaccugagauugaagacgagguguuuaggaaacgaaaccugacuaucauggaucuccauccggggaguggaaagacccggcgcuacuuaccagccauugucagagaagcaaucaagaggaaacugcggacacuuauacuggcucccacccgagugguagccucugagauggcugaagcacucaaggguaugccuauuagauaucaaacuaccgccgugaaaagcgagcacacaggcaaggagaucguugacuugaugugccaugccacguucacuaugcgccugcucuccccagucagggugcccaauuacaacaugaucauuauggaugaagcucacuuuaccgacccuucaucuaucgcggcacguggguauauaagcacacgggugggaaugggcgaggccgcugccauuuucaugaccgcaacuccgcccgguagugucgaagccuuuccacaguccaaugcuguaauccaggaugaggaaagagacauuccugagaggagcuggaacucuggguacgaguggaucacagauuuccccggaaaaaccgugugguuuguuccaucaauaaaguccggcaaugacauugcgaacugucugcgcaagaauggcaaacgagugauccagcuuaguagaaagacguucgauacugaauaucagaaaaccaagaacaacgacugggacuacgucgugaccaccgauaucagcgagaugggggccaauuuucgggcagacaggguuauugauccucgccguugccuaaaacccgugauccugaaggacggaccagaaagagucauuuuggcugguccgaugccugugacuguagccucggcagcccagcggaggggccgcauagggcgaaaccauaauaaggagggagaucaguacaucuauaugggccagcccuuaaacaaugacgaggaucacgcucacuggacagaagccaaaaugcugcucgacaacauuaauaccccagaggguaucauccccgcgcuguucgaaccugagagagaaaagucugcagccauugauggggaguaccggcuuaggggcgaggcucgcaaaacauucguggaacugaugagaaggggagaccucccaguuugguuguccuauaaggucgccagcgagggcuuucaauacucagaucggcguuggugcuucgacggggaacgcaacaaucaggugcuggaggaaaacauggauguggagauauggacuaaagagggagaacgaaagaaacuaagacccagguggcuggacgcucggacguauagugacccucucgcacuucgcgaguuuaaggaguucgccgcugguagaaggucugucuccggcgaucugaucuuagagauugggaaguugccgcagcaucugacccagcgggcccaaaaugcacucgacaaccugguuaugcuucacaauagcgaacagggaggccgagcguacagacaugccauggaggagcugccagauacaaucgaaacucucauguugcuggcuuuaauugccgugcuaaccggugggguaacacuguuuuuccucucaggccgcggacuuggcaaaaccaguaucgggcuguugugugugauggcaagcuccguccugcucuggauggcuucuguggagccccacuggauagccgcaagcaucauucuggaauuuuuccuuaugguucuccugaucccugagcccgacaggcagcggacuccacaggauaaccaauuggccuauguggucauuggacuguuauuuaugauccuaacgguagcugcgaaugagaugggucugcucgaaaccacaaagaaagaccuuggcauagggcacguggccguugagaaccaucaccaugcaacuaugcuggauguggacuugcacccugcuuccgccuggacccuguacgccgucgcaacaaccauuaucacucccaugaugcgucauacaauugaaaacacgaccgcuaauaucucacucacugccauagcgaaccaggcugccauccugaugggacuugauaagggcuggccaauuucuaaaauggacaucggugugccuuuacuggcacucgggugcuacagucaggucaauccguugacacugaccgccgcugugcuaaugcugguugcacacuaugccauuaucggccccggacuccaagcgaaggcuaccagagaggcccagaagaggacagcagccggcauaaugaaaaacccaacuguggaugggauuguagcuaucgaccuugauccuguggucuacgacgccaaguucgaaaaacagcugggacagaucauguugcugauucucuguacgucgcaaauccuguuaaugcgcaccacaugggcacuuugcgagagcauaacucuggcuaccggcccccucacaacccuaugggaggguuccccagggaaguuuuggaauacuacgauugccguuucuauggcgaacaucuuccggggaucauaucuggccggcgcagguuuggcuuuuagccugaugaaaucccucggcgggggacgaagaggcacaggggcccagggagaaacccuuggcgagaaguggaagaggcagcugaaucaguugaguaaaucugaguucaacauuuacaagcgcagcgguaucauggagguggaccggucagaagcaaaagaggggcugaagagaggagagacuacccgucacgcugucuccaggggcacagccaaacuccggugguucguggaacgcaauuuaguaaagccugaggguaaggugauagaucugggcugugggcgaggaggcuggaguuauuacugcgccgggcuuaaaaagguuacugaagugaaaggauauaccaagggcggucccgggcaugaggaaccgaucccaauggcgacauacggauggaaccuggucaaacuacacagcggcaaggacguguuuuucacgccucccgagagaugugauacccuccugugcgacauuggcgagucuuccccaaaucccacuaucgaagaggggaggacauugcggguccugaaaaugguggaaccuuggcuccgcggaaaccaauuuuguauuaagauccuuaauccguacaugcccucaguuguagagacccuggagcagaugcagagaaagcaugguggcauguuagugaggaacccacugagccgaaauucgacucacgaaauguauugggucucuugcgggacaggaaacauugugagugcuguuaauaugaccucccggauguugcucaaccguuucacgauggcacacagaaaaccuaccuacgagcgcgauguggaccugggcgccgguacaaggcaugucgcuguggaacccgagguagccaaccuagauaucauagggcagcggauugaaaauaucaagcacgagcauaaaagcacuuggcacuaugacgaggauaacccuuacaagaccugggcauaucauggaucauacgaagugaaaccauccggcucugccagcaguaugguuaauggcgucgugaaacuucugacaaagcccugggacgugaucccuauggucacucaaauugcuaugaccgauacaaccccauuugggcagcagagaguuuucaaagagaagguggacacucgcacgcccaaagcgaagaggggaacagcccaaauaauggaaguaaccgcacgauggcucugggguuuucugucccggaacaaaaagccgagaaucuguacuagggaggaguucacccgcaaggugcguagcaaugcugccauuggcgcagucuuuguggacgagaaccaguggaacucugccaaagaggcuguugaagaugagcgguucugggacuuggugcagaaggaaagagagcugcacaaacaggggaagugcgccacaugcgucuauaacaugaugggaaaaagggaaaagaagcucggcgaguuugguaaagcgaaggggucacgcgcaaucugguacauguggcuuggagcccgauuccuggaguuugaggcuuuaggcuucaugaaugaggaucacugguucagucgggaaaacucccugagcggcguggagggggagggauugcauaaacucgguuacauucugagagacaucucuaagauaccuggcgggaauauguaugccgaugacacggcaggaugggauaccaggaucacugaagacgaucuacaaaacgaggcuaaaauuacagacaucauggaaccagagcacgcccuucuggcuaccucgauuuuuaagcucacuuaccagaauaaaguaguucgcgugcagagacccgccaagaacggcacagucauggaugugaucucacggagggaccagcgugguagcgggcaagugggaaccuauggccugaauacauucacuaacauggaagcacaguugauacgacagauggaguccgagggcauauuuuuaccuagugaacuggagaccccaaaccucgcggaacgcguccuugauuggcuggagaagcaugggguugaaagacuaaaacggauggccaucucuggagacgacugugugguaaagcccaucgaugacagguucgcuacggcccugaccgcacucaaugauauggguaaagugcgcaaggacauuccgcagugggagccuagcaaaggcuggaacgauuggcaacagguccccuuuugcucccaccacuuccaucaguugauaaugaaggacgggagagagaucgugguuccaugucggaaucaggaugaacuggugggaagggcucgagucucacaaggcgccgguuggagucuucgugagacagcaugccuggggaagucuuacgcccagauguggcagcucauguauuuucacagacgcgacuuacggcuggcggcuaacgccauuuguagcgcagugccuguagauuggguucccacuuccaggaccacauggucaauccaugcccaccaucaauggaugacuaccgaagacauguugagcguguggaauagagucuggauugaggaaaacccauggauggaggauaaaacgcacgugucuuccuggggagacguucccuaccugggcaagcgcgaggaccaguggugcggcagucucaucgggcuuacagcucgggccaccugggcaagcaauauacagguggcuaucaaccaggucaggcgacugauuggaaaugaaaacuaucuagauuacaugacuucgaugaaaagauucaagaaugagggugacccugaaggcgcccugugguga

SEQ ID NO: 13976 - RNA, 9879 nt, Artificial Sequence
  derived and/or modified CDS sequence (opt3) from DENV-1__HM181970__SS-prME
agcgugaccaugcugcucaugcuuaugcccacugcacuggcuuuccacuugacuacgagaggaggggaaccucauaugaucgucuccaagcaggaaaggggaaaaucuuuacuguuuaagaccucagccgguguuaauaugugcacauuaauugccauggaccucggagagcugugugaagauacuaugaccuacaaaugcccacggauuacagaggcggaaccggacgauguggacuguuggugcaaugcuaccgauacuugggugacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggcagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuauucaucagauauucggaacggcguacggcguccuguuuucuggugugagcuggaccaugaagaucgggauuggcguauugcucacuuggcugggauuaaauucacgaaguacaucccugagcaugaccuguaucgcugugggccuaguuacacucuaccugggggucauggugcaggccgauucuggaugcgugaucaacuggaaaggccgcgaacuuaagugugguucagggauuuucgucacuaaugagguucacaccuggacggaacaauauaaguuucaggcagacaguccgaaaagauugagcgccgcuauaggaaaggccugggaggagggcgugugcgguaucagguccgcaacacggcuggaaaacauuauguggaaacagaucucuaacgagcucaaucauauucuguuagaaaacgacaugaagcugaccgugguagucggcgauguggcugggauccuuggacagggcaaaaagaugauacgcccucaacccauggaguacaaauauucguggaaaagcugggggaaggccaaaaucauuggagcggacgcccagaauacuaccuucaucauugauggcccaaacacaccugaaugucccgacgaucagagagcuuggaauaucugggagguugaggacuacgguuuugggauauucacuaccaacauuugguugaagcucagggauuccuauacacaggugugcgaccaccgucugaugucagcagccaucaaagauaguaaggcuguccacgccgacaugggauacuggauugaaucugagaaaaaugaaacguggaagcuagcacgggcgagcuuuaucgaggugaagaccuguauauggccaaaaucccauacucuguggucaaacggcguucucgaaagcgagaugaucauucccaagaucuaugguggcccuauuucucaacacaauuaccgaccaggguacuucacacagaccgccggaccguggcaucugggcaaacuugaguuggauuucgaccugugcgaagggacuacagugguagucgaugagcacugcggaaacagaggccccuccuuaaggaccacgacugugaccgguaagaucauacacgaaugguguugccgcaguuguacacucccuccacugcgguuuagaggggaggacggaugcugguauggcauggagauuaggcccgugaaagaaaaggaggaaaaucuugucaagagcaugguuucugcugguuccggcgagguggacucauucagucugggguugcucuguaucagcaucaugauugaagagguaaugcgcucgcgauggucccggaaaaugcugaugaccggaacucuagccguguuuuuccugcucaucaugggccagcugacauggaacgaucuuauucguuugugcauaauggucggggcaaaugcuuuugacagaaugggaaugggcaccacauaccuggccuuaauggcaacuuucaagaugaggccuauguuugccgugggucuccuguuccgccggcuuaccucuagagagguucugcuacucacgaucgggcugagcuugguggcuucagucgaacugccaaacaguuuagaggaacucggagauggccuggcgaugggcauuaugauccuuaaacuguugacagacuuucaaucccaucagcucugggccacccugcuaucucugacuuucauuaagaccacauuuagccuucacuaugcauggaaaacuauggcuauggugcucuccaucguuucacuguuccccuugugucugagcaccacgagucagaagacaaccugguuaccggugcuccuggggucucuuggaugcaagccucugacuauguuuuugauagccgagaauaaaaucugggguaggaaguccuggccacucaacgaaggcauuauggccgucgggaucguaagcauucugcuaucgucacugcuuaaaaacgaugugccccucgcuggaccucugaucgcaggcgguauguugauagccuguuacguuauuucugggaguuccgcggacuuaagccuggagaaggcugccgaggugucuugggaagaggaagcagagcauagcggagccucccacaauauccucgucgaagugcaggaugacggcacaaugaaaaucaaggaugaggagcgagacgauacccugacuauucuucugaaagcuacauugcuagcaguaucaggcguguauccccugaguauaccagccacccucuucgucugguacuucuggcaaaagaagaaacagcgcagcgggguucugugggacacgccuucucccccagaaguggagcgggcggugcuugaugacggaaucuauagaauuaugcagagggguuuacugggccguucccaggucggggugggaguuuuucaagaagacguauuccauacuauguggcacgugacccgcggcgcuguccucauguaccaggguaagcgguuggagccgucaugggccagugugaaaaaggaucugaucagcuacgggggaggcuggagacucaggggcuccuggaacacaggggaggaaguucaggugauugcagucgagccuggcaaaaaucccaagaacgugcagaccgccccagguacauuuaagacucccgaaggcgagguaggggcuaucgcccuggacuucaaaccuggaaccucuggcucgccaauagucaaucgagaagguaagaucguggggcuuuauggaaacggcguugugacgacaagcggcacuuacgucucagcaauugcucaagccaaagcgucccaggaggggccccugccugagaucgaagaugagguguuucggaagcgcaauuugaccauuauggaccuacacccgggaagugguaaaacaagaagguaucugccagccaucguucgggaagcaauaaagcgaaagcucagaaccuuaauucuggcucccacucgcguggucgccucugagauggcugaagcacuuaaaggcaugccuaucagguaccagaccacagccguaaagagcgagcauacggggaaagagaucguagaucugaugugccacgccacuuucaccaugcgucucuuguccccagugcggguucccaacuauaauaugauuaucauggacgaagcucauuuuacagauccuucaucuauagcggcaagaggauacauuagcaccagggucggcaugggugaggccgcugccaucuucaugacugcaacaccgcccgggaguguggaagccuuuccacaauccaacgcugugauucaggacgaggaacgcgauaucccugagcgaagcuggaacucuggacacgaguggauaaccgacuuccccggcaagacggucugguuuguaccaucaauuaaauccggcaacgauaucgcgaauugucugagaaagaacgggaagcgggugauccagcucaguaggaaaacuuucgacacagaauaucagaagaccaaaaauaacgacugggauuacguugugaccacugacauuagcgagaugggagccaacuuccgcgcagaucgugucaucgacccuagacggugccugaagcccgugauucuuaaagaugguccagaaaggguuauacuagcuggcccgaugccugugacagucgccucggcagcccaacgccgagggagaaucggacggaaucauaacaaggagggcgaccaguacauuuauaugggucagccccugaauaacgaugaggaccacgcucacuggaccgaagccaagauguuguuagauaauaucaacacaccagaggggaucauucccgcgcuguuugaaccugagagggaaaaaucugcagccguggacggcgaguaccgccucagaggagaggcuaggaagacuuucguagaacugaugcggcguggcgaucuuccaguguggcuguccuauaaaguugccagcgagggguuucaguacucagaccgccgauggugcuucgauggagaaagaaauaaccaaguccucgaggaaaauauggacguggagauauggacgaaggagggugaaaggaaaaaguugcggccccgcuggcuggacgcuagaaccuauagugauccucuagcacugagggaguuuaaagaguucgccgcuggccggcgaucuguguccggggaccucauccuugagauuggaaagcugccgcagcauuuaacacagagagcccagaacgcauuggauaaucuggucaugcuccacaacagcgaacaaggcggucgcgcguacaggcaugccauggaggagcugccagacacuaucgaaacccuuaugcugcucgcuuugauugccguucugacagggggcgugaccuuauuuuuccuaucaggacggggccuggggaagacaaguaucggacuccuuuguguaauggcaagcuccgugcuguuguggauggcuucugucgagccccacuggauagccgcaagcaucauucuggaauuuuuccucauggugcugcuuaucccugagcccgaucgucagagaacgccacaggacaaucagcucgccuauguugugauuggucuguuguuuaugauccugaccgucgcugcgaacgagaugggcuuacuagaaacaacuaaaaaggaucuggggauaggacacguagccguggagaaucaucaccaugcagcuaugcucgacguugaucuucacccugccuccgccuggacccuguacgcaguggcuacaaccauuaucacucccaugaugaggcauacaauugaaaacacgaccgccaacaucucauugacugcgauagcuaaucaagccgcaauccugaugggccucgacaaagguuggccaauuucuaagauggauaucggggucccucugcuugccuuaggcugcuacagucaggugaacccgcugacacucaccgcugcagucuugaugcugguggcccacuaugcgauuaucggacccggccuacaggcuaaagccacccgcgaggcacaaaagcggacagccgcugggauaaugaagaauccaacuguugacggaauuguggccaucgaucuggacccuguaguguacgacgcaaaauucgaaaagcagcucggccagaucaugcuucugauuuuguguacgucgcagauccugcucaugcgaaccacaugggcucugugcgagagcauaacuuuagccaccgguccccuuacaacccugugggagggguccccaggaaaauuuuggaacacuacgauugcggucucuauggccaauaucuucagaggcucauaucucgcaggagcuggccuagccuucagccugaugaagucccuaggggguggcaggcgcgggacaggagcacaaggcgaaacccugggugagaaauggaagcggcagcucaaccagcuuaguaagucugaauuuaauacuuacaaaagaagcgggauuauggagguugaucguucagaagcuaaggagggacugaaaaggggcgagaccacaaagcacgccgugucccgggguacugccaaauugcgcugguucgucgaacgaaaccuggugaagccugagggcaagguaaucgaccucggguguggaagaggcggguggaguuauuacugcgcgggacuaaagaaggugaccgaaguuaaaggcuauacaaagggugggcccggacaugaggaaccgauaccaauggcuacguacggcuggaaucuggugaaacuucacagcggcaaggaugucuuuuucaucccucccgagaaaugugacacccugcuaugcgauauuggggagucuuccccaaaccccacuaucgaagagggaaggacacuccgggugcugaagauggucgaaccuugguugcgcgguaaucaguuuuguauuaagauccugaacccguacaugcccucagugguugagacccucgagcaaaugcagagaaaacauggcgggaugcuuguaaggaauccacugagccgaaacucgacucacgaaauguauugggugucuugcggaacaggcaauauugucagugcagugaacaugaccucccggauguuacugaaucguuucacgauggcccacagaaagccuaccuacgagcgcgacguugauuuggguacagggacuaggcauguggcugucgaacccgagguggccaaccucgacaucauaggacagcggauugaaaacaucaaacacgagcauaagagcaccuggcacuaugaugaggacaauccuuacaaaacaugggcauaucauggcucauacgaaguaaagccauccggcucugccagcaguauggugaacgggguugucaagcugcuaacuaaacccugggaugugaucccuauggugacccagauugcuaugacagacaccacuccauuuggacaacagagagucuucaaggagaaaguugacacgcgcacacccaaggcgaaaagggguaccgcccagauaauggaagugacugcacgauggcuuuggggcuuucugucccggaauaagaagccgagaaucuguaccagggaggaguucacacgcaaaguacguagcaacgcugccauuggggcaguguuugucgaugagaaucaauggaacucugccaaggaggcuguggaagacgagcgguucugggaucucguucacagagaaagggagcugcacaaacagggaaagugcgccacgugcguguauaauaugaugggcaaacgcgaaaagaaguugggugaguuugggaaagcgaagggaucacgagcaaucugguacauguggcugggcgcccgguuccucgaguucgaagcucuuggcuuuaugaacgaggaccauugguucaguagagaaaauucccugagcggggucgagggagaggguuuacacaaacugggcuacauuuugagggauaucucuaagauaccugggggaaacauguaugccgacgauaccgcaggcugggacacucgcaucacagaagaugaccuccagaaugaggcuaaaauuaccgauaucauggaaccagagcaugcccugcuagcuaaggccauuuuuaaacuuacuuaccagaacaaggugguaagaguucaacggcccgcaaagaaugguacagugauggacgucaucucgaggcgugaucagcgagggucaggacaggugggcaccuauggccugaacacauucacuaauauggaagcgcagcucauacgccaaauggagagcgaggggauauuuuccccuagugaacuggagaccccaaacuuggccgaaagagcuuuagacuggcuggagaaauacggaguggaacggcucaagaggauggccaucucuggugacgauugugucguuaaacccaucgacgaucgcuucgcaacggcucuuaccgcccugaacgacaugggcaaggugagaaaagauauuccgcagugggagccuagcaagggguggaaugacuggcagcagguacccuuuugcucccaccacuuccaucaacuaauaaugaaggauggacgggagaucguggucccauguaggaaccaggacgaacuggugggccgagcacguguuucacagggugccggguggagucucagagagacagcgugcuugggaaaaucuuaugcucagauguggcaacugauguacuuucaccgccgggaucuuaggcuggccgcaaaugccauuuguagcgcugugccugucgacugggugcccacuuccagaaccacauggucaauccaugcccaccaucaguggaugacuaccgaagauaugcucagcguauggaaccgcguuuggauugaggaaaauccauggauggaggacaagacgcacaucucuuccugggaggacgugcccuauuuaggcaaacgggaagaucaguggugcggcagucugauaggguugacagcaagggcuaccugggccacuaacauccaagucgcgauuaaucaggugcgaagacugaucggaaacgagaauuaccucgacuacaugacaagcaugaagcgguucaaaaacgaaucggauccugagggugcucuuugguga

SEQ ID NO: 13977 - RNA, 9879 nt, Artificial Sequence
  derived and/or modified CDS sequence (opt3) from DENV-1__GU131821__SS-prME
agcgugaccaugcugcucaugcuuaugcccaccgcacuggcuuuccacuugacuacgagaggaggggaaccucauaugaucgucuccaagcaggaaagggggaaaucuuuacuguuuaagaccucagccgguguuaauaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaagguggaaacuugggcuuugaggcacccuggauuuaccguuauugcacucuuccuggcccaugcuaucggcacaucgauuacccagaagggcaucauauuuauccugcucauguuagugacgccaucaauggccaugcggugcgucgggauuggaagccgcgauuucguggagggucugaguggcgcgacuuggguagacguugugcuugagcacggguccugugucacaaccauggcaaaagauaagcccacuuuggacaucgaacugcuaaaaacagaggugaccaacccugccgugcucagaaagcugugcauugaagcuaaaaucucuaauacgaccacagauaguagguguccaacucaaggagaggccacccuugucgaagaacaggacgcaaacuuuguuugccggcgcacauucguggaucgaggcugggguaauggguguggacuguuuggcaagggcuccuugauaacuugcgcuaaguucaaaugcguaaccaagcucgaggggaaaacagugcagcacgaaaaccugaaguacucagucauugugaccguucauacuggagaccagcaccaaguggguaaugagaguacggaacauggcacaaccgccacuaucacaccccaggcgccuagcacagagauucaguuaaccgacuauggggcccugacucucgauuguucuccaagaacaggacuugacuuuaacgaaaugguccuguugacgaugaaagagaaguccuggcuagugcacaaacagugguuccuggaucucccgcugcccuggaccucaggcgcaagcacaagccaagagacauggaauaggaaggaccuucugguaaccuuuaagacagcucacgccaaaaagcaggaaguuguggucuuggguucucaggagggggcuaugcauacugcccucaccggcgcaacggaaauccaaaccuccggaacaacuaccaucuucgccggccaccugaaaugccgguuaaagauggauaaacugacacuaaaggggaugagcuacgugauguguacuggaucguucaagcucgagaaagaagucgcugagacccagcaugguacggugcugguucagauuaaguaugagggcacagacgcgccuugcaaaauaccauuuucuacccaggaugaaaagggggugacucaaaacggacgucuuaucacagcaaaucccauuguaaccgacaaagagaagccugucaacaucgaagccgagccacccuucggcgaguccuacauagugauuggugcuggggaaaaggccuugaaacugucaugguuuaagaaaggcaguagcaucggaaagauguucgaggcaacugcccgcggcgcuagaaggauggccauccucggggauaccgcaugggacuuuggauccauugguggcguuuucacaucuguggggaaacugguccaccagaucuuuggaacggcguauggcgugcuuuucagcgguguaucauggaccaugaagauugggauaggcgugcuguugacuuggcucggacugaauagucgguccacuagcuuaucuaugaccuguaucgcuguuggccuggucacacuauaccucggggugauggugcaggccgauucaggaugcgucauuaacuggaagggccgagaacugaaaugugguagugggaucuuuguuacuaaugaggugcauaccuggacggaacaguacaaguuccaagcagacagcccgaaacgccuuuccgccgcuaucggaaaggccugggaggagggcgugugcgguauuagaucugcaacaagguuggaaaacauaauguggaaacagaucucgaacgagcugaaucacauucuccuggaaaacgacaugaaguuuaccguagucgugggcgauguugcugggaucuuagcccagggcaagaagaugauucggccucagcccauggaguauaaguacagcuggaaauccuggggcaaggcgaaaaucauaggggccgacgugcaaaauacuaccuucaucauugauggaccaaacacaccugaaugucccgacgaucagcgcgcuuggaauaucugggaggucgaggacuauggcuuugguauuuucacuaccaacaucuggcugaaacuuagagauucauacacacaggugugcgaccacagguugaugagugcagccauaaaagauucuaaggcuguucaugccgacaugggguauuggauugaaagcgagaagaaugaaacguggaaacucgcacgugcguccuucaucgaggugaagaccuguauuuggccaaaaucacacacucuguggagcaacggaguacuagaaucugagaugaucauacccaagaucuacggcgguccuauuucccagcauaauuaucggccaggcuacuuuacacaaaccgccgggccguggcaccugggaaaacucgagcuggauuucgaccuuugcgaaggcacuacagucgugguggaugagcacugcgggaaccgaggacccaguuugagaaccacgacugucaccggcaagaucauucaugaaugguguugcaggagcuguacacugccuccauuacgcuuuaagggugaggacgggugcugguacggaauggagauccggcccguuaaagaaaaggaggaaaaucucgugaaaucuaugguauccgcuggcucaggugagguggacaguuucagccugggccuucuguguauaucgauuaugaucgaagaggucaugagauccagguggucucgcaagauguugaugaccgggacucucgccguguuuuuccugcuaaucaugggacagcugacauggaacgaucucauucgacugugcaucaugguuggcgcaaaugcuagcgaccggauggggaugggaaccacauaucuugccuugauggcaacuuuuaaaaugcguccuauguucgccgugggccuguuauuuagaaggcucaccucacgcgagguccugcuucugacgauuggucuaagucucguggcuuccguugaacugccaaacucuuuggaggaacugggggauggauuagcgaugggcauaaugauccucaagcugcuuacagacuuccagagccaccaacugugggccaccuugcucucccugacuuuuauuaagaccacauucucacuacauuacgcauggaaaacuauggcuauggugcugagcaucgucagucuuuuuccccucugucugucuaccacgucccagaagacaaccugguugccgguacuguuaggcagccucgggugcaaaccucugacuauguuccuuauugccgagaauaagaucuggggacggaaaucguggccacugaacgaagguauaauggccgugggcaucguuucaauuuugcucucuagucugcuaaagaacgaugugccccuggcugggccucuuaucgcaggaggcaugcucauugccuguuaugucaucuccgguagcucugcggaccugagcuuggagaaagcugccgagguguccugggaagaggaagcagagcacucaggggccagucauaauauauuaguagaagugcaggaugacggaacaaugaagauuaaggaugaggagagagacgauacccugacuauccuccugaaagcuacacuucuggcagucagcggcguuuaccccuugucuaucccagccacccuauucgugugguauuuuuggcagaagaaaaagcaaagguccggcgugcugugggacacgccuucacccccagaagucgagcgagcggugcucgaugacgggauuuaccgcauaaugcagcggggacugcuugguagaagucagguuggcguagggguguuccaggaaaacgucuuucacacuauguggcacgugaccaggggagcuguuuuaauguaucaaggcaaacgucuggagccgagcugggccuccgugaagaaggaccucaucucuuacggugggggauggcgcuugcagggcucguggaauacaggcgaggaaguccaggugauugcaguagagccugggaaaaaccccaagaauguccagaccgccccaggaacauucaaaacuagcgaaggugaggugggcgcuaucgcccuggauuuuaagcccgggaccucaggauccccuauuguuaaccgggaaggcaaaaucgugggucucuacgggaauggagucgugacgacaaguggcacuuauguuucugcaauagcucaagccaaggcgagccaggagggcccacugcccgagaucgaagacgagguguucagaaagaggaaccuuaccauuauggaucugcauccuggguccggaaaaacacgacgguacuugccggccaucguccgcgaagcaauuaagagaaaacuaaggacccugauccucgcuccaacucgggugguagccucagagauggcugaagcauuaaaggguaugcccauacgauaucagaccacagccgugaaaucugagcacacgggcaaggagauuguugaccugaugugccaugccacuuuuaccaugagacuucugagcccuguccgcgugccaaauuacaacaugaucaucauggaugaagcucacuucacagaccccaguuccauugcggcaaggggguauaucagcacccgugugggaaugggcgaggccgcugccauauuuaugacugcaacaccuccggguucugucgaagccuucccccaaucaaaugcuguaauucaggaugaggaacgggacaucccagagagauccuggaacaguggguacgaguggauuaccgauuuuccuggaaagacggugugguucguucccagcaucaaaucgggcaaugacauagcgaacugucucaggaagaauggcaaacgcgugauucaguugucucgaaagacuuucgauacagaauaucagaaaaccaagaacaacgacugggacuacgucgugaccacugauaucuccgagaugggggccaauuuuagagcagaccggguuaucgauccaaggcgcugccugaagccugugauucucaaagacggacccgaacgugucauccuggcugguccaaugccggugacaguagccagcgcagcccaaagacggggcaggauugggcgcaaccauaauaaggagggagaucaguacauauauaugggccagccucuuaacaaugacgaggaucacgcucacuggaccgaagccaaaaugcuacuggacaacaucaauacacccgaggguauuaucccagcguuguucgaacccgagcgagaaaagucagcagccaucgauggggaguacagauuacggggcgaggcuaggaaaacuuuuguggaacugaugcgcagaggagaccucccuguuuggcugaguuauaaggucgccucugagggcuuccaguacuccgauaggcgguggugcuuugacggggaacguaacaaucaagugcuugaggaaaacauggauguggagauuuggacgaaagagggagaacgcaagaagcugcgaccaagauggcucgacgcuaggaccuauagcgaccccuuggcacugcgggaguucaaagaauuugccgcuggucgcagaucagucaguggcgaucuaauacuggagaucgggaagcucccucagcaucuuacacagagggcccagaaugcacuggacaacuuaguuauguugcacaauagcgaacaaggaggccgggcguaccgacaugccauggaggagcugccggauacuauugaaacccucaugcugcuugcucugaucgccgugcucacaggugggguaaccuuguucuuucuguccggcagaggauuaggcaaaacuucuauugggcuacugugugugauggcaagcuccgcucuccuuuggauggccucagucgagccacacuggaucgcagccucuauaauccuggaguucuuuuugauggugcugcucauucccgagccugaccgccagaggacgccccaggauaaccagcuggcuuauguugugaucggacuucucuucaugauucugaccgucgcggccaaugagauggguuugcuggaaacaacuaagaaagacuuaggcaucgggcacguagcaguggagaaccaucaccaugcuaccaugcuagauguugaccugcacccagccagugccuggacacucuacgcaguggcuaccacuauaauuacaccuaugaugcggcauacgaucgaaaacaccacugccaauauuucgcuuacagcgaucgcuaaccaagccgcaauacugaugggauuggauaagggcuggcccaucagcaagauggacauuggugucccacugcucgcccuggggugcuacucccaggugaauccucuuaccuuaaccgcugcaguccugaugcucguggcccacuaugcgaucauuggcccgggauugcaggcuaaagccacacgugaggcacaaaagagaacugccgcuggcaucaugaaaaaccccacgguugaugggauaguggccauugaccuggauccaguaguguacgacgcaaaguuugaaaaacagcuaggacagaucaugcugcucauccuuuguaccucucagauucuguugaugaggacaacuugggcucugugcgagucaaucacccucgccacaggcccucugaccacuuuaugggaggguagccccgggaaguucuggaauacgacaauagcggucuccauggccaacauuuuccgcggaaguuaucuugcaggcgcuggucuggccuuuucucucaugaaaagccuaggcgggggacggcgaggcaccggggcacaaggagaaacucugggcgagaaauggaagagacaguugaaucagcugucaaaauccgaguucaacaccuacaagaggagugguaucauggagguugaccgcagcgaagcuaaagaggggcucaagcggggagagacaacuaagcacgccgugucuagaggcaccgccaaacuucguugguuugucgaaaggaaucuggugaagccagaggguaaaguaauugauuugggcugugggcggggaggcugguccuauuacugcgcggggcugaagaaagugacagaaguuaagggauauacgaaaggcgguccugggcaugaggaacccaucccgauggcuaccuacggauggaaccucgugaaguuacacucaggcaaggacgucuucuuuauaccaccugagaaaugugauacucugcuuugcgacaucggcgagagcucgcccaauccaacaauugaagaggggcgcacccugcgagugcuaaagauggucgaacccuggcucagaggaaaccaguucuguaucaaaauucugaauccuuacaugccgucugugguugagacuuuggagcaaaugcagaggaagcaugguggcaugcugguacggaacccccucagucgcaauuccacacacgaaauguauugggugagcugcgggaccggaaacaucgucucagcagugaauaugacguccagaaugcuucugaacagguuuaccauggcccaccgaaaaccaacauacgagcgggauguugacuuaggcgcugguacucgucauguggccgucgaaccugagguggcaaaccuggauauuaucgggcagagaauagaaaauauuaagcacgagcauaagucuaccuggcacuaugacgaggauaaccccuacaaaacaugggccuaucauggaagcuacgaaguaaagccuaguggcuccgcuagcucuauggugaauggcguugucaaauugcucacuaagccaugggacgugauccccauggugacccagaucgcgaugacagauaccacuccuuucgggcaacagcgcgucuuuaaagagaagguugacacgaggacaccaaaggccaaacggggaaccgcacagauuauggaagugacugcuaaguggcugugggguuuccuaucaagaaacaaaaagccccgcauauguaccagggaggaauuuacacgaaaaguacggaguaaugccgcaaucggcgccguguucgucgacgagaaccaauggaacuccgcuaaggaggccguggaagaugagagauuuugggaccuuguucacagggaacgcgagcugcacaagcaggggaaaugcgcgacgugcguguauaacaugaugggaaagcgugagaagaagcucggcgaguucgguaaagcaaaggggagccgggccauuugguacauguggcugggagcuagauucuuggaguuugaagcccugggcuucaugaaugaggaucauugguuuucuagggaaaacucgcucucaggcgucgagggggagggacuucacaaacuggguuacaucuuacgcgacauuagcaagaucccgggcgggaauauguaugcagaugacaccgcuggaugggauacucgaauaacagaagacgaucugcagaacgaggccaagaucaccgacauuauggaaccugagcaugcuuugcucgccaaauccaucuucaagcugacuuaccagaauaaagugguacggguucaaagaccagcaaagaacggcacagugauggaugucauuaguaggcgcgaccagagagguucuggacaggugggaaccuauggccuaaauacauuuacuaacauggaagcgcagcuuauccggcaaauggagagcgagggcauauucucccccucagaacuggagaccccuaaccucgccgggagggugcuggauugguuggaaaaacacggagucgagcguuuaaagcgaauggcuauuaguggugacgacuguguugugaagccaaucgaugaccgcuuugccacggcacugaccgcucucaaugauaugggcaaaguaagaaaggacaucccccagugggaaccgucuaaaggguggaacgauuggcaacaggugccuuucugcagccaccauuuucaccaacuuauuaugaaggacggacgggagauagucgugcccuguaggaaucaggaugagcugguuggccgcgccagagugucccagggugcaggguggucacuacgggaaacagccugccugggaaaaagcuacgcgcagauguggcaacucauguauuuccauaggcgagacuugcgucuggcugccaacgcaaucuguucugccgucccaguggaguggguaccuacuuccagaaccacauggaguauucacgcucaucaccaguggaugacuaccgaagauaugcuuagcguuuggaaucgcguguggaucgaggaaaaccccuggauggaggacaagacgcacauuucguccuggggcgaugucccauaccugggcaagcgggaggaccaguggugcgggucucucaucggauuaacagccagggcaaccugggcuacuaauauacaaguggccaucaaccagguuagacgccugauugguaaugaaaacuauuuggacuacaugacaucaaugaaacgguuuaagaaugagagcgaucccgaaggcgcgcugugguga

SEQ ID NO: 13978 - RNA, 9879 nt, Artificial Sequence
  derived and/or modified CDS sequence (opt3) from DENV-1__JF937617__SS-prME
uccgugaccaugcugcucaugcuuaugcccacagcacuggcuuuccacuugacuacgagaggaggggagccucauauggucguuuccaagcaagaaagaggaaaaucuuuacuguuuaagaccucagccggugugaauaugugcacacugaucgccauggaccucggcgagcugugugaagauacuaugaccuacaaaugcccacggauuacagaggcggaaccggacgauguagacuguuggugcaaugcuaccgauacuugggugacauaugggaccuguagucaaacgggagagcaccgccgagacaagcguagcgucgcccuugcaccccaugugggccuggguuuggagacuagaaccgaaacauggauguccucugagggggccuggaaacagauacagaggguugaaacuugggcucuccggcacccuggauucaccgugaucgcacuguuucuggcccaugcuauuggcacaucgaucacccagaagggcauuaucuucauacucuuaaugcuggucacgccaucaauggccaugcgcugcguggggaucggaagcagagauuuuguagagggucuuaguggcgcgacuuggguugacguggucuuggagcacggguccugugugacaaccauggcaaaggauaaacccacucuggacauugaacugcucaagacagaggugaccaacccugccauccugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauaggguugggcgugcuccugacuugguuaggacuaaauucacgaaguacaucccuaagcaugaccuguaucgcuguuggccucgucacacuguaccuuggggugauggugcaggccgauucuggaugcgucauuaacuggaaaggccgcgaauugaagugugguucagggaucuucguuacuaaugaggugcacaccuggacggaacaauauaaguuucaggcagacaguccgaaaagacugagcgccgcuaucggaaaggccugggaggagggcgugugcgguauuagguccgcaacacggcucgaaaacguaauguggaaacagauaucuaacgagcugaaucauaucuuacuggaaaacgacaugaaguucaccgucgugguuggcgauguggcugggauucuugcccagggcaaaaagaugauccgcccucaacccauggaguacaaauauucguggaaaagcuggggcaaggcgaagauuaugggggccgacguccagaauacuaccuuuaucauagauggaccaaacacaccugaaugucccgacgaucagagagcuuggaauaucugggagguggaggacuacggcuucgguauuuuuacuaccaacaucugguugaagcucagggauuccuauacacagguuugcgaccaccgucugaugucagcagccauuaaagauaguaaggcugugcacgccgacaugggguacuggaucgaaucugagaaaaaugaaacguggaagcuagcacgggcgagcuucauagagguaaagaccuguauuuggccaaaaucccauacucuguggucaaacggaguccucgaaagcgagaugaucauucccaagaucuauggcgguccuauaucucaacacaauuaccgaccaggcuacuucacacagaccgccgggccguggcaucugggaaaacuugaguuggauuuugaccugugcgaaggcacuacagugguggucgaugagcacugcgggaacagaggacccuccuuaaggaccacgacuguuaccggcaagaucauucacgaaugguguugccgcaguuguacacucccuccacugcgguucagaggugaggacgggugcugguauggaauggagaucaggcccgugaaagaaaaggaggaaaaucuuguaaagagcauggugucugcuggcuccggugaggucgacucauuuagucugggcuugcucuguauuagcaucaugauagaagaggugaugcgcucgcgauggucccggaaaaugcugaugaccgggacucuaguuguguuccugcuccugauuaugggacagcuuacauggaacgauuugauccgucugugcaucauggucggcgccaaugcaucugacagaauggggaugggaaccacauacuuagcucucauggccacuuuuaagaugaggccuauguucgcagugggccugcuuuuucgccggcugaccagcagagagguucuacuccugacgauugguuugucacugguggccagugucgaauuaccaaacucccucgaggaacugggggauggacuugcuaugggcaucaugauucugaaauugcucacagacuuccaaucucaucagcugugggcgacccuacugagccuuacuuuuauaaagaccacauucucccuccacuaugccuggaaaacuauggcaaugguacugucaaucgugagcuuguuuccccuguguuuaaguaccacgucucagaagacaaccuggcucccgguucugcuuggcucccuggggugcaagccuuugacuauguuccucauugcugagaauaaaaucuggggaaggcgaagcuggccacugaacgaagguauuauggccgugggcaucgucucgauacuacugucaucucuucucaagaacgaugugccccuggccgggccuuugaucgcuggaggcauguuaauugcauguuacguaaucagugguuccagcgccgaccugucucucgagaaagcggcugaggugagcugggaagaggaagccgagcauuccggggcaucacacaauauucuggucgaaguucaggaugacggaacaaugaagaucaaagaugaggagcgcgacgauacccuuacuauacuguugaaggccacacuacuggcugugaguggcguguauccccucagcauuccagcaacccuguuugucugguacuucuggcagaaaaagaagcagcggucuggcgugcuuugggacacgccuucacccccagaaguugagagagccguauuagaugacgggaucuauaggaucaugcagcguggacugcucggucgcagccaggugggcgucgggguguuccaagaaaacguuuuucauacuauguggcacgugacccggggagcggucuugauguaccagggcaaaagacuggagccgaguugggcuagcgugaagaaagaccucauuuccuacggugggggauggaggcugcagggcucuuggaauacaggcgaggaaguacaggucauagccguggagccugggaagaaccccaaaaauguucaaaccgcaccaggaacauucaagacucccgaaggugagaucggcgccauugcucuugauuuuaagccugggaccucgggaagcccaaucgugaaccgagaaggcaaaauugucggucuguaugggaauggagugguuacgacaucaggcacuuacguguccgccaucgcacaggcuaaggccagucaggagggccccuugccugagauagaagacgaggucuuccggaaacgcaaccuaaccaucauggaucugcacccggggucuggaaagacaagaagguaucucccagcgauugugcgggaagccaucaaacgaaaguuaagaacccugauucuugcacccacucgcguaguggcuagcgagauggccgaagcucugaaggguaugccuaucagguaccaaaccacagcaguuaaauccgagcauacgggcaaggagauagucgaccucaugugccacgccacuuuuaccaugcguuugcugucaccagugcgggugcccaauuauaacaugauuaucauggaugaagcccauuucacagacccuucuagcaucgcugcgagaggguacauuaguaccagggucggaaugggcgaggcagccgcuaucuuuaugacugccacaccgcccgguuccguagaagcauucccacagagcaaugccgugauacaggaugaggaacgcgacauuccugagcgaucuuggaacucaggguaugaguggaucaccgauuuucccggaaaaacgguuugguucgugccauccauuaagaguggcaaugacaucgcuaacugucucaggaaaaauggcaagcgggucauacagcugagcaggaagacuuuugauacagaauaccagaaaaccaagaacaacgacugggacuacgugguuaccacugauauuucggagaugggggcgaauuuccgcgccgaccgugugaucgauccuagacggugccuuaaacccgucauccuaaaggacggaccagaaagggugauucuggcagguccgaugccuguaacaguggcuucugccgcacagcgccgaggcagaaucgggcggaaccacaauaaagagggagaucaguauauuuacaugggccagcccuugaacaaugacgaggaucaugcccacuggaccgaagcuaagauguuacuggacaacauaaauacaccagaggguaucauucccgcccucuucgaaccugagagggaaaaguccgcggcaaucgauggggaguaucgccugagaggcgaggccaggaaaacuuuuguugaacuuaugcggcguggagaccugccagucuggcucagcuacaagguggcuucagagggcuuccaauauagugaucgccgauggugcuuugacggggaaagaaacaaucagguguuggaggaaaacauggaugucgagaucuggacgaaagagggagaaaggaagaaacugcggccccgcuggcuagacgccagaaccuacucugacccucuggcucucagggaguucaaggaauuugcagccggucggcgauccguuagcggcgaucuuauucuggagauagggaaauuaccgcagcacuugacacagagagcucaaaaugcccuggacaaccucgugaugcugcauaauucagaacagggaggccgcgcauauaggcacgcgauggaggagcuuccagauacuaucgaaacccugaugcucuuggcccugauugcuguauuaacagguggggugacccuauucuuucugaguggccggggacucggcaagacuagcaucgggcuucugugugucauggccuccucuguguugcuguggauggcaagcguugagccccauuggauugcugccuccaucauacucgaguucuuucugauggugcuucucaucccugagcccgaccgucagagaacgccacaggauaaccaacuggcauacgucguaauuggauugcuguucaugaucuuaaccguggccgcuaaugagaugggucuacuggaaacaacuaagaaagaccucggcauugggcacgcggccguuggaaaccaccaucacgcagcuaugcuugauguggaccugcauccugccucagccuggaccuuguacgcagucgcuacaaccaucauaacucccaugaugaggcacacaauugagaacacgaccgccaauaucucucugacugcgauugcuaaccaggccgcaauccucaugggccuggauaaggguuggccaauaaguaaaauggacaucggggugccucuuuuagcccugggcugcuauucgcaggucaauccgcucacauugaccgcugcagugcugaugcuaguugcccauuacgcgauuaucggacccggccugcaagcuaaggccacccgcgaagcacagaaacggacagccgcugggauuaugaagaacccaacuguggauggaaucguagccauagaccucgauccuguggucuaugacgcaaaguuugagaaacagcuuggccagauuaugcuguugauccuguguacgagccaaauccuccugaugcgaaccacaugggcuuuaugcgaauccauuacucuugccaccgguccccugacaacccucugggaggggucuccaggaaaguucuggaauacuacgaucgcgguuucaauggccaacauauuuagaggcagcuaccuagcaggagcuggccuggccuucuccuugaugaaaagucuagggggaggcaggcgcgggacaggagcacagggcgagacccucggugaaaaguggaaacggcagcuuaaucagcugucuaagagcgaguucaacacuuauaagagaucagggauuauggaaguggaccguuccgaggcuaaagaaggauugaagaggggcgagaccacaaaacacgccgucagucgggguacugccaagcugcgcugguuuguggagcgaaaucucguaaaaccugaaggcaaggugaucgauuuaggguguggaagaggcggguggagcuacuauugcgcgggacugaagaaaguuaccgaggugaagggcuacacaaaaggugggcccggacacgaagaaccgauuccaauggcuacguacggcuggaaccuugucaagcugcauucuggcaaagacguguucuuuaucccucccgaaaagugugauacccuacucugcgacauaggggaguccucaccaaaucccacuaucgaggaaggaaggacacugcgggucuugaaaaugguggagccuuggcugcgcgguaaccaauucuguauuaagauccucaauccguauaugcccagcguuguagaaacccuugagcagaugcagagaaagcacggcgggaugcuggugaggaacccauuaucgcgaaauucuacucaugagauguacugggucaguugcggaacaggcaacauuguguccgcaguuaauaugaccagccggaugcuguugaaccguuuuacgauggcccacagaaaaccuaccuaugaacgcgauguggaccucggugcugggacaaggcacgucgccguggagcccgaaguagcaaaccuggauaucauuggacagcggaucgagaauauaaagcaugaacacaaaucaacuuggcauuacgacgaggauaacccuuauaagaccugggccuaccacggcuccuaugaggugaaaccaucuggcagcgcuaguuccaugguuaauggggucgugaagcuacuuacaaagcccugggacgugauuccuauggucacucaaaucgcgaugaccgauacaaccccauucggacagcagagaguuuuuaaagaaaagguggacacucgcacgcccaaagccaagagggguacagcacaaaucauggagguaaccgcuaaauggcuguggggcuuccucagccgaaacaagaagccgcggauuuguacuagagaagaguuuaccaggaaagugcgcucuaaugccgcaauaggggccgucuucguggacgaaaaccaguggaacucagcuaaggaggccguugaggaugaacguuuuugggaccuggugcaucgggagagagaauugcacaaacagggaaagugcgcgacaugcgucuacaacaugaugggcaaaagggagaagaagcugggugaguucgggaaagcaaagggaagucgcgccaucugguacauguggcucggcgcucgauuucuugaguucgaggcccugggcuucaugaaugaagaucacugguuuucccgggagaacagcuuaucugggguggaaggagagggucugcauaaauugggcuauauucucagagacaucucgaagauuccugggggaaauauguacgcagaugacacggcuggcugggauaccaggaucacugaggacgaucugcagaacgaagcccgcauaacagacaucauggagccagaacacgcucuacuugccaaaucaauuuucaagcugaccuaucaaaauaaaguaguuagagugcagcggcccgcaaagaacgguacugucauggaugugaucagcaggcgugaccagcgaggguccggacaggugggcacauacggccucaauaccuuuacaaacauggaggcgcaacugauucgccagauggaaagugaggggaucuucucuccuagcgaguuggaaacuccaaacuuagccgagagaguccuggauuggcucgaaaaguauggaguugagcggcuuaaaaggauggcuauauccggugacgacugugugguaaagcccauugaugaccgcuuugccaccgcacugacggcucuaaaugauaugggcaaagugagaaaggacaucccgcagugggaaccuucaaaaggguggaacgauuggcagcaaguccccuucugcagucaucacuuucaccagcugaucaugaaggacggacgggagauugugguuccauguaggaaucaggaugagcucgugggccgagcccgugucucucagggugcaggguggagcuugagagaaaccgccugccugggaaaguccuacgcgcaaauguggcagcuuauguauuuccaucgccgggaccugaggcucgcugccaacgcaauauguucagccgugccuguagauuggauccccacaagcagaacuaccuggucuauucacgcucaucaccaguggaugacaacugaggacauguuauccguuuggaaucgcguguggaucgaagagaacccauggauggaagauaaaacccauauuaguagcuggggcgacguccccuaccugggcaagcgggaggaccaauggugcgggucguugaucggacugacggccagggcaacaugggcuaccaauauacagguggccaucaaccagguucgaagacucauugguaaugagaacuaccuugauuauaugacuuccaugaaacgguuuaagaaugaaucugacccugagggcgcgcugugguga

SEQ ID NO: 13979 - RNA, 9879 nt, Artificial Sequence
  derived and/or modified CDS sequence (opt3) from DENV-1__JF937618__SS-prME
agcgugaccaugcugcucaugcuuaugcccacagcccuggcuuuccacuugacuacgcggggaggggagccucauaugaucgucuccaagcaggaaaggggaaaaucuuuacuguuuaagaccucagccgguguuaauaugugcacauugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcaauucugaggaaacuuugcaucgaagccaagauaucuaauaccacaacugauagccgguguccaacccaaggagaggcuacacugguggaagaacaggacgccaacuucgucugccgccgaacuuuuguugauagaggcugggguaauggguguggauuguucggcaaaggcucccucauuaccugcgcaaaguuuaagugcgugacaaaacuggaggggaagaucguacaguacgaaaacuuaaaauauucagugauugucaccgugcacacuggagaccagcaucaaguugguaaugagaguacggaacacggcacaaccgcuacuaucacaccccaagccccuaccaccgagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauucagacaucuggaacuaccacaauauuugcaggccauuuaaaaugccgucugaagauggauaaacuaacucucaaggggauguccuaugucauguguaccggaucguucaaacuggagaaggaaguggccgagacgcagcacgguacaguccuugugcagaucaaguacgagggcaccgacgcuccuugcaaaauuccauucucgacucaagaugaaaaggggguuacacagaacggacgcuugaucaccgcgaaucccauagugacugacaaagagaagccuguaaacauugaagcagagccacccuuuggcgagucuuauaucgucaucggugccggggaaaaagcucugaagcucuccugguucaagaaaggcucaaguauuggaaagauguuugaggccaccgcaagaggcgccaggcggauggcuauccugggggauacagccugggacuucggaagcauugguggcguguuuacguccguugggaaacuugugcaucagauauucggaaccgcauacggcguccuguuuucuggugugagcuggacuaugaagaucgggauuggcguauugcucacauggcugggauuaaauucacgaaguaccucccugagcaugacauguaucgcggugggccuaguuacucucuaccugggggucauggugcaggcugauucuggaugcgugaucaacuggaaaggccgcgaacuuaagugugguucagggauuuucgucaccaaugagguucacacguggacagaacaauauaaguuucaggccgacaguccgaaaagauugagcgcagccauaggaaaggcuugggaggagggcgugugcgguaucagguccgccacccggcuggaaaacauuauguggaaacagaucucuaacgagcucaaucauauucuguuagaaaacgacaugaaguucacugugguagucggcgauguggcagggauccuggcucagggcaaaaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuuggcuuaaguugagggauuccuauacgcaggucugcgaccaccgucucaugucagcugcaaucaaagauaguaaggccgugcacgcugacaugggguacuggauugaaucugagaaaaaugaaaccuggaagcuggcccgggcauccuucaucgagguuaagacuuguauauggccaaaaucccauacacuauggucaaacggagugcuggaaagcgagaugaucauucccaagaucuauggcgguccuauuucucaacacaauuaccgaccaggcuacuucacccagacugcggggccguggcaucucggaaaacuggagcuugauuuugacuugugcgaaggcacaaccguagucguggaugagcacugcgggaacagaggacccucccugaggacgacuaccgugacaggcaagaucauacacgaaugguguugccgcaguuguaccuuaccuccacuccgguucagaggugaggacgggugcugguauggaauggagauuaggcccgucaaagaaaaggaggaaaaucugguuaagagcauggugucugccggcuccggugagguagacucauuuagucuuggccuguuguguaucagcaucaugauugaagaggugaugcgcucgcgauggucccggaaaaugcucaugacugggacacuggcugucuuccuacugcucaucaugggacagcugaccuggaacgaucuuauucguuugugcauaauggugggcgccaaugcaucugacagaauggggaugggaacaacuuaccuggcuuuaauggccaccuuuaagaugaggccuauguucgcaguuggccuccuguuucgccggcuuacgagcagagaggugcugcuacucacaaucggucugucauuggucgccaguguggaacugccaaacuccuuagaggaacucggggauggacuggcuaugggcauuaugauccuuaaacuguugaccgacuuccaaucucaucagcucugggcgacucugcuaagccugaccuuuauuaagacaacuuucucccuucacuaugccuggaaaaccauggcaaugguucucucaaucgugagccuguuucccuugugucugaguacgacaucucagaagaccacuugguuaccgguccuccugggcucccuugggugcaagccucugacaauguucuugauagcugagaauaaaaucuggggaaggcgaagcuggccacucaacgaagguauuauggccguaggcaucgugucgauucugcuaucaucucugcuuaagaacgauguuccccucgccgggccucugaucgcuggaggcauguugauagcauguuacgugauuagugguuccagcgccgacuuaucucuggagaaagcggcugaggucagcugggaagaggaagccgagcauuccggggcaucacacaauauccucguggaaguacaggaugacggaaccaugaagaucaaagaugaggagcgcgacgauacucugacaauucuucugaaggccaccuugcuagcugugaguggcgucuauccccugagcauaccagcaacgcucuuuguuugguacuucuggcagaaaaagaagcagcggucuggcgugcugugggacacuccuucacccccagaaguggagagagccguccuugaugacgggaucuauaggauuaugcagcguggauuacugggucgcagccaggugggcguugggguauuccaagaaaacguguuucauaccauguggcacgucacacggggagcggugcucauguaccagggcaaaagauuggagccgaguugggcuagcguuaagaaagaccugaucuccuacggugggggauggaggcuccagggcucuuggaauaccggcgaggaagugcaggucauugccguggagccugggaagaacccccgaaauguacaaacaacuccaggaaccuucaaaacgcccgaaggugaggucggcgcaaucgcccuggauuuuaagccugggacaucgggaagcccaauagugaaccgggaaggcaagaucguuggucuuuaugggaauggaguggucacuaccucaggcacauacguguccgcuauugcccaggcaaaagcuagucaggagggcccccugccugagaucgaagacgagguuuuccgcaagagaaacuugaccauuauggaucuacacccggggucuggaaaaacuaggcgguaucugccagccaucgugcgagaagcgauaaagagaaaacuccgcaccuuaauucuggcccccacaagggucguggcaagcgagauggcugaagcccuuaaggguaugccuauccguuaccaaacgacugcuguaaaguccgagcauaccggcaaagagaucguggaccugaugugccacgcaacauuuaccaugcggcucuugucaccaguuagaguccccaauuauaacaugauuaucauggaugaagcccauuucacugacccuucuagcauagccgcuaggggguacauuaguacacgcgugggaaugggcgaggcggcagccaucuuuaugaccgcuacgccgcccgguuccguggaagccuucccacagagcaaugcagucauucaggaugaggaacgagacaucccugagagaucuuggaacucaggguaugaguggauaacugauuuucccggaaagacaguaugguucgugccauccauuaaaaguggcaaugacaucgccaacugucugcggaagaauggcaaaaggguuauccagcucagccgcaagaccuuugauaccgaauaccaaaagacuaaaaacaacgacugggacuacguggucacaaccgauauuucggagaugggggcuaauuuccgugcggacagagugaucgauccucggaggugccugaagcccguuauucuuaaagacggaccagaacgcgugauacuagccgguccgaugccugucacaguggcaucugcugcccagcgaagaggccggaucgggaggaaccacaauaaggagggagaucaguauauuuacaugggccagccccugaacaaugacgaggaucaugcacacuggacugaagccaaaauguuguuagacaacaucaauacgccagaggguaucauucccgcucuguucgaaccugagcgcgaaaaguccgccgcgauagauggggaguauagacucaggggcgaggcacggaagaccuuuguagaacugaugcgucgcggagaccuuccaguguggcugagcuacaaaguugccucagagggcuuccaauauagugaucgaagauggugcuuugacggggaaaggaacaaucagguccucgaggaaaacauggauguggagaucuggacaaaggagggagaacggaaaaaguugcgccccagauggcuggacgcuaggacuuacucugacccucuagcccugcgggaguucaaagaauuugcugcaggucgaagauccgugagcggcgaucucauucuugagaucgggaagcugccgcagcacuuaacccagcgcgcccaaaaugcuuuggacaaccuggucaugcuccauaauucagaacagggaggcagggccuaucggcacgcaauggaggagcugccagauacaauugaaacccuuaugcugcucgcguugaucgccguucugacugguggggugacguuauucuuucuaaguggccguggacugggcaaaaccagcauagggcuccuuuguguaauggcuuccucugugcuguuguggacagccagcgucgagccccauuggaucgcagcuuccauuauccuggaguucuuucucauggugcugcuuauuccugagcccgacagacagaggacuccacaggauaaccaacucgccuacguugugaucggacuguuguucaugauacugaccgucgcagccaaugagauggguuuacuagaaacaaccaagaaggaccugggcauugggcacguagcugugggaaaccaccaucacgcggccaugcucgauguugaccuucauccugcaucagcuuggacucuguacgccguggccacaacgaucauuacccccaugaugcgccacacuaucgagaacacaaccgcaaauauaucuuugaccgcuaucgccaaccaggcggcuauucugaugggccucgauaaagguuggccaaucaguaagauggacauuggggucccucugcuugccuuaggcugcuauagccaggugaauccgcugacacucacugcagccgucuugaugcugguggcucauuacgcaaucauaggacccggccuacaagccaaagcgacgcgggaagcucagaagcgaaccgccgcagggauuaugaaaaacccaacaguugauggaaucguggccaucgaccuggauccuguaguguaugacgcuaaguuugagaagcagcucggccagauuaugcuucugaucuuguguacuagccaaauacugcucaugagaaccacaugggcccugugcgaauccauuaccuuagcaacugguccccuuacgacacugugggaggggucuccaggaaaauucuggaauaccacuaucgcugucucaauggccaacauuuuuaggggcagcuaccucgcgggugccggccuagcauucucccugaugaagagucuagggggaggccgccgggggaccggagcucagggcgagacacugggugaaaaauggaagagacagcucaaucagcuuucuaaaagcgaguucaacacuuauaagcguucagggaucauggaaguugacagguccgaggccaaggaaggacugaaacggggcgagaccacaaagcacgcagugagucgcgguacggcuaaauugcgaugguuugucgagagaaaucuggugaagccugaaggcaaaguaauagaucucggguguggaaggggcggguggagcuacuauugcgccggauuaaagaaggugaccgagguuaaaggcuacacuaagggugggcccggacacgaagaaccgaucccaauggccacauacggcuggaaccuggugaaacuucauucuggcaaggacgucuucuuuauuccucccgaaaaaugugauacccugcuaugcgacaucggggaguccucaccaaaucccacuauugaggaaggacggacacuccgcgugcugaagauggucgagccuugguugagagguaaccaauucuguaucaaaauucugaauccguauaugcccagcgugguugaaacccucgagcagaugcagaggaagcacggcgggaugcuuguacgaaacccacugucgagaaauucuacgcaugagauguacugggugaguugcggaaccggcaacaucgucuccgcggugaauaugacaagccguauguuacugaacagauuuacuauggcucaccgcaagccuaccuaugaaagggauguugacuugggugcagggacacggcacguggccgucgagcccgaaguggcuaaccucgauauaauuggacagagaaucgagaauaucaaacaugaacacaagucaacuuggcauuacgacgaggauaacccuuauaaaaccugggccuaccacggcuccuaugagguaaagccaucuggcagcgcaaguuccauggugaaugggguugucaaacugcuaacaaagcccugggacgugauuccuauggugacccaaauagccaugacugauacgacaccauucggacagcagcgcgucuuuaaggaaaaaguugacaccaggacucccaaggcuaaacgagguaccgcgcaaaucauggaggugacagccaaguggcuuuggggcuuccugagccggaacaaaaagccgagaauuuguacgagggaagaguuuacccgcaagguacguucuaaugcagcuaucggggccguguucgucgacgaaaaccaguggaacucagcaaaagaggccguggaggaugaacgguuuugggaccucguucauagagagagggaacugcacaagcagggaaaaugcgcuacuugcguguacaacaugaugggcaagcgcgagaaaaaguugggugaguucgggaaggccaaaggaagucgagcgauuugguacauguggcugggcgcacgguuucucgaguucgaggcccuuggcuucaugaaugaagaucacugguuuuccagagagaacagccugucuggggucgaaggagaggguuuacauaagcugggcuauaucuugagggacauaucgaaaaucccugggggaaauauguacgcugaugacacagccggcugggauacccgcauuacugaggacgaucuccagaacgaagcaagaaucacagacauuauggagccagaacacgcucugcuagccaagucaaucuucaaacuuaccuaucaaaauaaggugguacggguucagaggcccgcuaaaaacgguacagugauggaugucauaagccgucgagaccagcgcggguccggacaggugggcacuuacggccugaauaccuuuacgaacauggaggcccaacucauuagacagauggaaagugaggggaucuucucuccuagcgagcuggaaaccccaaacuuggcagagcggguguuagauuggcuggaaaaguauggagucgagaggcucaagcgcauggcgaucuccggugacgacuguguugugaaacccauugaugacagauuugccacagcucuuacugcccugaaugauaugggcaagguacggaaagacauaccgcagugggaaccuucaaagggguggaacgauuggcagcaagugcccuucugcagucaucacuuucaccagcuaaucaugaaagacggaagggagauugucgugccaugucgaaaucaggaugagcugguuggccgugcaagagugucucagggugcuggguggagccuccgcgaaaccgccugcuugggaaaguccuacgcacaaauguggcagcugauguauuuccaucggagggaccuuagacuggccgcgaacgcuaucuguucagccgucccuguggauuggauucccacaagccgcacuaccuggucuauccacgcacaucaccaguggaugacgacagaggacaugcucuccguauggaaucggguuuggauagaagagaacccauggauggaagauaagacccauaucaguagcuggggcgacgugcccuacuuaggcaaaagggaggaccaauggugcgggucgcugauuggauugacugcccgagcuacaugggccaccaauauccaggucgcaauuaaccaggugagacggcugaucgguaaugagaacuaccucgauuauaugacuuccaugaagagguuuaaaaaugaaucugacccugagggcgcucuuugguga

SEQ ID NO: 13980 - RNA, 9879 nt, Artificial Sequence
  derived and/or modified CDS sequence (opt3) from DENV-1__JF937619__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgagcugugugaagauacuaugaccuacaaaugcccacggauaacagaggcggaaccggacgauguggacuguuggugcaaugcuaccgauacuuggguaacauaugggaccuguagucaaacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggaagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguacggcguguuguuuucugguguaagcuggaccaugaagauugggauaggcgugcuccugacuugguuaggacugaauucacgaaguacaucccuaagcaugaccuguaucgcuguuggccucgucacacuguaccuuggggugauggugcaggccgacucuggaugcgucauuaacuggaaaggccgcgaguugaagugugguucagggaucuucguuacuaaugaagugcacaccuggacggagcaauauaaguuucaggcagauaguccgaaaagacugagcgccgcuaucggaaaggccugggaggaaggcgugugcgguauuagguccgcaacacggcucgagaacauaauguggaaacagaucucuaacgaacugaaucauauuuuacuggagaacgacaugaaguucaccguagucgugggcgacguugcugggauccuugugcagggaaaaaagaugauucgcccucaacccauggaauacaaauauucguggaagagcuggggcaaggccaaaaucauaggggcggauguccagaauuccacuuuuaucauugacggaccaaacaccccugagugucccgaugaccagagagccuggaauaucugggagguggaagauuacggcuucgguauuuuuacaacuaacaucugguugaagcucagggacucauauacccagguuugcgaucaccgucugaugagugcugcaauaaaagacucuaaggccgugcacgcugauaugggguacuggauugagagcgaaaaaaaugagacauggaagcuagcccgggcauccuucaucgaaguaaagacguguauuuggccaaaaucacauacccuguggagcaacggaguccucgagucugagaugaucauacccaagauccacggcgguccuauuucccaacauaauuaucgaccaggcuacuucacucagacagcggggccguggcaccugggaaaacuugaauuggacuuugaucugugcgagggcaccacugugguggucgacgaacacugcgggaacagaggacccaguuuaaggacaaccacgguuacuggcaagaucauucaugagugguguugccgcagcuguacccucccuccacugcgguucagaggugaggaugggugcugguacggaauggaaaucaggcccgugaaagagaaggaagagaaucuuguaaagucuaugguguccgccggcucaggugaagucgacaguuuuagccugggcuugcucuguauaucgauuaugaucgaggaggugaugcgcucccgauggucucggaaaaugcugaugacagggacccuagcuguuuucuuucugcucaucaugggacagcugacuuggaacgaccuuauucguuugugcaucauggugggcgccaaugcaagcgauagaauggggaugggaacaaccuaucuggcuuuaauggucacauucaagaugaggccuauguuugccgugggccuccuguuccgccggcuuacuucaagagaaguucugcuacucaccauuggucugaguuugguggcauccgucgagcugccaaacucuuuagaagagcucggggacggacuggccaugggcauaaugauccuuaaacuguugacggauuuucaaagcuaccagcucugggcuacacugcuaucccugaccuucauuaagacuaccuuuucacuucacuaugcguggaaaacaauggccaugguacucagcaucgugagucuguuccccuugugucugucuacuaccucccagaagacgacaugguuaccgguucuccugggcagccuugggugcaagccucugaccauguuuuugauugcagaaaauaaaaucuggggaaggaagucguggccacucaacgaggguauaauggcugugggcaucgucucaauucugcuaucuagucugcuuaaaaacgacgugccccucgccgggccucugaucgccggaggcauguugauugcuuguuacguaaucuccgguagcucugcagauuuaagccuggagaaggccgcggaaguguccugggaggaagaggcugaacauucaggggccagucacaauauacucgucgagguucaggacgauggaacuaugaaaauuaaggacgaggaacgagaugacacacugaccauccuucugaaagcaacuuugcuagccgugagcggcguguauccccugucuaucccagcuacacucuucgucuggcauuucuggcaaaagaagaaacagcgcuccggcgugcugugggauaccccuucacccccagagguugaacgggcaguacuugacgaugggauuuacagaauaaugcagaggggauuacugggucguagucaggugggcgucgggguguuucaagagaacguuuuccacacgauguggcacgugacucgcggagccguccucauguaucagggcaagcgguuggagccgagcugggcguccgugaaaaaggaccugaucucuuacggugggggauggagauuucagggcucguggaauaccggcgaagagguacaggucauugcuguggaaccugggaaaaaccccaagaauguucaaacagccccaggaaccuucaagacacccgagggugaagugggcgcaaucgcccucgacuuuaaaccugggacuagcggaucaccaauugucaacagggagggcaagaucgugggucuguacgggaauggaguugugaccacguccggcacauaugucagugcuauagcccaggcaaaagcuucucaggagggcccccuuccugaaaucgaggaugaaguguuccgaaagcggaaccugacuauuauggacuugcauccggggagcggaaaaacccgcagauaccuaccagccaucguaagggaggcgauuaagcggaagcugcgaacacucaucuuagcccccaccagagugguugcauccgaaauggcugaggcccugaaagguaugccuauacgcuaucaaacuaccgcugucaagucagagcacacaggcaaagaaauuguggaucuuaugugccaugcaacguuuacuaugaggcugcucucuccagugcguguccccaauuacaacaugaucaucauggacgaggcccacuucaccgauccuagcaguauugccgcucggggguauaucuccacaagaguaggaaugggcgaagcggcagccauauuuaugaccgcuacuccgcccgguagcauggaggccuucccacagucuaaugcagugauucaggacgaagagagggauaucccugagcgcucauggaacuccggguacgaauggauuacagacuuucccggaaagaccguuugguucgugccaaguaucaaagccggcaaugauauagcuaacuguuugcgaaagaauggcaagagagucauucagcugagccggaaaacguucgacacugaguaucaaaagaaaaagaacaacgauugggacuacgugguuacaaccgacaucucggaaaugggggcgaauuuuagggccgaucgcgugaucgacccucguagaugccucaaacccgucauucugaaggauggaccagagcgggugauccuugcagguccgaugccuguaaccguggcuucugccgcacagaggcgcggccgaauugggagaaaccauaauaaggagggagaccaguacauauauaugggccagccccuaaacaaugaugaagaccacgcccacuggacugaggcuaaaaugcuguuggauaacaucaauacaccagaagguauuauccccgccuuauucgagccugaacgggagaaguccgcggcaaucgacggggaguacaggcugcgcggcgaagccagaaaaaccuuuguugagcucaugaggcggggagaucugccagucuggcuuagcuauaagguggcuucagaaggcuuccaauacagugaccgucgcuggugcuuugauggggagcgaaacaaucaggugcuggaagagaacauggacgucgagauuuggacaaaagaaggagagagaaagaaacucaggccccggugguuggaugcccgcacuuauucugacccucuggcucuaagagaauucaaggaguuugcagccgguaggcgguccguuagcggcgaccugauacucgaaaucgggaagcuuccgcagcaucugacgcagcgagcucaaaaugccuuagauaacuuggugaugcugcacaauucagagcagggaggcagagcauaccgccaugcgauggaggaacucccagacaccauugagacacugaugcuucuggcccucaucgcuguauugacugguggggugacccuguucuuuuuaaguggcaaaggacuaggcaagacaagcauugggcugcucugugucauggccuccucugugcuucuguggauggcaagcguugaaccccacuggaucgcugccuccauaaucuuggaguucuuucugauggugcuccugauuccugagcccgauaggcagcggaccccacaggacaaccaacuugcauaugucguaaucggacuccuguucaugauuuugacuguggccgcuaaugaaaugggucuguuagagacgaccaaaaaggaucuaggcaucgggcacguugcgguggaaaaccaucaccaugccgcaaugcuggacgucgaucuccacccugcuucagccuggacacuuuacgccguggcaacuaccauaauuacacccaugaugcgucauaccaucgagaacacuacagcuaauauuucucugacggccaucgcgaaccaggcugccauauugaugggacuggacaaaggcuggccaaucaguaagauggauauuggugucccucuccuggcacuugggugcuacucgcaggugaauccguuaacccugacugccgcuguucucauguugguggcacacuaugccaucauuggccccggacugcaagcgaaggcuacaagagaagcccagaaaaggaccgcagccggcaucaugaagaacccaaccauagacgggauuguagcuaucgaucuagacccugugaucuacgaugccaaauuugagaagcagcugggacagauuaugcuccuuauccuguguacaagccaaauauugcugaugcgcacuacgugggcacucugcgaguccauuacccuggcuacaggccccuuaacuacccuuugggaagguucuccagggaaauucuggaauacaaccaucgccgucucaauggcgaacauuuuccggggaagcuaucuggccggcgcaggucucgcuuuuucccuaaugaagagucugggcgggggacgaagaggcacuggggcccagggagagacguugggcgaaaaguggaaaaggcagcugaaucagcucucuaagagcgaguucaacacauacaaacgcucagguaucauggaaguugaccgguccgaggcaaaggaggggcuuaaaagaggagaaaccacuaagcacgcugugagucguggcaccgccaagcugaggugguuugucgagcggaauuuggugaaaccugaagguaagguaauagaccugggcugugggcgcggaggcuggagcuauuacugcgccgggcucaaaaaggugacagagguuaaaggauauacuaagggcggucccgggcaugaagagccgaucccaauggcgaccuacggauggaacuuagugaaacugcacucuggcaaggaugucuucuuuauuccucccgagaagugugacacacuucugugcgauaucggcgaauccucaccaaaucccacgauugaggaagggcgaacccuaagagugcucaaaauggucgagccuuggcugaggggaaaccaauucuguaucaagauuuugaauccguacaugcccagcgugguugagacucuggaacagaugcagcggaaacaugguggcaugcucguacgcaacccacuuucgagaaauucuacacacgagauguauugggugaguugcgggaccggaaacaucgucuccgcugugaauaugacuagcaggaugcuguuaaaccgauuuacaauggcacaccggaagccuaccuacgaacgugacguugaucugggcgccgguacgagacauguggcugucgagcccgaaguggccaacuuggacauaauugggcagcgcaucgagaauaucaaacacgagcauaagucaaccuggcacuaugaugaagacaacccuuacaagacaugggcauaucauggauccuacgagguaaaaccaucuggcagcgccaguuccauggugaauggcguugucaagcuccugacuaaacccugggaugugauuccuauggugacccaaauagcuaugacagacacuaccccauucgggcagcagagggucuuuaaggaaaaaguugauacacggacccccaaggcgaagagaggaacugcccaaaucauggaggugacggcacgcuggcuaugggguuuccuuagcaggaacaaaaagccgcgaauuuguacacgggaagaguuuaccagaaaaguaaggucuaaugcugccaucggcgcaguguucgucgacgagaaccaguggaauucagccaaggaagcuguggaggacgaucgcuuuugggaccugguucaccgugaacgggagcuccacaaacaggggaagugcgccacuugcguguauaacaugaugggaaagagagaaaaaaagcugggcgaguucgguaaagcgaaggggaguagggcaauuugguacaugugguugggagcccgcuuccuggaguuugaagcucucggcuucaugaaugaggaucauugguuuucccgagaaaacagccuuucuggcgucgagggggagggacugcacaaauuagguuacauccugcgggacauaucgaagaucccuggcgggaauauguaugccgaugacaccgcaggaugggauacaagaauuacggaagacgauuugcagaacgaggcuaaaaucaccgacauuauggaaccagagcaugcccuccuggcuaagucaaucuucaagcuaacuuaccaaaauaaagugguaaggguucagcgccccgccaagaacggcacagugauggaugucauaagcagacgggaccagagggguuccgggcaggugggaaccuauggccuuaauacuuuuacaaacauggaagcacaacugauucgucagauggagagugagggcaucuuccucccuaacgaacuggagaccccaaauuuggcggggcgaguguuagauuggcuggaaaaauacggagucgagcgccucaagagaauggccaucucuggugacgacuguguugugaaacccauugaugaccgguuugcuacagcccuuacugcacugaacgauaugggcaagguaaggaaggacauaccgcagugggaaccuagcaaaggguggaaugauuggcagcaagugcccuucugcucccaccacuuucaucagcuaaucaugaaggacggacgcgagauugucgugccauguagaaaccaggaugagcugguuggccgggcuagggugucacagggugccggguggagucuccgagaaaccgcaugcuugggaaaaucuuaugcccaaauguggcagcugauguacuuccaccguagagaccuucgccuggcggcuaaugccaucuguagcgcagucccuguggauuggguacccacgucccggaccacauggucaauucaugcccaccaucaguggaugacuaccgaggacaugcucagcguuuggaacaggguguggaucgaagagaauccauggauggaagauaagacaagaauaucuuccugggaggacguccccuauuuaggcaaacgcgaggaccaauggugcggcagucugaucggguugacugcucgggccaccugggcaacgaacauucagguggcuaucaaucagguuaggcgacugauuggaaacgaaaauuacagcgauuacaugacaucgaugaagagauuuaagaacgaguccgaaccugagggugcccucugguga

SEQ ID NO: 13981 - RNA, 9879 nt, Artificial Sequence
  derived and/or modified CDS sequence (opt3) from DENV-1__GU131827__SS-prME
uccgugaccaugcugcucaugcuuaugcccaccgcacuggcuuuccacuugacuacgcggggcggggaaccucauaugaucgucuccaagcaggaaaggggaaagucuuuacuguuuaagaccucagccgguguuaacaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaggacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaggccccuacaaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucagaaagggcucaaguaucggaaaaauguuugaggccaccgcaaggggcgcccggcgaauggcuauucugggggauacagccugggacuucggaagcaucgguggcguuuuuacguccguggggaaacuuguccaucagauuuucggaaccgcauacggcgugcuguuuucugguguaagcuggacuaugaaaauagggaucggcguguugcucacauggcugggauuaaauucacgcaguaccucccugagcaugacauguauugcgguuggccuagucacucucuaccugggggugauggugcaggcugauucuggaugcgccaucaacuggaagggcagagaacuuaaaugugguucagggaucuucgucaccaaugagguucacacguggacagaacaauauaaguuucaggcagacaguccgaagagguugagcgccgcuauuggaaaagccugggaggagggcgugugcgguauacgguccgcaacccgccuggaaaacaucauguggaagcagauuucuaacgagcucaaucauauccuguuagaaaacgacaugaaauucacugugguagucggcgauguggcugggauucuggcccagggaaagaaaaugaucagaccucaacccauggaguacaaguauucguggaaaagcuggggcaaggcgaagauaaucggggccgacguucagaauaccacauuuauuaucgauggaccaaacacuccugaaugucccgacgaucagagggcuuggaauauuugggagguggaggacuacggcuucgguaucuuuaccacaaacauauggcuuaaauugcgugauuccuauacgcaggucugcgaccaccggcucaugucagcagccauuaaggauaguaaagcugugcacgccgacaugggguacuggaucgaaucugagaagaaugaaaccuggaaacuggcacgagcgagcuucauugagguuaagacuuguaucuggccaaagucccauacacuauggucaaacggagugcuggaaagcgagaugauaauccccaaaauuuauggcgguccuaucucucaacacaauuacagaccaggcuacuucacccagacugccgggccguggcaucucggaaagcuggagcuugauuuugacuugugcgaaggcacaaccguagucguggaugagcacugcgggaacaggggacccucccugcgcacgacuaccgugacaggcaaaauuauccacgaaugguguugccggaguuguaccuuaccuccacucagauucaggggugaggacgggugcugguauggaauggagauacgccccgucaaggaaaaagaggaaaaucugguuaagagcauggugucugcuggcuccggugagguagacucauuuagucuuggccuguuguguauuagcaucaugaucgaagaggugaugcgaucgcgguggucccguaagaugcucaugacugggacacuggccgucuucuuucuacugauuaugggacagcucaccuggaacgaucugaucagacuuugcauuauggugggcgcaaaugcuucugacaggauggggaugggaacaacuuacuuggcccugauggcaaccuucaaaaugcgcccuauguuugccguuggcuuacucuuccggagacugacgagcagggaggugcuucugcuaacaauaggucucucacuggucgcuaguguggaauugccaaacucccuggaggaauuaggggauggacucgcgaugggcaucaugauucugaaacuucugaccgacuuucaaucucaucaguugugggccacucuccugagccuaaccuucaucaaaacaacuuuuucccugcacuaugcauggaagaccauggcuaugguucuuucaauugugagccucuucccccuguguuugaguacgacaucucagaaaaccacuuggcugccggucuuacucggcucccuggggugcaagccucuuacaauguuucugaucgccgagaauaagauauggggacgacgcagcuggccauugaacgaagguaucauggccguaggcauugugucgauccuccugucaucucuacugaaaaacgauguuccccuugcugggccucucauugcaggaggcaugcugaucgccuguuacgugauaagugguuccagcgcggacuugucuuuagagaaggcugccgaggucagcugggaagaggaagcagagcauuccggggccucacacaauauucugguggaaguacaggaugacggaaccaugaaaaucaaggaugaggagcgggacgauacucucacaauccugcuuaaagcuacccuguuggcagugaguggcgucuauccccuaagcauuccagccacgcuguucguuugguacuucuggcaaaagaaaaagcagagaucuggcgugcucugggacacuccuucacccccagaaguggagagggcgguccuggaugacgggauauaucguaucaugcagcgcggacuuuuaggucggagccaggugggcguugggguauuucaagaaaacguguuccauaccauguggcacgucacaagaggagcugugcugauguaccagggcaagaggcucgagccgaguugggccagcguuaaaaaggacuugauuuccuacggugggggauggcgacugcagggcucuuggaauaccggcgaggaagugcaggucaucgcaguggagccugggaaaaaccccaagaauguacaaacagccccaggaacuuuuaaaacccccgaaggugaggucggcgcuauugcccucgauuucaagccugggacgucgggaagcccaaucgugaaccgggaaggcaagauaguuggucuguaugggaauggaguggucacaacuucaggcaccuacguguccgcaaucgcucaggccaaagcgagucaggagggcccccuuccugagauugaagacgagguuuuucgcaagagaaaccugacaaucauggauuugcacccggggucuggaaaaaccaggcgguaucuaccagccauugugcgagaagcaaucaagagaaaacugcgcacucucauauuagcucccaccagggucguggccagcgagauggcugaagcacugaaggguaugccuauucguuaccaaacaacggccguaaaguccgagcauacuggcaaagagaucguggaccuuaugugccacgccaccuucacaaugcggcugcucucaccaguuagaguccccaauuauaacaugaucauuauggaugaagcucauuuuaccgacccuucuagcaucgcggcaaggggguacauaaguacucgcgugggaaugggcgaggccgcugccauuuucaugacagcaaccccgcccgguuccguggaagccuuuccacagagcaaugcugucauccaggaugaggaacgagacauuccugagagaucuuggaacucaggguaugaguggaucacggauuuccccggaaagacuguaugguuugugccauccauaaaaaguggcaaugacauugcgaacuguuugcggaagaauggcaaaaggguuauccagcugagccgcaagacauucgauaccgaauaccaaaagaccaaaaacaacgacugggacuacguggucacuacagauaucucggagaugggggccaauuuccgugcagacagagugauugauccucggaggugccucaagcccguuauccugaaagacggaccagaacgcgugauucuugcugguccgaugccugucaccguggccucugcagcccagcgaagaggccggauagggaggaaccacaauaaggagggagaucaguauaucuacaugggccagccccuaaacaaugacgaggaucaugcucacuggacagaagccaaaaugcuguuggacaacauuaauacuccagaggguaucguacccgcguuauuugaaccugagcgcgaaaaguccgcagccaucgauggggaguauagacugaggggcgaggcucggaagacguucguggaacucaugcgucgcggagaccugccaguuuggcuuagcuacaaagucgccucagagggcuuucaauauagugaucgaagauggugcuucgacggggaaaggaacaaucaggugcuggaggaaaacauggauguggagauuuggaccaaggagggagaacggaaaaagcuccgccccagaugguuggacgcuaggacauacucugacccucuggcacuacgggaguuuaaagaguucgccgcuggucgaagauccgucagcggcgaucugauacucgagaucgggaaacuuccgcagcaccugacucagcgcgcccaaaaugcauuagacaacuugguuaugcugcauaauucagaacagggaggcagggcguaucggcacgccauggaggagcucccagauaccauugaaacacugaugcuucuggcucucaucgccguguugaccggugggguaacucuguuuuucuuaaguggccguggacuaggcaaaacgagcauugggcugcucugugugauggcauccucuguccuucuguggauggcuagcguggagccccauuggaucgccgcauccauaaucuuggaauuuuuccugaugguucuccugauuccugagcccgacagacagaggaccccacaggauaaccaacuugccuacguggucaucggacuccuguuuaugauuuugacaguagcugcgaaugagaugggucuguuagaaacuaccaagaaggaccuaggcaucgggcacguggccguugagaaccaccaucacgcagcuaugcuggauguggaccuccauccugccucagccuggacacuuuacgcagucgcuaccacuauaauuacacccaugaugcgccacacgaucgaaaacaccacugccaauauuucucugacagcgaucgcuaaccaggccgcaauauugaugggacuggauaaaggcuggccaaucaguaagauggacauuggugugccucuccuggcccuugggugcuauucgcaggucaauccguuaacccugaccgcugcagugcucauguugguugcccauuacgcgaucauuggccccggacugcaagcuaaagccacacgggaggcacagaagcgaacugccgcuggcaucaugaaaaacccaacgguggaugggauaguagccauugaccuagauccuguggucuaugacgcaaaguucgaaaagcagcugggacagaucaugcuccuuauccuguguaccagccaaauuuugcugaugagaacaacuugggcucucugcgaguccaucacccuggccacaggccccuuaaccacucuuugggaggguucuccagggaaauuuuggaauacgacaauagcgguuucaauggccaacauuuucaggggaagcuaccuggcaggcgcuggucucgccuucucccuaaugaagagucugggcgggggacgccggggcaccggggcacagggagaaacuuugggcgagaaauggaagagacagcugaaucagcucucuaaaagcgaauuuaacaccuauaagcguucagguaucauggagguggacagguccgaagcuaaggaggggcuuaaacggggagagacaacuaagcacgccgucagucgcggcaccgccaaacugcgaugguucguggaaagaaauuugguaaagccugaggguaaagugauugaucugggcugugggaggggaggcuggagcuacuauugcgcggggcucaagaagguuacagaagugaaaggauacacgaagggcggucccgggcacgaggaaccgaucccaauggcuaccuacggauggaacuuagucaaacugcauucuggcaaggacguguuuuucauaccucccgagaaaugugauacucuucugugcgacaucggcgaguccucaccaaaucccacaauugaagaggggcggacccuacgcguccucaagaugguggaaccuuggcugagaggaaaccaauuuuguaucaaaauuuugaauccguauaugcccagcguuguagagacucuggagcagaugcagaggaagcacgguggcaugcucgugcgaaacccacuuucgagaaauucuacacaugaaauguacugggucaguugcgggaccggaaacaucguguccgcaguuaauaugacgagccguaugcuguuaaacagauucaccauggcccaccgcaagccuacauaugagagggauguggaccugggcgcugguacucggcacgucgccguggaacccgagguagcaaacuuggauauuaucgggcagagaauagaaaauauuaaacaugagcacaagucaaccuggcauuacgacgaggauaacccuuauaaaacaugggccuaccacggauccuaugaagugaagccaucuggcagcgcuaguuccaugguuaauggcgucgugaaacuccugacuaagcccugggacgugaucccuauggucacccaaaucgcgaugacagauaccacuccauuugggcagcagcgcguuuucaaggagaaaguggacacgaggacacccaaggccaaacgaggaaccgcacaaauuauggaaguaacugcuaaguggcuaugggguuuucuuagccggaacaaaaagccgagaauauguaccagggaggaguucacacgcaaggugcguucuaaugccgcaaucggcgccgucuuuguggacgagaaccaguggaacucagcuaaagaggccguugaagaugagcgguucugggaccuggugcauagagaaagggagcuccacaagcaggggaaaugcgcgacgugcgucuacaacaugaugggaaagcgcgagaagaagcugggcgaguuugguaaggcaaaagggagucgagccauuugguacaugugguugggagcucgguuccuggaguucgaagcccucggcuuuaugaaugaggaucacugguucuccagagaaaacagccuuucuggcguggagggggagggacugcauaaguuagguuauauccugagggacauuucgaaaaucccuggcgggaauauguacgcagaugacaccgcuggaugggauacucgcauaacagaagacgauuugcagaacgaggccagaaucaccgacauuauggaaccagagcacgcucuccuggccaagucaaucuuuaaacuaacuuaucaaaauaagguaguucgggugcagaggcccgccaagaauggcacagucauggaugugauuagccgucgagaccagcgcgguuccggacaggugggaaccuacggccuuaauacauucacuaacauggaagcgcaacugaucagacagauggagagugagggcauauuuucuccuagcgaacucgagaccccaaaccuggccgaacgggucuuggauugguuagagaaguaugggguugaaaggcugaagcgcauggcuauuuccggagacgacugugugguaaaacccaucgaugacagauucgccacggcacucaccgcucuuaaugauauggguaaggugcggaaagacaucccgcagugggagccuucaaagggcuggaacgauuggcagcaaguccccuuuugcagucaucacuuccaccagcugauuaugaaagacgggagggagauagugguuccaugucgaaaucaggaugagcuagugggacgugccagagucucucagggcgcagguuggagccugcgcgagacagccugccucgggaaguccuacgcgcaaauguggcaguugauguauuuucaucggagggaccugagacuugcugccaacgcaaucuguucagccgugccuguagauuggauucccacuagccgcaccacauggucuauccacgcucaucaccaguggaugacuaccgaagacaugcuguccguuuggaaucggguguggauugaggaaaacccauggauggaggauaagacgcauaucaguagcuggggagacguccccuaccucggcaaaagggaggaccaauggugcggcucguuaauagggcugacagcccgagcaaccugggcuacuaauauccagguggccauuaaccagguuagacgguugaucggaaaugaaaacuaccuggauuauaugacauccaugaagagguucaaaaaugagucugacccugaaggugcgcucugguga

SEQ ID NO: 13982 - RNA, 9879 nt, Artificial Sequence
  derived and/or modified CDS sequence (opt3) from DENV-1__GU131831__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauauccuaugugauguguaccgguagcuucaaacuggagaaggaacuugccgagacgcagcacggaacagucuuggugcagaucaaguacgagggcaccgacgcuccuugcaaaauuccauucucgacucaagaugaaaaggggguuacacagaacggacgccugaucaccgcgaaucccauagugacugacaaagagaagccuguaaacauugaagcagagccacccuuuggcgagucuuauaucgucaucggugccggggaaaaagcucucaagcuguccugguucaagaaaggcucaaguauuggaaagauguuugaggccaccgcaagaggcgccaggcggauggcuauccuuggggauacagccugggacuucggaagcauugguggcguguuuacguccguugggaaacuggugcaucagauauucggaaccgcauacggcgucuuguuuucuggugugagcuggacuaugaagaucgggauuggcguacuccugacaugguuaggacuaaauucacgaaguaccucccuaagcaugacauguaucgcggugggccucguuacucuguaccuuggggucauggugcaggcugauucuggaugcgugaucaacuggaaaggccgcgaauugaagugugguucagggauuuucgucaccaaugagguucacacguggacagaacaauauaaguuucaggccgacaguccgaaaagacugagcgcagccauaggaaaggcuugggaggagggcgugugcgguaucagguccgccacccggcucgaaaacauuauguggaaacagaucucuaacgagcugaaucauauuuuacuggaaaacgacaugaaguucacugugguagucggcgauguggcagggauccuugcucagggcaagaagaugauacgcccucaacccauggaguacaaauauucguggaaaagcuggggcaaggccaagaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauuccuauacgcaggucugcgaccaccgucugaugucagcugcaaucaaagauaguaaggccgugcacgcugacaugggguacuggauugaaucugagaaaaaugaaaccuggaagcuagcccgggcauccuucaucgagguuaagacuuguauauggccaaaaucccauacacuguggucaaacggagugcucgaaagcgagaugaucauucccaagaucuauggcgguccuauuucucaacacaauuaccgaccaggcuacuucacccagacugcggggccguggcaucugggaaaacuugaguuggauuuugaccugugcgaaggcacaaccguagucguggaugagcacugcgggaacagaggacccuccuuaaggacgacuaccgugacaggcaagaucauacacgaaugguguugccgcaguuguacccucccuccacugcgguucagaggugaggacgggugcugguauggaauggagauuaggcccgucaaagaaaaggaggaaaaucuuguuaagagcauggugucugccggcuccggugagguagacucauuuagucugggcuugcucuguaucagcaucaugauugaagaggugaugcgcucgcgauggucccggaaaaugcugaugacugggacacuagcugucuucuuucugcucaucaugggacagcugaccuggaacgaucuuauucguuugugcauaauggugggcgccaaugcaucugacagaauggggaugggaacaacuuaccuggcuuuaauggccaccuucaagaugaggccuauguuugcaguuggccuccuguuccgccggcuuacgagcagagaggugcugcuacucacaaucggucugucauuggucgccaguguggaacugccaaacuccuuagaggaacucggggauggacuggcuaugggcauuaugauccuuaaacuguugaccgacuuucaaucucaucagcucugggcgacucugcuaagccugaccuucauuaagacaacuuuuucccuucacuaugccuggaaaaccauggcaaugauccucucaauaguuagccuguuccccuugugucugaguacgacaucucagaagaccacuugguuaccggugcuccugggcucccuugggugcaagccucugacaauguuuuugaucgcugagaauaaaauuuggggaaggcgaagcuggccacucaacgaagguaucauggccgucggcauuguaucgauccugcuaucaucucugcuuaagaacgaugugccccucgccgggccucugauagcuggaggcauguugauugcauguuacguuaucagugguuccagcgccgacuuaucucuggagaaagcggcugaggugagcugggaagaggaagccgagcauuccggggcaucacacaauauccucgucgaagugcaggaugacggaaccaugaagauuaaagaugaggagcgcgacgauacucugacaauacuucugaaggccaccuugcuagcuguaaguggcguguauccccugagcaucccagcaacacucuucgucugguacuucuggcagaagaagaagcagcggucuggcguucugugggacacuccuucacccccagaaguggagagagccgugcuugaugacgggauuuauaggaucaugcagcguggauuacugggucgcagccaggucggcguggggguuuuucaagaaaacguauuccauaccauguggcacgugacacggggagcgguccucauguaccagggcaaaagauuggagccgaguugggcuagcgugaagaaagaccugauuuccuacggugggggauggaggcuccagggcucuuggaauaccggcgaggaaguucaggugaucgccgucgagccugggaagaaccccaaaaaugugcaaacagcaccaggaacuuuuaagacccccgaaggugagguaggcgccauagcucuggauuucaagccugggacgucgggaagcccaaucgucaaccgagaaggcaaaauugugggucuuuaugggaauggaguugugacaacuucaggcaccuacgucuccgccaucgcacaggcuaaggccagucaggagggcccccugccugagauugaagacgagguguuucggaaacgcaacuugacaaucauggaucuacacccggggucuggaaagaccagaagguaucugccagcgauaguucgggaagccauuaaacgaaagcucagaacuuuaauccuggcacccacccgcguggucgcuagcgagauggccgaagcucuuaaggguaugccuaucagguaccaaacaacggcagugaaauccgagcauacuggcaaggagauuguagaccugaugugccacgccaccuucacaaugcgucucuugucaccagugcggguucccaauuauaacaugaucauaauggaugaagcccauuuuaccgacccuucuagcauugcugcgagaggguacaucaguacuagggucggaaugggcgaggcagccgcuauuuucaugacagccaccccgcccgguuccguggaagcauuuccacagagcaaugccgugauccaggaugaggaacgcgacauaccugagcgaucuuggaacucaggguaugaguggauuacggauuuccccggaaaaacugucugguuuguaccauccaucaagaguggcaaugacaucgcuaacugucugaggaaaaauggcaagcgggugauucagcucagcaggaagacauucgauaccgaauaccagaaaaccaagaacaacgacugggacuacguugugacuacagauaucucggagaugggggcgaauuuccgcgccgaccgugucauugauccuagacggugccugaaacccgugauacuuaaggacggaccagaaaggguuauccuagcagguccgaugccugugaccgucgcuucugccgcacagcgccgaggcagaauugggcggaaccacaauaaagagggagaucaguauaucuacaugggccagccccugaacaaugacgaggaucaugcccacuggacagaagcuaagauguuguuagacaacaucaauacuccagaggguauuauacccgcccuguuugaaccugagagggaaaaguccgcggcaaucgauggggaguaucgccucagaggcgaggccaggaaaacguucguggaacugaugcggcguggagaccuuccaguauggcugagcuacaagguggcuucagagggcuuucaauauagugaucgccgauggugcuucgacggggaaagaaacaaucagguucucgaggaaaacauggaugucgagauuuggaccaaagagggagaaaggaagaaauugcggccccgcuggcuggacgccagaacauacucugacccucuagcucugagggaguuuaaggaguucgcagccggucggcgauccgugagcggcgaucucauccuugagauugggaaacugccgcagcacuuaacucagagagcucaaaaugccuuggacaaccuggugaugcuccauaauucagaacagggaggccgcgcauauaggcacgcgauggaggagcugccagauaccaucgaaacacuuaugcugcucgccuugauagcuguccugaccggugggguuacuuuauuuuuccuaaguggccggggacugggcaagacgagcaucgggcuccuuugugugauggccuccucuguacuguuguggauggcaagcguggagccccauuggauugcugccuccaucauucuggaauuuuuccucaugguccugcuuaucccugagcccgaccgucagagaaccccacaggauaaccaacucgcauacgugguuauaggacuguuguuuaugauucugacaguggccgcuaaugagauggguuuacuagaaacuaccaagaaagaccugggcaucgggcacgucgcgguagagaaccaccaucacgccgcaaugcucgauguggaccuucauccugcuucagccuggacacuguacgccguugcaaccacuauuaucacacccaugaugaggcacacgauagaaaacaccacugcuaauaucucuuugacagccauugcgaaccaggcugccauccugaugggacucgauaagggcuggccaauuaguaaaauggacaucggugugccucugcuugcauuagggugcuauucgcaggucaauccgcugacccucaccgccgcuguguugaugcuggucgcacauuacgccauaauuggccccggacuacaagcgaaggcuacacgcgaggcccagaaacggacugcagccggcaucaugaagaacccaacgguggaugggaucguugcuauugaccuggauccugugguauaugacgccaaguucgaaaaacagcucggacagaucaugcuucugauauuguguaccagccaaauucugcucaugcgaacaacuugggcacugugcgaguccaucaccuuagcuacaggcccccuuaccacucugugggaggguucuccagggaaguuuuggaauacgacaauugccgugucaauggcgaacaucuucagaggaagcuaccucgccggcgcaggucuagcuuucucccugaugaaaaguuugggcgggggaaggcgcggcaccggggcccagggagaaacucugggcgagaaguggaaacggcagcucaaucagcuuucuaagagcgaauuuaacaccuauaagagaucagguauaauggaggucgaccguuccgaagcaaaagaggggcugaagaggggagagacaacuaaacacgcuguuagucggggcaccgccaaguugcgcugguucguggaacgaaaucuggucaaaccugaggguaaggugaucgaucucggcugugggagaggaggcuggagcuacuauugcgccggguuaaagaaaguaacagaagugaagggauacacgaaaggcggucccgggcacgaggaaccgauuccaauggcgaccuacggauggaaccugguuaaacuucauucuggcaaagacguguuuuucaucccucccgagaagugugauacucugcuaugcgacauuggcgaguccucaccaaaucccacaaucgaagaggggaggacccuccggguccugaaaaugguggaaccuugguugcgcggaaaccaauuuuguauuaagauccugaauccguauaugcccagcgucguggagacucucgagcagaugcagagaaagcacgguggcaugcuuguuaggaacccacugucgcgaaauucuacacaugaaauguacuggguaaguugcgggaccggaaacauaguguccgcugucaauaugacgagccggauguuacugaaccguuucaccauggcacacagaaaaccuacauaugagcgcgauguggacuugggcgccgguacuaggcacguugcuguggaacccgaggucgccaaccucgauauuaucgggcagcggaucgaaaauauuaagcaugagcacaaaucaaccuggcauuacgacgaggauaacccuuauaagacaugggcauaccacggauccuaugaagugaaaccaucuggcagcgccaguuccaugguaaauggcgugguuaagcugcuaacuaagcccugggacgucauaccuauggugacccaaaucgcuaugacagauaccacuccauuugggcagcagagaguguucaaagagaaggucgacacgcgcacacccaaagcgaagaggggaaccgcccaaauuauggaaguuacugcaaaauggcuuugggguuuucugagccgaaacaagaagccgcggaucuguaccagagaggaguucacaaggaaagugcgcucuaaugcugccauuggcgcaguauuuguggacgagaaccaguggaacucagccaaggaggcugucgaagaugagcguuucugggaccucgugcaucgggaaagagagcugcacaaacaggggaagugcgccacgugcguuuacaacaugaugggaaaaagggaaaagaaguugggcgaguuugguaaagcgaaggggagucgcgcaaucugguacauguggcugggagcccgauuccucgaguucgaagcucuuggcuuuaugaaugaggaucacugguucucccgggaaaacagccugucuggcguggagggggagggauuacauaaacuggguuauauauugagagacaucucgaagauuccuggcgggaauauguacgccgaugacaccgcaggaugggauacuaggaucacagaagacgaucuccagaacgaggcucgcauuaccgacaucauggaaccagagcacgcccugcuagcuaaaucaauauuuaaacuuacuuaucaaaauaaagucgugagaguacagcggcccgccaagaacggcacaguuauggaugugauuagcaggcgugaccagcgagguuccgggcaggucggaaccuacggccugaauacauucacuaacauggaagcacaacucauccgccagauggagagugagggcaucuuuucuccuagcgaacuggagaccccaaacuuggcggaaagaguguuagauuggcuggagaaguaugggguggaacggcucaaaaggauggccauuuccggagacgacugugucguuaagcccauagaugaccgcuucgcuacggcccuuaccgcacugaaugauauggguaaagugagaaaggacaucccgcagugggagccuucaaaaggcuggaacgauuggcagcaaguacccuuuugcagucaucacuuccaccagcuaauuaugaaggacgggcgggagaucguggucccauguaggaaucaggaugaacuggugggacgagcucguguuucucagggcgccgguuggagccucagagagacagcaugcuuggggaaguccuacgcccaaauguggcagcugauguauuuucaucgccgggaccuuaggcuggcggcuaacgccauuuguucagcagugccugucgauuggauccccacuagcagaaccacauggucuauacacgcccaucaccaguggaugacuaccgaagacaugcucuccguguggaaucgcguauggaucgaggaaaacccauggauggaggauaaaacgcauauuaguagcuggggagacguucccuacuuaggcaagcgggaggaccaauggugcggcucgcugaucggguugacagcuagggccaccugggcaacuaauauucagguggcuaucaaccagguccgaagacugauuggaaaugaaaacuaccucgauuauaugacauccaugaaacgguucaagaaugagucugacccugaaggugcccuuugguga

SEQ ID NO: 13983 - RNA, 9879 nt, Artificial Sequence
  derived and/or modified CDS sequence (opt3) from DENV-1__EU482789__SS-prME
agcgugaccaugcugcucaugcuuaugcccaccgcacuggcuuuccacuugacuacgagaggaggggaaccucauaugaucgucaccaagcaggaaaggggaaaauccuuacuguuuaagacaucugccgguguuaauaugugcacuuuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuucucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaaauggaggggaagauuguacaguacgaaaaccugaaauauuccgugaucgucaccgugcacacuggagaccagcaucaaguugguaaugagucaacggaacacggcacaaccgccacuauuacaccccaggcgccuacaagugagauccaguuaaccgacuacggggcccugacucucgauuguagcccaaggacaggacuugacuucaacgaaauggugcuguugacgaugaaggagaaaucuuggcugguccauaagcagugguuucuggaucucccgcugcccuggaccuccggcgcaucaacuagccaagagacauggaaucggcaggaccuucuggugaccuucaaaacagcucacgccaagaagcaggaaguaguuguguuggguagucaagagggggcuaugcacacugcccucaccggcgcaacggaaauccagaccucuggaacaacuaccauuuuugccggccaucugaaaugccguuuaaagauggauaaacugacacuaaaggggauguccuaugucauguguacugggucguucaaacucgagaaggaaguggcugagacccagcacgguacgguccuggugcagauaaaguacgagggcacagacgcgccuugcaaaaucccauucucgacccaagaugaaaaggggguuacucagaacggacgccuuauuacagcaaaucccaucgugaccgacaaagagaagccuguaaacauagaagccgagccacccuuuggcgagucuuauauugucaucggugcuggggaaaaagccuugaagcuguccugguucaagaaaggcucaaguaucggaaagauguuugaggcaacugccagaggcgcuaggcggauggccauucucggggauaccgcaugggacuucggaagcaucgguggcguguuuacauccguugggaaacuggugcaucagauuuucggaacggcguacggcguccuauuuucuggugugagcuggaccaugaagauagggaucggcguacuguugacuuggcucggacuaaauucacgaaguacauccuuaagcaugaccuguauugcugugggccugguuacacuauaccucggggucauggugcaggccgauucuggaugcgugaucaacuggaaaggccgcgaacugaagugugguucagggaucuucgucacuaaugagguucacaccuggacggaacaauauaaguuucaggcagacaguccgaaaagacuuagcgccgcuauuggaaaggccugggaggagggcgugugcgguauaagguccgcaacacgguuggaaaacaucauguggaaacagauuucuaacgagcugaaucauauccuccuggaaaacgacaugaaguucaccgugguagucggcgaugugguugggauuuuagcucagggcaagaagaugauccgcccucaacccauggagcacaaauacucguggaaaagcuggggcaaggccaaaauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcugaaacuuagggauuccuacacacaggugugcgaccaccguuugaugucagcugcaauuaaagauaguaaggccguucaugcugacaugggguauuggaucgaaucugagaaaaaugaaacguggaagcucgcccgggcauccuucauugaggugaagaccuguaucuggccaaaaucccacacucuguggucaaacggaguacuagaaagcgagaugauaauccccaagauuuacggcgguccuaucucucaacauaauuaucgaccaggcuacuucacacagaccgcggggccguggcaccugggaaaacucgagcuggauuuugaccuuugcgaaggcacuacagucgugguggaugagcacugcgggaacagaggacccuccuugaggaccacgacugucaccggcaagauuauccaugaaugguguugccgcaguuguacacugccuccauuacgguucaaaggugaggacgggugcugguacggaauggagauaagacccguuaaggaaaaggaggaaaaucucgugaaaagcaugguaucugccggcuccggugagguggacucauuuagucugggccuucuguguauuagcaucaugaucgaagaggucaugaggucgcgcuggucccgaaagauguugaugaccgggacucucgcuguguuccugcuacugauuaugggacagcucacauggaacgaucugauccggcuuugcauuaugguuggcgccaaugcaucugaccguauggggaugggaaccacauauuuggcucugauggccacuuuuaaaaugagaccuauguucgcagugggcuuacucuuuaggcgccugaccagccgggagguccuucugcuaacgauaggucucucacugguggccaguguugaauugccaaacucccuggaggaauuaggggauggacucgcuaugggcaucaugauucugaaacuucugacagacuuccaaucucaccaguugugggcgacccuccugagccuaacuuuuaucaaaaccacacugucccuucauuacgccuggaagacuauggcaauggugcucucaauugucagccuguuccccuugugucugaguaccacgucucagaagacaaccugguuaccgguacuccugggcucccuugggugcaaaccucugacuauguuuuugaucgcugagaauaagauauggggaagaaaaagcuggccacucaacgaagguaucauggccgugggcguugugucgauucugcuaucaucucugcuuaagaacgaugucccccucgccgggccucugaucgcuggaggcauguugauugcauguuaugugaucagugguuccagcgccgacuuaucucuggagaaagcggcugagguaagcugggaagaggaagccgagcacuccggggcaucacauaauauacucguggaaguccaggaugacggaacaaugaagauuaaagaugaggagagggacgauacccugacuauccuucugaaggccacauugcuagcuguuaguggcguguacccccugagcaucccagcaacccucuucgugugguauuuuuggcaaaagaaaaagcagcgaucuggcguccugugggacacgccuucacccccagaaguggagcgcgccguucuugaugacgggauuuaccggauaaugcagagaggauuacuggguaggagccagguaggcgugggggucuuccaagaaaacguguuccacacuauguggcacguuacccguggagcggugcucauguaucagggcaaacgcuuggagccgaguugggcuagcgucaagaaagaccugaucuccuacggugggggauggcggcuccagggcucuuggaauacaggcgaggaagugcagguaauugccgucgagccugggaagaaccccaagaaugugcaaaccgcaccaggaacauuuaaaacucccgaaggugagguuggcgccaucgcucuggauuucaagccugggaccucgggaagcccaauugugaacagagaaggcaaaaucgucggucuuuacgggaauggagugguuacgacaucaggcacuuauguguccgccauagcacaggcuaaggccagucaggagggcccccugccugagaucgaagacgaggucuuuaggaaacgaaacuugaccauuauggaucuacauccggggucuggaaagacacggcgcuaccugccagcgaucgugagagaagccauuaagaggaaacuccggaccuuaauccuggcacccacucgaguaguggcuagcgagauggccgaagcucuuaaggguaugccuauaagauaucaaaccacagcaguuaaauccgagcacacgggcaaggagauugucgaccugaugugccaugccacuuucaccaugcgccucuugucaccagugagggugcccaauuacaacaugaucaucauggaugaagcccacuuuacagacccuucuagcauugcugcgcguggguauaucaguacccgggucggaaugggcgaggcagccgcuauauucaugacugccacaccgcccgguuccguagaagcauuuccacagagcaaugccgugauucaggaugaggaaagagacaucccugagaggucuuggaacucaggguacgaguggauuaccgauuuccccggaaaaacgguuugguuugugccauccaucaagaguggcaaugacauagcuaacugucugcgcaagaauggcaaacgagucauucagcucagcagaaagacuuucgauacagaauaucagaagaccaagaacaacgacugggacuacgugguuaccacugauaucucggagaugggggcgaauuuucgggccgacagggugaucgauccucgccguugccugaaacccgucauucuuaaggacggaccagaaagagugauccuagcagguccgaugccuguaacaguggcuucugccgcacagcggaggggccgcauugggcgaaaccauaauaaggagggagaucaguacauauauaugggccagccccugaacaaugacgaggaucacgcccacuggaccgaagcuaaaauguuguuagacaacaucaauacaccagaggguauuauccccgcccuguucgaaccugagagagaaaaguccgcggcaaucgauggggaguaccggcucaggggcgaggcccgcaaaacuuucguugaacugaugagaaggggagaccuuccagucuggcugagcuauaagguggcuucagagggcuuucaauacagugaucggcguuggugcuucgacggggaacgcaacaaucaggugcucgaggaaaacauggaugucgagauuuggacgaaagagggagaacgaaagaaauugagacccagguggcuggacgcccggaccuauucugacccucuagcucugcgcgaguuuaaggaguucgcagccgguagaagguccguuagcggcgaucucauacuugagaucgggaagcugccgcagcauuuaacacagcgggcucaaaaugccuuggacaaccuggugaugcuccacaauucagaacagggaggccgagcauacagacaugcgauggaggagcugccagauacuauugaaacccuuaugcugcucgccuugaucgcuguacugacagguggggugaccuuauuuuuccuaaguggccgcggacugggcaaaacuagcauugggcuccuuugugucauggccuccucugugcuguuguggauggcaagcguugagccccacuggaucgcugccuccauaauccuggaauuuuuccucauggugcugcuuauuccugagcccgacaggcagcggacgccacaggauaaccaacucgcauaugucguaaucggacuguuguuuaugauucugaccguggccgcuaaugagauggguuuacuagaaacaacuaagaaagaccugggcaucgggcacguugcgguggagaaccaucaccaugccaccaugcucgaugucgaccuucacccugcaucagcuuggacacuguacgccguggccaccacuauaauuacacccaugaugcgucauacgaucgaaaacaccacugcaaauauuucuuugacagcuaucgccaaccaggcggcuauacugaugggacucgauaagggcuggccaaucaguaaaauggacauuggugucccucugcuugccuuagggugcuacagccaggugaauccgcugacccucaccgcagccguuuugaugcugguggcucacuaugcaaucauuggccccggacuacaagccaaggcgacaagagaggcucagaagaggacugccgcaggcaucaugaaaaacccaacgguagaugggauaguggccauugaccuggauccugucguuuacgacgcuaaguucgaaaaacagcucggacagaucaugcuucugaucuuguguaccagccaaauucugcucaugcgcacaacuugggcccugugcgaguccaucaccuuagcaacaggcccccuuaccacucugugggaggguucuccagggaaguuuuggaauacgacaauagcugugucaauggccaacauuuuccggggaagcuaucucgcgggcgccggucuagcauuuucccugaugaaaaguuugggccgagggagaaggggaaccggcgcucagggggaaacucugggagagaaguggaagcgccagcucaaucagcuuucuaaaagcgaguucaacaucuacaagcggucaggcauuauggaggucgacagauccgaagccaaagagggucugaagcguggggagaccacaaggcacgcagugagucggggaacugcuaaauugcgcugguucguagaacgaaaucuggugaagccugagggcaagguuaucgaucucgguuguggcagagggggauggagcuauuacugcgccggccuaaagaaggugaccgaagucaaaggguauacaaagggaggccccggucaugaggaaccgauaccaauggccacguacggguggaaccuggugaaacuucacucuggaaaggacgucuuuuucaccccucccgagaaaugugauacucugcuaugcgacaucggcgaguccucaccaaaucccacaauugaagagggcaggacccuccgggugcugaagaugguugaaccuugguugcgcgggaaccaauuuuguaucaagauucugaauccguacaugcccagcguaguggagacucucgagcagaugcagagaaaacauggagguaugcuugucaggaacccacugucgcgaaauucuacacacgaaauguauugggugaguugcggcaccgggaacaucguuuccgcggugaauaugacgagccggauguuacugaaccguuucaccauggcucacagaaagccuacauacgagcgcgaugucgacuugggagcaggcacuaggcauguggccguagaacccgagguggcuaaccucgauauuaucggucagcggauagaaaauauuaaacacgagcauaagucaaccuggcacuaugacgaggauaacccuuacaaaacaugggccuaucauggguccuacgaaguuaagccaucuggaagcgcaaguuccauggucaauggcguggugaagcugcuaacuaaacccugggacgucaucccuaugguuacccaaaucgccaugacagauaccacuccauuuggccagcagagaguguucaaggagaaaguagacacgcgcacacccaaggcuaaaagggggaccgcgcaaauuauggaagugacugcccgauggcuuuggggauuucugagccggaacaagaagccgagaauauguaccagggaggaguucacacgcaaaguccguucuaaugcagcuaucggugccguguuuguugacgagaaccaguggaacucagcaaaggaggccguggaagaugagcgguucugggaccucguccagaaagaaagagagcugcacaagcagggcaaaugcgcuacgugcguguauaacaugauggggaagagggaaaagaaauugggagaguuuggcaaggccaaagguagucgcgcgauuugguacauguggcugggggcacgauuccucgaguuugaagcccuuggauucaugaaugaggaucacugguucucccgggaaaacagccugucuggcguagagggcgagggguuacauaagcugggauacaucuugagagacauuucgaaaaucccugguggcaauauguaugcugaugacaccgccgggugggauacuaggauaacagaagacgaucuccaaaacgaggcaaagaucaccgacauuauggaaccagagcacgcucugcuagccacuucaaucuuuaaacuuacauaccagaauaagguugugcgcguccagagacccgcuaagagcggaaccgugauggaugugauuucccggagggaccagcguggcaguggucaagucgggacauauggacugaacacuuucaccaauauggaagcccagcucauccgacagauggagucugagggcauauuucugccuagcgaauuggagacgccaaacuuagcagaacgcguucuggauuggcucgagaaauacggcguggaaagacuuaagcggauggcgauuuccggggacgacuguguagugaaacccaucgaugacagguucgccaccgcucugacagcccuaaacgauaugggaaagguccgcaaagacaucccgcagugggagccuucaaaggguuggaaugauuggcaacaggugcccuuuugcagucaucacuuccaccagcugauuaugaaggacggcagagagauaguugugccaugucggaaccaggaugaacucgucgggagggcacgagugucucaaggagcuggcuggagcuugcgugagacugccugccuggguaaauccuaugcacagauguggcagcuuauguacuuucauagacgcgaccugcggcucgccgcgaaugcuaucuguucagccguaccuguugauugggugcccaccagcaggacaacuuggucuauucacgcacaucaccaauggaugaccacggaagacauguuauccgucuggaacagaguguggaucgaggaaaauccauggauggaggauaagacacauguuaguagcuggggagacgugcccuaucugggaaaacgcgaggaccaguggugcggcucguugauuggccugaccgcccgggcuacuugggccuccaacauccaggucgcaauaaaucaggugaggcgacucaucgggaacgaaaauuaccuugauuacaugacaucuaugaagagauucaaaaacgagggagacccugaaggugcucugugguga

SEQ ID NO: 13984 - RNA, 9879 nt, Artificial Sequence
  derived and/or modified CDS sequence (opt3) from DENV-1__EU482790__SS-prME
agcgugaccaugcugcucaugcuuaugcccacagcccuggcuuuccacuugacuacgagaggaggggaaccucauaugaucgucuccaagcaggaaaggggaaaaucuuuacuguuuaagaccucagccgguguuaacaugugcacacugauugccauggaccucggcgaguucugugaagauacuaugaccuacaaaugcccacggauuacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcagcaguaccucucaagagacuuggaaucggcaggaccuucugguaacauuuaaaaccgcacacgcuaagaagcaggaaguuguggucuuggguucccaagagggggccaugcacacagcucucacuggcgccaccgaaauccagacgagcggaaccacaacuauuuucgcaggccaucugaaaugccguuuaaagauggauaaacugacccuaaaggggaugucguaugugauguguacaggaucuuucaaacucgagaaggaagucgccgagacucagcacgguaccgugcugguucagauaaaguacgagggcacggacgugccuugcaaaaucccauuuuccacacaagaugaaaaggggguaacccagaacggacgccuuauuacugcuaaucccaucgucacagacaaagagaagccugugaacauagaagcggagccacccuucggcgagucauauauuguuaucggugcaggggaaaaagccuugaagcugaguugguuuaagaaaggcagcuccaucggaaagauguucgaggcuaccgccagaggcgcaaggcggauggccauucucggggauacugcuugggacuuuggaucuaucgguggcguguucaccagcgucgggaaacuggugcaucagauuuuuggaacagccuacggcguacuuuucucaggugugaguuggacgaugaagauagggaucggcguucuguugaccuggcucggacuaaauucccgaagcacuucuuuaucaaugacauguauugcagucggccuggugacccuauaccucggggugaugguccaggcggauaguggaugcguuaucaacuggaaaggccgcgaacugaagugugguagcgggaucuuugugacaaaugaggugcacacuuggaccgaacaauauaaguuccaggcugacuccccgaaaagacuuucugccgcaauuggaaaggccugggaggagggcguaugcgguauaaggucggcuacgcgguuggaaaacaucauguggaaacagauuagcaacgagcugaaucauauccuccuggaaaacgacaugaaguuaacagucgugguuggcgauguggccgggauucuggcacagggcaagaagaugauccgcccucaacccauggaguacaaauauuccuggaagucauggggcaaggcuaaaauaaucggggccgacguccagaauaccacuuuuauuaucgauggaccaaacaccccugaaugucccgacgaucagagagcguggaauauuugggagguggaggacuacggcuucgguaucuuuacaacuaacauauggcuuaaguugagggauaguuauacccagguuugcgaccaccgucucaugucugccgcuauuaaagauagcaaggcagugcacgccgacaugggguacuggaucgaauccgagaaaaaugaaacauggaagcuggcucgggccucauucauugagguaaagacguguaucuggccaaaaagccauacccuauggucuaacggaguccuggaauccgagaugauaauccccaagauuuauggcgguccuaucagucaacacaauuaccgaccaggcuacuucacucagacagcagggccguggcaucucggaaaacuggagcuugauuuugacuugugcgaaggcaccacugugguggucgaugagcacugcgggaacagaggacccagccugaggacaaccacgguuacuggcaagauuauccacgaaugguguugccgcucuuguaccuuaccuccacuccgguucaaaggugaggacgggugcugguauggaauggagauaagacccgugaaggaaaaggaggaaaaucugguaaaauccauggugucagcgggcaguggugaggucgacagcuuuucgcuuggccuguuguguauuuccaucaugaucgaagaggugaugaggucucgcuggagccgaaagaugcucaugacagggacccuggccguuuucuuucuacugauuaugggacagcucacuuggaacgaucugauccggcuuugcauuauggugggcgcuaaugccucagaccguauggggaugggaacaaccuacuuggcacugauggcuacauucaaaaugagaccuauguuugccgucggcuuacucuucaggcgccugacaagucgggaggugcuucugcuaaccauaggucucucccugguugcaucuguggaauugccaaacagccuggaggaauuaggggauggacucgccaugggcaucaugauucugaaacuucugacggacuuucaaucccaucaguugugggcuacacuccugucacuaaccuucaucaaaacuaccuuuagccugcacuaugcguggaagacaauggccaugguccuuaguauuguaucucucuucccccuguguuuguccacuaccagccagaagacgacauggcugccgguguuacucggcucgcuggggugcaaaccucuuaccauguuucugaucgcagagaauaagauauggggaagaaaaucauggccauugaacgaagguaucauggcuguuggcauugugucuauccuccugaguucccuacugaagaacgaugucccccuugccgggccucucauugccggaggcaugcugaucgcuuguuacgugauaagcgguucuagcgcagacuuguccuuagagaaagccgcggagguaucaugggaagaggaagcugagcauaguggggccagccacaauauucugguggaaguccaggaugacggaacuaugaagaucaaagaugaggagagggacgauacacucaccauccugcuuaaggcaacucuguuggccguuucuggcguguauccccuauccauuccagcuacacuguucgugugguacuucuggcaaaagaaaaagcagcgaucaggcguccucugggacaccccuagucccccagaaguggagcgcgcaguucuggaugacgggauauaucggaucaugcagagaggacuuuuagguaggagccagguaggcgugggggucuuucaagaaaacguguuccauacgauguggcacguuacucguggagccgugcugauguaccagggcaaacgccucgagccguccugggcgucugucaagaaagacuugauuucguacggugggggauggcggcugcagggcagcuggaauaccggcgaggaagugcagguaaucgcugucgagccugggaagaaccccaagaaugugcaaacagccccaggaaccuuuaaaacaucagaaggugagguuggcgcaauugcccucgauuucaagcccgggacuuccggaaguccuaucgugaacagagaaggcaaaauagucggucuguaugggaauggagugguuaccacgucuggcacauacgugagcgcuaucgcccaggcaaaggcuucccaggagggcccacuucccgagauugaagacgaggucuuuaggaaacgaaaccugacuaucauggauuugcacccugggucaggaaagacccggcgcuaucuaccggccauugugagagaagcgaucaagaggaaacugcggacacucauauuagccccaacccgaguaguggcaucugagauggcugaagcccugaaggguaugcccauuagauaccaaacuaccgcuguuaaaagcgagcauacaggcaaggagaucgucgaccuuaugugccacgcaacguucacuaugcgccugcucaguccugugagggugccaaauuauaacaugaucauuauggaugaagcccauuuuaccgaccccuccagcaucgccgcucguggguacauaucuacacgggucggaaugggcgaggcggcagccauuuucaugaccgcuacuccuccggguucaguagaagccuuuccccaguccaaugcagugauccaggaugaggaaagagacauuccagagaggaguuggaacagcggguaugaguggaucacagauuucccuggaaaaaccguuugguuugugcccucgauaaagucuggcaaugacauugccaacuguuugcgcaagaauggcaaacgagucauccagcuguccagaaagacguucgauacugaauaccaaaagacuaagaacaacgacugggacuacgugguuaccaccgauaucagcgagaugggggcuaauuuccgggcggacagggugauugauccacgccguugccucaaaccugucauccugaaggacggacccgaaagagugauucuugccgguccaaugccgguaacuguggcaucagcugcccagcggaggggccgcauagggcgaaaccacaauaaggagggagaucaguauaucuacaugggccagccucuaaacaaugacgaggaucaugcacacuggacagaagccaaaaugcuguuggacaacauuaauacccccgaggguaucaucccagcuuuauuugaacccgagagagaaaagagugccgcgauugauggggaguaucggcugaggggcgaggcacgcaaaacauucguugaacucaugagaaggggagaccugccugucuggcuuucuuacaagguggccuccgagggcuuucaauauagcgaucggcguuggugcuucgacggggaacgcaacaaucaggugcuggaggaaaacauggaugucgagauauggacuaaagagggagaacgaaagaaacucagaccaaggugguuggacgcucggacguacucagacccccuggcccuacgcgaguuuaaggaguucgcugcagguagaaggaguguuagcggcgaucugauccucgagauugggaaacuuccucagcaccugacccagcgggcccaaaaugcuuuagacaacuuggugaugcugcauaauuccgaacagggaggccgagccuauagacacgcaauggaggagcucccggauacaaucgaaacucugaugcuucuggcgcucauugccguauugaccgguggggugacacuguuuuucuuaucuggccgcggacuaggcaaaaccagcaucgggcugcucugugucauggcuuccucagugcuucuguggauggccucuguugagccacauuggauagcagcuaguaucauuuuggaauuuuuccugauggugcuccugauccccgagccugacaggcagcggacuccccaggauaaccaacuugccuacgucguaauuggacuccuguuuaugaucuugacgguggcagccaaugagaugggucuguuagaaaccacaaagaaagaccuaggcauagggcacguugcuguggagaaccaccaucacgcggccaugcuggaugucgaccuccauccagcaucggcuuggacucuuuacgccguggccaccacaauuaucaccccuaugaugcgucacacuauugaaaacacaacggcaaauaucagccugaccgcuauagccaaccaggcggcuaucuugaugggacuggauaagggcuggcccauuuccaaaauggacaucggugucccacuccuggcccuugggugcuauucucaggugaauccuuuaacucugacagcagccguucucauguugguggcucauuacgcaauuaucggcccgggacugcaagccaaggcgaccagagaggcucagaagaggaccgccgcaggcauaaugaaaaaccccacaguagaugggauuguggccaucgaccuagauccagucguuuaugacgcuaaguucgaaaaacagcugggacagaucaugcuccuuauucuguguacuucacaaaucuugcugaugcgcacgaccugggcccucugcgagagcauaacacuggcaacuggcccuuuaaccacacuuugggaggguucccccgggaaguuuuggaauaccacuauugcugugaguauggccaacaucuuccggggaucuuaccuggcgggcgccggucucgcauucagccuaaugaaaucacugggcgggggacgaagaggcacgggggcucagggagaaacauugggcgagaaguggaagaggcagcugaaucagcucuccaaaagugaauuuaacaccuauaagcgcagcgguauuauggaggucgaccggucugaagccaaagaggggcuuaagagaggagagacuaccaaacacgcagugucccguggcacagcuaagcugaggugguucguagaacggaauuuggugaagccagaggguaaaguuaucgaucugggcugugggcgcggaggcuggucauacuauugcgccgggcucaagaaagugacugaagucaagggauacaccaaaggcgguccugggcacgaggaacccauaccgauggccacauacggauggaacuuagugaagcuguauagcggcaaagacgucuuuuucaucccaccugagaagugugauacgcuucugugcgacauuggcgagucgucucccaauccaaccaucgaagaggggcgaacucuaagagugcucaagaugguugaacccuggcugaggggaaaccaauuuuguauuaaaaucuugaauccuuacaugccgaguguaguggagacacuggagcagaugcagcggaagcaugguggcaugcucguccgcaacccccuuuccagaaauagcacccacgaaauguauugggugucaugcgggacuggaaacauuguuuccgcggugaauaugacaucuaggaugcuguuaaaccgauucaccauggcucaucggaaaccaacguacgagcgugaugucgaccugggcgcagguaccagacacguggccguagaaccugaggugcccaacuuggauaucauagggcagcgcauugaaaauaucaagcacgagcauaaaagcacauggcacuaugacgaggauaacccuuacaagacuugggcuuaucauggaaguuacgaaguuaagccauccggcagcgccucuucaauggucaauggcguggugaaacuccugaccaagcccugggacgucaucccuaugguuacacaaauugcaaugacugauaccacaccauuugggcagcagaggguguucaaagagaagguagacacccggacucccaaagccaagagaggaacggcucaaauaauggaagugacagcgaaguggcuaugggguuuucuuagucgcaacaaaaagccgaggaucuguacccgagaggaguucacucggaaagucagauccaaugccgcaauuggcgcuguguuuguugacgagaaccaguggaauagcgccaaggaggcaguggaagaugagagguucugggaccugguccaccgcgaacgugagcuccauaaacaggggaagugcgcaaccugcguguacaacaugaugggaaagcgggagaaaaagcugggcgaguuugguaaagcuaaggggucuagagccaucugguauaugugguugggagcgagguuccuggaguucgaagcacucggcuuuaugaaugaggaucacugguucucgcgcgaaaacucacuuagcggcguagagggggagggacugcacaaauuagguuacauucugcgagacaucuccaagauaccuggcgggaauauguaugccgaugacacagcuggaugggauacgcggaucaccgaagacgauuugcagaacgaggccaaaauuacugacaucauggaaccagagcaugcacuccuggcuaagaguauuuuuaagcuaacauaccaaaauaaaguugugagaguccagaggcccgccaagaacggcaccgugauggaugugaucucucgcagagaccagcgggguagcgggcaggucggaacuuauggccuuaauacauucaccaacauggaagcucaacugauaaggcagauggaguccgagggcauauuuucaccuagugaacucgagacaccaaaccuggccgggcguguuuuggauugguuagaaaaacacggaguggagcgacugaagcgcauggcaaucucuggugacgacuguguagugaaacccaucgaugacagauucgcgacugcccucaccgcucuuaaugauaugggcaagguccggaaggacauuccgcagugggaaccuagcaaaggguggaacgauuggcagcaagugcccuuuugcucccaucacuuccaccagcugauaaugaaggacggaagggagaucguugugccaugucgcaaucaggaugagcuagucggcagagcccgggugucacagggugcaggguggagccugagggaaacggcuugccucggaaaaucuuacgcccaaauguggcaguugauguauuuucaucgacgugaccugagacuugcagccaacgcgauuuguuccgcuguaccuguugauugggugcccaccagucgcacaacuuggagcauccacgcccaucaccaguggaugaccacagaggacaugcugucggucuggaaucggguguggauugaagagaacccauggauggaagauaagacucauaucuccucuuggggcgacguucccuaccucggcaaaagggaggaccaauggugcgggucauuaauaggacugaccgcaagagccacgugggcuacaaauauccagguggccauuaaccagguccgccgguugaucgguaaugagaacuaccuggauuauaugaccagcaugaagagguucaagaaugaaagugacccugagggcgcacucugguga

SEQ ID NO: 13985 - RNA, 9879 nt, Artificial Sequence
  derived and/or modified CDS sequence (opt3) from DENV-1__EU482791__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaaaagcuggccacugaacgaaggcauaauggccguggggguugugucgauccuacugucaucucuucucaagaacgacgucccccuggccggaccuuugauugcuggcgguauguuaaucgcauguuaugugauuaguggguccagcgccgaucugucucucgagaaagcggcugagguaagcugggaagaggaagccgagcacuccggagcaucacauaauauccugguggaaguccaggacgauggcaccaugaagauaaaagacgaggagagggaugacacucuuacaauucuguugaaggccacccuacuggcuguuaguggcguguacccccucagcaucccagcaacgcuguucgugugguauuuuuggcaaaagaaaaagcagcgaucugggguccuuugggauacuccuucacccccagaaguggagcgcgccguuuuagacgauggaaucuaccggauuaugcagagaggucugcucggcaggagccagguaggggugggagucuuccaagaaaacguguuccacaccauguggcacguuacacguggcgcgguguugauguaucaggguaaacgccuggagccgaguugggcuagcgucaagaaagaccucauauccuacgggggaggcuggcggcugcagggcucuuggaauaccggggaggaagugcagguaaucgccgucgagccuggaaagaaccccaagaaugugcaaacagcaccagguacuuuuaaaacccccgaaggcgagguuggggccauugcucuugacuucaagccuggaacgucgggcagcccaaucgugaacagagaagguaaaauugucgggcuguacggaaauggcgugguuacaacuucaggcaccuauguguccgccaucgcacaggcuaaggccagucaggaggggcccuugccugagauagaagaugaggucuuuaggaaacgaaaccuaacaaucauggaccugcauccgggaucugguaagacccggcgcuaccucccagcgauugugagagaagccaucaagaggaaauuacggacucugauucuugcacccacccgaguaguggcuagcgagauggccgaagcucugaagggcaugccuaucagauaucaaacaacggcaguuaaauccgagcacacugggaaggagauagucgaucucaugugccaugccaccuucacaaugcgcuugcugucaccagugagggugcccaauuacaacaugauuaucauggacgaagcccacuuuaccgauccuucuagcaucgcugcgcguggauauauuaguacucgggucggcaugggugaggcagccgcuaucuucaugacagccaccccgcccggguccguagaagcauuuccacagagcaaugccgugauacaggacgaggaaagagauauuccugagaggucuuggaacucaggauacgaguggaucacggacuuccccggcaaaacuguuugguuugugccauccauuaagaguggcaaugauaucgcuaacugucuccgcaagaaugggaaacgagucauacagcugagcagaaagacauucgacaccgaauaucagaaaaccaagaacaacgauugggacuacgugguuacuacagacauuucggagaugggagcgaauuuucgggccgauagggugaucgacccucgccguugccuuaaacccgucauccuaaaggaugguccagaaagagugauucuggcaggcccgaugccuguaaccguggcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuucgaaccugagagagaaaaguccgcggcaaucgacggcgaguaccggcugaggggagaggcccgcaaaacguucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagaucuggaccaaagagggugaacgaaagaaacugagacccagguggcuagaugcccggacauauucugacccucuggcucuccgcgaguuuaaggaguucgcagccggcagaagguccguuagcggggaccuuauucuggagauaggaaaguuaccgcagcauuugacucagcgggcucaaaaugcccuggauaaccucgugaugcugcacaauucagaacagggcggucgagcauacagacaugcgauggaggagcuuccagacaccaucgaaacacugaugcucuuggcccugauugcuguauuaaccgggggcgugacucuauuuuuccugaguggacgcggccucgggaaaacgagcaucggacuucugugugucauggccuccucuguguugcuguggauggcaagcguugagccccacuggauugcugccuccaucauacucgaauuuuuccugauggugcuucucaucccugagcccgauaggcagcggaccccacaggacaaccaacuggcauaugucguaauugguuugcuguuuaugaucuuaacaguggccgcuaaugagaugggccuacuggaaacuaccaagaaagaucucgggauuggacacguugcgguggagaaccaucaccaugccacaaugcuugacgucgaucugcacccugcaucagcuuggaccuuguacgccguggccacuacaaucauaacgcccaugaugcgucauaccauugaaaacacuacagcaaauaucucucugaccgcuauugccaaccaggcggcuauccucaugggccuggacaaggguuggccaauaaguaaaauggauaucggggucccucuuuuagcccugggcugcuacagccaggugaauccgcucaccuugacagcagccguucugaugcuaguggcucacuaugcaauuaucggacccggccugcaagccaaggcgacuagagaggcucagaagaggacggccgcagggauuaugaaaaacccaaccguagacggaaucguggccauagaucucgacccugucguuuacgaugcuaaguucgaaaaacagcuuggccagauuaugcuguugauccuguguacaagccaaauccuccugaugcgcacuaccugggccuuaugcgaguccauuacacuugcaaccgguccccugacuacgcucugggaggggucuccaggaaaguuuuggaauacaaccaucgcugugucaauggccaacauauuccggggcagcuaucuagcgggugccggccuggcauuuuccuugaugaaaagucuagggggaggccgaagagggacuggagcucagggcgaaacccucggugagaaguggaagaggcagcuuaaucagcugucuaaaagcgaguucaacauuuacaagcgcucagggaucauggaggucgaccgguccgaagccaaagagggauugaagagaggcgagacaacucgucacgcagugaguagggguaccgcuaaacugcggugguucguagaacgcaaucucgugaagccugagggcaagguuauugacuuaggguguggacgaggcggguggagcuauuacugcgccggacugaaaaaggugacagaagucaaaggcuauacgaagggugggcccggacaugaggaaccgaucccaauggccaccuacggcuggaaccuugugaaacugcacucuggcaaggaugucuuuuucacuccucccgagaaaugugacacacuacucugcgauauaggggaguccucaccaaaucccaccaucgaagagggaagaacucugaggguguugaagaugguugaaccuuggcugcgggguaaccaauuuuguauuaagauccucaauccguacaugcccagcguaguggagacacuugagcagaugcagcgcaaacauggcgggaugcuggucagaaacccauuaucgagaaauucuacccacgaaauguauugggugaguugcggaacgggcaacauuguuuccgcggugaauaugaccagccgaaugcuguugaaccgguucacaauggcucaccguaagccuacuuacgagagagacgucgaucucggugcagggacccgccauguggccguagaacccgagguggcuaaccuggacaucauuggacagaggaucgaaaauauaaaacacgagcauaagucaacauggcacuaugaugaggacaacccuuacaaaacuugggccuaucauggcuccuacgaaguuaagccaucuggcagcgcaaguuccauggucaaugggguggugaagcuacuuaccaaacccugggaugucauuccuaugguuacacaaaucgccaugaccgacacuacgccauuuggacagcagcggguguucaaggagaaaguagauacaagaacccccaaggcuaaacgcgguacugcgcaaaucauggaagugaccgccagguggcuguggggcuuucucagccgaaacaagaagccgcggauuuguacaagagaggaguucacgaggaaaguccgcucuaaugcagcuauaggggccguguuuguugacgagaaccaguggaacucagcaaaggaggccguggaagacgagcguuucugggaucugguccagaaagaacgggaguugcacaagcagggaaaaugcgcuaccugcguguauaacaugaugggcaagagagaaaagaaacugggugaguuugggaaggccaaaggaaguagggcgaucugguacauguggcucggcgcacgcuuccuugaguuugaagcccugggcuucaugaaugaggaccacugguucucccgagaaaacagcuuaucugggguagagggagagggucugcauaaguugggcuacauucuccgggauaucucgaaaauuccugggggaaauauguaugcugacgauacugccggcugggacacaagaaucaccgaagaugaccugcaaaacgaggcaaagauaacugauaucauggaaccagagcacgcucuacuugccacaucaauuuuuaaacugaccuaccagaauaagguugugaggguccagcgccccgcuaagaacgguacagugauggacgugaucagcagacgggaucagaggggguccggacaagucggcacuuauggccucaauaccuucacgaacauggaagcccagcugauucgucagauggagagugaggggaucuuuuugccuucugaauuagagaccccaaaccuggcagaacgaguucucgacuggcuugagaaauacggaguggaacgccugaagagaauggcgauaagcggugaugacuguguagugaaacccauugacgaucgguucgccacagcucuaacugcccugaaugacaugggcaaggucaggaaagauaucccgcagugggagccuuccaagggguggaacgacuggcaacaggugcccuuuugcucacaucacuuccaccagcucaucaugaaggauggacgcgagauuguugugccauguagaaaucaggacgaauuggucggccgggcaagggugagucaaggugcuggguggucucugcgagagaccgccugccuuggaaaaagcuaugcacagauguggcagcugauguacuuucaucguagagaucuccgcuuagccgcgaacgcuauauguuccgccguaccuguugacugggugcccacaucacggacuaccuggagcauccacgcacaucaccaauggaugacgacagaagauaugcugucugucuggaauaggguguggauugaggaaaacccauggauggaggacaagacccauguuuccaguuggggcgaugugcccuauuugggcaaaagagaggaccaguggugcgggagccugaucggacucacugcccgcgcuacaugggccucgaauauucaggucgcaaucaaccaggugcggaggcuuauagguaaugaaaacuaccuggacuacaugaccuccaugaagcgauucaaaaaugagggcgauccugaaggggcucuaugguga

SEQ ID NO: 13986 - RNA, 9879 nt, Artificial Sequence
  derived and/or modified CDS sequence (opt3) from DENV-1__EU482792__SS-prME
uccgugaccaugcugcucaugcuuaugcccacggcccuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgagacugaaccggacgauguggacuguuggugcaaugcgacagauaccuggguaacguaugggacuuguucacaaaccggagagcaccgccgagacaagcguaguguggcucuugcaccccaugucggccuggguuuggagacaagaacugaaaccuggaugagcuccgagggggcauggaaacagauccagaggguggaaacaugggcccuccggcacccuggauucaccguuauugcucuguuucuggcccaugccaucggcacgucuauuacucagaagggcaucauauucauccucuuaaugcuggugacaccaucgauggcuaugcgcugcgucgggauuggaucaagagauuuuguggagggucuuagcggcgccaccuggguagacguuguguuggagcacgggaguugugucacuacaauggcgaaggauaaacccacccuggacaucgaacuacucaagacggaggugaccaacccugcagugcugaggaaacuuugcauugaagccaagaucuccaauacaacuaccgauucucgguguccaacacaaggagaggcuacucugauggaagaacaagacgccaacuucgucugccgccgaaccuuuguugauagaggcugggguaauggguguggauuguucggcaaaggcagccucauaacaugcgcaaaguuuaagugcgugaccaaacuggaggggaagauuguacaguacgaaaacuuaaaauauuccgugaucgucacugugcacacgggagaccagcaucaaguugguaaugagucaacagaacacggcaccacugcuaccauuacaccccaggccccuaccagugagauccagcugacugacuacggggcgcucacacuugauuguagcccaaggacgggacuggacuucaacgaaaugguguugcuaaccaugaaggagaaaucuuggcugguccauaagcagugguuucucgaucugccgcuucccuggacuuccggcgccucaacaagccaagagaccuggaaucggcaggaccuguuggugacauucaaaacugcacacgcuaagaagcaggaaguaguugugcucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugucauguguaccggaucguucaaacuggagaaggaaguggccgagacgcagcacgguacaguccuugugcagauaaaguacgagggcaccgacgcuccuugcaaaaucccauucucgacucaagaugaaaaggggguuacacagaacggacgcuugauuaccgcgaaucccaucgugacugacaaagagaagccuguaaacauagaagcagagccacccuuuggcgagucuuauauugucaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguguuuacguccguugggaaacuugugcaucagauuuucggaaccgcauacggcguccuguuuucuggugugagcuggacuaugaagauagggaucggcguauugcucacauggcugggauuaaauucacgaaguaccucccugagcaugacauguauugcggugggccuaguuacucucuaccugggggucauggugcaggcugauucuggaugcgugaucaacuggaaaggccgcgaacuuaagugugguucagggaucuucgucaccaaugagguucacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacugugguagucggcgaugugguugggauucuggcacagggcaaaaagaugauccgcccucaacccauggagcacaaauacucguggaaaagcuggggcaaggcuaagauaaucggggccgacgugcagaauaccacauuuauuaucgauggaccaaacacuccugaaugucccgacgaucagagagcguggaauauuugggaggucgaggacuauggcuucgguaucuuuaccacaaacauauggcuuaaguugagggauuccuacacacaggugugcgaccaccgucucaugucagccgcuauuaaagauaguaaggcaguucaugccgacaugggguauuggaucgaaucugagaaaaaugaaaccuggaagcuggcucgggccagcuucauugaggugaagacuuguaucuggccaaaaucccacacacuauggucaaacggaguacuggaaagcgagaugauaauccccaagauuuacggcgguccuaucucucaacauaauuaucgaccaggcuacuucacccagacugcagggccguggcaccucggaaaacuggagcuugauuuugacuugugcgaaggcacaaccgucgugguggaugagcacugcgggaacagaggacccucccugaggacgacuaccgucacaggcaagauuauccaugaaugguguugccgcaguuguaccuuaccuccacuccgguucaaaggugaggacgggugcugguacggaauggagauaagacccguuaaggaaaaggaggaaaaucuggugaaaagcaugguaucugcgggcuccggugagguggacucauuuagucuuggccuguuguguauuagcaucaugaucgaagaggucaugaggucgcgcuggucccgaaagaugcucaugacugggacacuggccguguuccuacugcucauuaugggacagcugaccuggaacgaucuuauccgguugugcauuaugguuggcgcuaaugccucugaccguauggggaugggaacaacuuaucuggcauuaauggcuaccuuuaaaaugagaccuauguucgccgugggccuccuguuuaggcgccuuacgagccgggagguccugcuacucacaauaggucugucauugguggcaaguguugaacugccaaacuccuuagaggaacucggggauggacuggccaugggcaucaugauucuuaagcuguugaccgacuuccaaucucaccagcucugggcuacucugcuaagccugaccuuuaucaaaacaacucuuucccuccauuacgcguggaagaccauggccauggugcugucaauugucagcuuguucccccuguguuuaaguacgacaucucagaagaccacuuggcucccgguacugcuuggcucccuggggugcaaaccuuugacaauguuucucaucgcagagaauaagauauggggaagaaaaagcuggccacugaacgaagguaucauggcugugggcguugugucgauucuacugucaucucuucucaagaacgaugucccccuggccgggccuuugaucgccggaggcauguuaauugcuuguuaugugaucagugguuccagcgcagaccugucucucgagaaagccgcggagguaagcugggaagaggaagcugagcacuccggggccucacauaauauacugguggaaguccaggaugacggaaccaugaagauuaaagaugaggagagggacgauacucuuacaauccuguugaaggcaacccuacuggccguuaguggcguguacccccucagcaucccagcuacgcuguucgugugguauuuuuggcaaaagaaaaagcagcgaucuggcguccuuugggacacuccuucacccccagaaguggagcgcgcaguuuuagaugacgggauuuaccggauaaugcagagaggacugcucgguaggagccagguaggcgugggggucuuccaagaaaacguguuccacaccauguggcacguuacacguggagccguguugauguaucagggcaaacgccuggagccgaguugggcgagcgucaagaaagaccucaucuccuacggugggggauggcggcugcagggcucuuggaauaccggcgaggaagugcagguaauugcugucgagccugggaagaaccccaagaaugugcaaacagccccaggaacuuuuaaaacccccgaaggugagguuggcgcaaucgcccuugauuucaagccugggacgucgggaagcccaauugugaacagagaaggcaaaaucgucggucuguacgggaauggagugguuacaacuucaggcaccuauguguccgcuauagcccaggcaaaggcuagucaggagggccccuugccugagaucgaagacgaggucuuuaggaaacgaaaccuaacaauuauggaucugcauccggggucuggaaagacccggcgcuaccucccagccaucgugagagaagcgauuaagaggaaauuacggacucugauccuugcccccacccgaguaguggcaagcgagauggcugaagcccugaaggguaugccuauaagauaucaaacaacggcuguuaaauccgagcacacuggcaaggagauugucgaccucaugugccaugcaaccuucacaaugcgcuugcugucaccagugagggugcccaauuacaacaugaucaucauggaugaagcccacuuuaccgacccuucuagcauugccgcucguggguauaucaguacucgggucggaaugggcgaggcggcagccauauucaugacagcuaccccgcccgguuccguagaagccuuuccacagagcaaugcagugauucaggaugaggaaagagacaucccugagaggucuuggaacucaggguacgaguggauuacggauuuccccggaaaaacuguuugguuugugccauccaucaagaguggcaaugacauagccaacugucuccgcaagaauggcaaacgagucauucagcugagcagaaagacauucgauaccgaauaucagaaaaccaagaacaacgacugggacuacgugguuacuacagauaucucggagaugggggcuaauuuucgggcggacagggugaucgauccucgccguugccuuaaacccgucauucuaaaggacggaccagaaagagugauccuggccgguccgaugccuguaaccguggcaucugcugcccagcggaggggccgcauugggcgaaaccauaauaaggagggagaucaguacauauauaugggccagcccuugaacaaugacgaggaucacgcacacuggacagaagccaaaauguuacuggacaacaucaauacuccagaggguauuauccccgcucucuucgaaccugagagagaaaaguccgccgcgaucgauggggaguaccggcugaggggcgaggcacgcaaaacguucguugaacuuaugagaaggggagaccugccagucuggcucagcuauaagguggccucagagggcuuucaauacagugaucggcguuggugcuucgacggggaacgcaacaaucagguguuggaggaaaacauggaugucgagauuuggaccaaagagggagaacgaaagaaacugagacccagguggcuagacgcucggacauauucugacccucuggcccuccgcgaguuuaaggaguucgcugcagguagaagguccguuagcggcgaucuuauacuggagaucgggaaguuaccgcagcauuugacucagcgggcccaaaaugcucuggacaaccucgugaugcugcacaauucagaacagggaggccgagccuacagacaugcaauggaggagcuuccagauaccauugaaacacugaugcucuuggcgcugaucgccguauuaaccgguggggugacucuauuuuuccugaguggccgcggacucggcaaaacgagcauugggcuucugugugucauggcuuccucuguguugcuguggauggccagcguugagccccacuggaucgcagcuuccauaauccucgaauuuuuccugauggugcuucucauuccugagcccgacaggcagcggaccccacaggauaaccaacuggccuaugucguaaucggauugcuguuuaugauuuuaacaguggcagccaaugagaugggucuacuggaaacuaccaagaaagaccucggcaucgggcacguugcuguggagaaccaucaccaugcgacaaugcuugaugucgaccugcacccugccucagcauggaccuuguacgcuguggccacuacaauaauuacgcccaugaugcgucauaccaucgaaaacacuacagccaauauuucucugaccgcaaucgcuaaccaggccgcgauacucaugggacuggauaagggcuggccaaucaguaaaauggacauuggugucccucuuuuagcucuggggugcuacagccaggugaauccgcucaccuugacagccgcaguucugaugcuaguggcccacuaugcuaucauuggccccggacugcaagcaaaggccacuagagaggcgcagaagaggacggcugccggcaucaugaaaaacccaaccguagaugggauaguggcaauugaccucgauccugucguuuacgacgccaaguucgaaaaacagcuuggacagaucaugcuguugauccuguguacaagccaaauucuccugaugcgcacuaccugggcuuuaugcgaguccaucacacuugccaccggcccccugacuacgcucugggaggguucuccagggaaguuuuggaauacaaccauagcagugucaauggcuaacauuuuccggggaagcuaucuagccggcgcgggucuggccuuuuccuugaugaaaagucugggcgggggacgaagaggcacuggggcacagggagaaacccucggcgagaaguggaagaggcagcuuaaucagcugucuaaaagcgaguucaacaucuacaagcgcucagguauuauggaggucgaccgguccgaagcuaaagagggguugaagagaggagagacaacucgucacgccgugaguaggggcaccgcaaaacugcggugguucguagaacgcaaucucgugaagccugaggguaagguuaucgauuuaggcugugggcgaggaggcuggagcuauuacugcgcugggcugaaaaaggugacagaagucaaaggauauacgaagggcggucccgggcaugaggaaccgauaccaauggccaccuacggauggaaccuugugaaacugcacucuggcaaggacgucuuuuucacuccucccgagaaaugugauacacuacucugcgacaucggcgaguccucaccaaaucccaccauugaagaggggagaacucugaggguguugaagaugguugaaccuuggcugcggggaaaccaauuuuguaucaagauucucaauccguacaugcccagcguaguggagacacuugagcagaugcagcgcaaauaugguggcaugcuggucagaaacccauuaucgagaaauucuacccaugaaauguacugggugaguugcgggacgggaaacaucguuuccgccgugaauaugaccagccgaaugcuguugaaccgguucacaauggcgcaccguaagccuacuuaugagagagaugucgaccucggcgcugguacccgccacguggcaguagaacccgagguggccaaccuggauauuaucgggcagaggauagaaaauauuaaacaugagcacaagucaacauggcauuacgacgaggauaacccuuauaaaacuugggcuuaccacggauccuaugaaguuaagccaucuggcagcgccaguuccauggucaauggcguggugaagcuacuuaccaaacccugggacgucaucccuaugguuacacaaaucgcaaugaccgauacuacgccauuugggcagcagcggguguucaaggagaaaguagacacaagaacccccaaggccaaacgcggaacugcucaaauuauggaagugaccgcgagguggcugugggguuuucucagccgaaacaagaagccgcggauauguacaagagaggaguucacgaggaaaguccgcucuaaugccgcaaucggcgcuguguuuguugacgagaaccaguggaacucagccaaggaggcaguggaagaugagcguuucugggaccugguccagaaagaacgggaguugcauaagcaggggaaaugcgcaaccugcguguacaacaugaugggaaagagagaaaagaaacugggcgaguuugguaaggcuaaagggaguagggccauuugguacauguggcucggagcgcgcuuccuugaguuugaagcacugggcuucaugaaugaggaucacugguucucccgagaaaacagcuuaucuggcguagagggggagggacugcacaaguuggguuauauccuccgggacauuucgaaaaucccuggcgggaauauguacgccgaugacacugcuggaugggauacaagaauaaccgaagacgaucugcaaaacgaggccaagaucacugacauuauggaaccagagcaugcacuacuugcuacaucaaucuuuaaacugaccuaucagaauaagguugugaggguccagcgccccgccaagaacggcacagugauggaugugauuagcagacgggaccagagggguuccgggcaagucggaacuuacggccucaauaccuucacgaacauggaagcucagcugauccgucagauggagagugagggcauauuuuugccuucugaauuagagaccccaaaccuggccgaacgaguucucgauuggcuugagaaauaugggguggaacgccugaagagaauggcaauuagcggagacgacuguguagugaaacccaucgaugaccgguucgcgacagcccuaacugcucugaaugauauggguaaggucaggaaagacaucccgcagugggagccuuccaagggcuggaacgauuggcaacaggugcccuuuugcucacaccauuuccaccagcucauuaugaaggacgggcgcgagauaguugugccauguagaaaucaggaugaauuggucggacgggccagggugagucaaggcgcagguuggucucugcgagagaccgcuugccuugggaaaagcuacgcccagauguggcagcugauguauuuucaccguagagaccuccgcuuagcagccaacgcgaucuguuccgcuguaccuguugauugggugcccacaucacggacuaccuggagcauucaugcccaccaucaauggaugacgacagaagacaugcugucugucuggaauaggguguggaucgaggaaaacccauggauggaggauaagacccacguuuccaguuggggagacgugcccuacuugggcaaaagagaggaccaguggugcggcagccugauugggcucacugcacgcgccacaugggcuucgaauauccaggucgccauaaaccaggugcggaggcuuaucggaaaugaaaacuaccuggauuauaugaccuccaugaagcgauucaaaaaugagggugacccugaaggcgcacuaugguga

SEQ ID NO: 13987 - RNA, 9879 nt, Artificial Sequence
  derived and/or modified CDS sequence (opt3) from DENV-1__EU482707__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgagcugugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacugguagcuucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggugauggugcaggccgauucuggaugcgucaucaacuggaaaggccgcgaacuuaagugugguucagggaucuucguuacuaaugaggugcacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaagcugaccguagucgugggcgauguugcugggauucuuggacagggcaaaaagaugauccgcccucaacccauggaguacaaauauucguggaaaagcugggggaaggccaaaauaaucggagcggacgcccagaauacuaccuucauuaucgauggcccaaacacaccugaaugucccgacgaucagagagcuuggaauauuugggagguggaggacuacgguuuugggaucuucacuaccaacauaugguugaagcucagggauuccuauacacaggucugcgaccaccgucugaugucagcagccauuaaagauaguaaggcugugcacgccgacaugggauacuggaucgaaucugagaaaaaugaaacguggaagcuagcacgggcgagcuuuauugagguuaagaccuguaucuggccaaaaucccauacucuguggucaaacggcgugcucgaaagcgagaugauaauccccaagauuuaugguggcccuaucucucaacacaauuaccgaccaggguacuucacacagaccgccggaccguggcaucugggcaaacuugaguuggauuucgaccugugcgaagggacuacaguagucguggaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgucaaagaaaaggaggaaaaucuuguuaagagcauggugucugcugguuccggcgagguagacucauucagucugggguugcucuguauuagcaucaugaucgaagaggugaugcgcucgcgauggucccggaaaaugcugaugaccggaacucuagccgucuuuuuccugcucauuaugggccagcugacauggaacgaucuuauccguuugugcauuauggugggggcaaaugcuucugacagaaugggaaugggcaccacauaccuggccuuaauggcaacuuuuaagaugaggccuauguucgccguuggucuccuguuucgccggcuuaccagcagagaggugcugcuacucacgauagggcugucauuggucgcuaguguggaacugccaaacuccuuagaggaacucggagauggccuggcgaugggcaucaugauucuuaaacuguugacagacuuccaaucucaucagcucugggccacccugcuaagccugacuuuuaucaagaccacauucucccuucacuaugcauggaaaacuauggcuaugguucucucaauugugagccuguuucccuugugucugaguaccacgucucagaagacaaccugguuaccgguccuccuggggucccuuggaugcaagccucugacuauguucuugaucgccgagaauaaaauaugggguaggaaguccuggccacucaacgaaggcaucauggccguagggauugugucgauccugcuaucaucucugcuuaaaaacgauguuccccucgcuggaccucugauugcaggcgguauguugaucgccuguuacgugauaaguggguccagcgcggacuuaucucuggagaaggcugccgaggucagcugggaagaggaagcagagcauuccggagccucacacaauauucucguggaaguacaggaugacggcacaaugaaaaucaaggaugaggagcgagacgauacccugacuauccuucugaaagcuacauugcuagcagugaguggcgucuauccccugagcauuccagccacccucuuuguuugguacuucuggcaaaagaagaaacagcgcucuggggugcugugggacacgccuucacccccagaaguggagcgggcgguccuugaugacggaauauauagaaucaugcagagggguuuacugggccguagccagguggggguuggaguauuccaagaaaacguguuucauacuauguggcacgucacccgcggcgcugugcucauguaccaggguaagcgguuggagccgaguugggccagcguuaaaaaggaccugauuuccuacgggggaggcuggagacucaggggcucuuggaauacaggggaggaagugcaggucaucgcaguggagccuggcaaaaaucccaagaauguacagaccgccccagguacauucaagacucccgaaggcgaggucggggcuauugcccuggauuuuaaaccuggaaccucgggcagcccaaucgugaaccgagaagguaagauaguugggcuuuauggaaauggcguggucacgacaucaggcacuuacguguccgcaaucgcucaagccaaagcgagucaggaggggccccugccugagauugaagacgagguuuuccggaagcgcaacuugaccaucauggaucuacacccgggaucugguaaaacaagaagguaucugccagccauugugcgggaagcaaucaagcgaaagcucagaaccuuaauacuggcucccacucgcgucguggccagcgagauggcugaagcacuuaaaggcaugccuauuagguaccagaccacagccguaaaguccgagcauacggggaaagagaucguggaccugaugugccacgccacuuuuaccaugcgucucuugucaccaguucggguccccaauuauaacaugaucauuauggaugaagcucauuucacagacccuucuagcaucgcggcaagaggauacauaaguaccagggugggcaugggugaggccgcugccauuuuuaugacugcaacaccgcccggguccguggaagccuucccacaaagcaaugcugucauccaggaugaggaacgcgacauuccugagcgaucuuggaacucaggauaugaguggaucaccgauuuucccggcaagacgguaugguucgugccauccauaaaaaguggcaaugacauugcgaacugucugagaaagaaugggaagcggguuauccagcucagcaggaaaacuuuugauacagaauaccagaagaccaaaaacaacgacugggacuacguggucaccacugauaucucggagaugggagccaauuuccgcgcagaccgugugauugauccuagacggugccugaagcccguuauccuuaaagacgguccagaaagggugauucuagcuggcccgaugccugucacaguggccucugcagcccaacgccgagggagaauaggacggaaccacaauaaggagggcgaucaguauaucuacaugggucagccccugaacaaugacgaggaucaugcucacuggaccgaagccaagauguuguuagacaacauuaauacaccagaggggaucauccccgcgcuguucgaaccugagagggaaaaauccgcagccguagauggcgaguaucgccucagaggagaggcuaggaagacuuuuguggaacugaugcggcguggcgaccuuccaguuuggcugagcuacaaagucgccucagagggguuccaguauagugaucgccgauggugcuuugacggagaaagaaacaaucaagugcucgaggaaaacauggauguggagauuuggacgaaggagggugaaaggaaaaaguugcggccccgcuggcuggacgcuagaaccuacucugacccucuagcacugagggaguucaaagaauuugccgcuggccggcgauccgucagcggggaucucauacuugagaucggaaagcugccgcagcacuuaacacagagagcccagaaugcauuggacaaccugguuaugcuccauaauucagaacaaggcggucgcgcguauaggcacgccauggaggagcugccagauacuauugaaacccuuaugcugcucgcuuugaucgccgugcugacagggggcguaaccuuauucuuucuaaguggacggggccuggggaagacuagcauuggacuccuuugugugauggcauccucuguccuguuguggauggcuagcguggagccccauuggaucgccgcauccauaauccuggaguucuuucucaugguucugcuuauuccugagcccgaccgucagagaacgccacaggauaaccagcucgccuacguggucaucggucuguuguucaugauucugaccguagcugcgaaugagaugggcuuacuagaaacaacuaaaaaggaccuggggaucggacacguggccguugagaaccaccaucacgcagcuaugcucgauguggaccuucauccugccucagccuggacccuguacgcagucgcuacaaccauaauuacucccaugaugaggcacacaaucgaaaacacgaccgccaauauuucuuugacugcgaucgcuaaccaagccgcaauacugaugggccucgauaaagguuggccaaucaguaagauggacauuggggugccucugcuugccuuaggcugcuauucgcaggucaauccgcugacacucaccgcugcaguguugaugcugguugcccauuacgcgaucauuggacccggccuacaggcuaaagccacccgcgaggcacaaaagcggacagccgcugggaucaugaagaacccaacuguggauggaauaguagccauugaccuggauccuguggucuaugacgcaaaauuugaaaagcagcucggccagaucaugcuucugaucuuguguacgagccagauucugcucaugcgaaccacaugggcucugugcgaguccaucacuuuagccaccgguccccuuacaacccugugggaggggucuccaggaaaauucuggaauacuacgauagcgguuucaauggccaacauuuuuagaggcagcuaccucgcaggagcuggccuagccuucucccugaugaagagucuagggggaggcaggcgcgggacaggagcacaaggcgaaacccugggugagaaauggaagcggcagcucaaucagcuuucuaagagcgaguucaacacuuauaaaagaucagggaucauggagguggaccguuccgaagcuaaggagggacugaaaaggggcgagaccacaaagcacgccgucagucgggguacugccaaauugcgcugguuuguggaacgaaaucugguaaagccugagggcaaggugauugaucucggguguggaagaggcggguggagcuacuauugcgcgggacuaaagaagguuaccgaagugaaaggcuacacaaagggugggcccggacacgaggaaccgaucccaauggcuacguacggcuggaaccuggucaaacuucauucuggcaaggacguguucuuuauaccucccgagaaaugugauacccugcuaugcgacaucggggaguccucaccaaaucccacuauugaagagggaaggacacuccggguccugaagaugguggaaccuugguugcgcgguaaccaguucuguaucaagauucugaauccguauaugcccagcguuguagaggcacucgagcaaaugcagagaaaacacggcgggaugcuugugaggaacccacugucgcgaaauucuacccaugaaauguacugggucaguugcggaacuggcaacaucguguccgccguuaauaugacaagccggauguuacugaaccguuuuaccauggcucacagaaagccuacguaugagcgcgauguggacuuggguaccgggacaaggcacgucgccguggaacccgagguagcaaaccucgauauuaucggacagcggauagaaaauauuaaacaugagcacaagucaacuuggcauuacgacgaggauaacccuuauaaaaccugggccuaccacggcuccuaugaagugaagccaucuggcagcgcuaguuccaugguuaauggggucgugaagcugcuaacaaaacccugggacgugaucccuauggucacucagaucgcgaugaccgauacaaccccauucggacaacagagaguuuuuaaggagaaaguggacacucgcacgcccaaggccaaaagggguacagcacagauuauggaaguaaccgcucgauggcuuuggggcuuccugagccggaacaagaagccgagaauauguacuagggaggaauuuacccgcaaagugcguucuaaugccgcaaucggggccgucuucguggacgagaaccaauggaacucagcuaaggaggccguugaagaugagcgguuuugggaccucgugcauagagaaagggagcugcacaaacagggaaagugcgcgacaugcgucuacaacaugaugggcaaacgcgaaaagaaguugggugaguucgggaaagcaaagggaagucgagccauuugguacauguggcugggcgcucgguuucucgaguucgaagcccuuggcuucaugaaugaggaucacugguuuuccagagaaaacagccugucugggguggagggagaggguuuacauaaacugggcuauaucuugagggacauuucgaagaucccugggggaaauauguacgcagaugacacggcuggcugggauacccgcauaacugaagacgaucuccagaacgaggccaaaaucacagacauuauggaaccagagcacgcucugcuagccaaggcaaucuucaaacuuaccuaucagaauaagguaguuagagugcaacggcccgcgaagaacgguacugucauggaugugauuucaaggcgugaccagcgagggagcggacaggugggcacauacggccugaauaccuuuacaaacauggaagcccagcucauccgccaaauggaguccgaggggauauucaguccuucugaacuggagacuccaaacuuggcugaaagagccuuagauuggcuggagaaauauggagucgaacggcucaagaggauggcaauuagcggugacgacuguguugugaaacccaucgaugaccgcuuugcuaccgcccuuacggcacugaaugauaugggcaagguaagaaaagacaucccgcagugggagccuuccaagggguggaacgauuggcaacaggugcccuucugcucacaucacuuucaccaacuaauuaugaaggacggacgggagauagucgugccauguaggaaucaggaugaacugguuggccgagcccgugugagucagggugcgggguggucucucagagagaccgcuugcuugggaaaaagcuacgcccagauguggcaacugauguauuuccaucgccgggaccuuaggcuggcagccaacgcuaucuguuccgccgucccuguggauuggguacccacaucaagaacuaccuggagcauucacgcacaucaccaguggaugacaacugaagacaugcucucuguuuggaaucgcguguggaucgaggaaaacccauggauggaggauaagacccauauuuccaguugggaggacguccccuacuuaggcaaacgggaagaccaguggugcggcagccugaucggguugacggcuagggccacaugggcgaccaauauacaaguggcuaucaaccagguucgaagacugauuggaaaugagaacuaccucgauuauaugacuucgaugaagcgguuuaaaaaugaauccgacccugagggugcccuuugguga

SEQ ID NO: 13988 - RNA, 9879 nt, Artificial Sequence
  derived and/or modified CDS sequence (opt3) from DENV-1__EU482708__SS-prME
agcgugaccaugcugcucaugcuuaugcccacggcccuggcuuuccacuugacuacgagaggaggggaaccucauaugaucgucuccaagcaggaaagaggaaaaucuuuacuguuuaagaccucagccgguguuaacaugugcacacuaauugccauggaccucggcgagcugugugaagauacuaugaccuacaaaugcccacggauaacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggagcuucaaacuggagaaggaagucgccgagacgcagcacgguacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaagaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgagagagccgugcuggaugacgggauauauaggaucaugcagcguggacuuuuaggucgcagccagguuggcguagggguguuucaagaaaacgucuuccauaccauguggcacgugacacggggagcgguucugauguaccagggcaaaagacucgagccgaguugggcuagcgugaagaaagacuugauuuccuacggugggggauggaggcugcagggcucuuggaauaccggcgaggaaguccaggugaucgccguagagccugggaagaaccccaaaaauguccaaacagcaccaggaacuuuuaagacccccgaaggugaggugggcgccauugcucucgauuucaagccugggacgucgggaagcccaaucguuaaccgagaaggcaaaauagugggucuguaugggaauggagucgugacaacuucaggcaccuacguuuccgccaucgcacaggcuaaggccagucaggagggcccccuuccugagauugaagacgagguguuucggaaacgcaaccugacaaucauggauuugcacccggggucuggaaagaccagaagguaucuaccagcgauuguccgggaagccaucaaacgaaagcugagaacucucauauuagcacccacccgcgugguagcuagcgagauggccgaagcucugaaggguaugccuauuagguaccaaacaacggcagugaaauccgagcauacuggcaaggagaucguugaccuuaugugccacgccaccuucacaaugcgucugcucucaccaguccgggugcccaauuauaacaugaucauuauggaugaagcccauuuuaccgacccuucuagcaucgcugcgagaggguacauaaguacuagggugggaaugggcgaggcagccgcuauuuucaugacagccaccccgcccgguuccgucgaagcauuuccacagagcaaugccguaauccaggaugaggaacgcgacauuccugagcgaucuuggaacucaggguaugaguggaucacggauuuccccggaaaaacugugugguuuguuccauccauaaagaguggcaaugacauugcuaacuguuugaggaaaaauggcaagcgggugauccagcugagcaggaagacauucgauaccgaauaccagaaaaccaagaacaacgacugggacuacgucgugacuacagauaucucggagaugggggcgaauuuccgcgccgaccguguuauugauccuagacggugccucaaacccgugauccugaaggacggaccagaaagggucauucuugcagguccgaugccugugaccguagcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguggaacucaugcggcguggagaccugccaguuuggcuuagcuacaaggucgcuucagagggcuuucaauauagugaucgccgauggugcuucgacggggaaagaaacaaucaggugcuggaggaaaacauggauguggagauauggaccaaagagggagaaaggaagaaacuccggccccgcugguuggacgccagaacauacucugacccucuggcucuaagggaguuuaaggaguucgcagccggucggcgauccgucagcggcgaucugaucucagagauugggaaacucccgcagcaccuuacucagagagcucaaaaugcccuggacaacuuaguuauguugcauaauagugaacagggaggccgcgcauauaggcacgcgauggaggagcugccagauaccaucgaaacacucaugcugcuugcccugauugcugugcucaccggugggguaacuuuguuuuuccugagcggccggggauuaggcaagacguccaucgggcuacugugugugauggccucuagcguccuccuuuggauggcauccguggagccccauuggauagcugccucaaucauucuggaauuuuucuugaugguucugcucaucccugagcccgaccgucagagaaccccacaggauaaccaacuggcauacguggucauuggacuucucuuuaugauccugacaguagccgcuaaugagauggguuugcuggaaacuaccaagaaagacuuaggcauagggcacguggcgguugagaaccaccaucacgccgcaaugcuagauguggaccugcauccugcuucugccuggacacucuacgccgucgcaaccacuauuaucacacccaugaugaggcacacgauugaaaacaccacugcuaauaucagucuuacagccauagcgaaccaggcugccauccugaugggauuggauaagggcuggccaauuucgaaaauggacaucggugugccucugcucgcacuggggugcuauagccaggucaauccgcuuaccuuaaccgccgcugugcugaugcucguugcacauuacgccauuaucggccccggauugcaagcgaaggcuacacgcgaggcccagaaacggacugcagccggcauaaugaagaacccaacgguggaugggauuguagcuaucgaccuggauccuguggucuaugacgccaaguucgaaaaacagcuaggacagaucaugcugcucauucuuuguaccucccaaauccuguugaugcgaacaacuugggcacugugcgagucuauaacccucgcuacaggcccccugaccacuuuaugggaggguucaccagggaaguuuuggaauacgacaauugccguuagcauggcgaacaucuucagaggauccuaccuugccggcgcaggucuggcuuucagucucaugaaaucucuaggcgggggaaggcgcggcaccggggcccagggagaaacucugggcgagaaguggaaacggcaguugaaucagcugagcaagucagaauuuaacaccuauaagagauccgguauuauggagguggaccguagugaagcaaaagaggggcucaagaggggagagacaacuaaacacgcugucagccggggcaccgccaaacuucgcugguucguggaacgaaaucugguaaaaccugaggguaaggugaucgauuugggcugugggagaggaggcuggucuuacuauugcgccgggcugaagaaaguuacagaagugaagggauacacgaaaggcggucccgggcacgaggaaccgauaccaauggcgaccuacggauggaaccucgucaaguuacauuccggcaaagacguguuuuucaucccucccgagaagugugauacucugcuuugcgacauuggcgagucaagcccaaaucccacaaucgaagaggggaggacccugcggguccuaaaaaugguggaaccuuggcuccgcggaaaccaauuuuguauuaagauccugaauccguauaugcccucgguuguagagacuuuggagcagaugcagagaaagcacgguggcaugcuggugaggaacccacucucucgaaauaguacacaugaaauguacugggucuccugcgggaccggaaacauugugagcgcuguuaauaugacgucacggaugcuucugaaccguuucaccauggcacacagaaaaccuacauaugagcgcgauguggacuuaggcgccgguacuaggcacgucgcuguggaacccgagguagccaaccuggauaucauagggcagcggauugaaaauaucaagcaugagcacaaauccaccuggcauuacgacgaggauaacccuuauaagacaugggcauaccacggaucuuaugaagugaaaccaagcggcagugccuccagcaugguuaauggcgucgugaaguugcucacuaagcccugggacgugaucccuauggucacccaaauugcuaugacagauaccacuccauuugggcagcagagaguuuucaaagagaagguggacacgcgcacacccaaagcgaagaggggaaccgcccaaauaauggaaguaacugcaaaauggcugugggguuuucuaucucgaaacaagaagccgcggaucuguaccagagaggaguucacaaggaaagugcgcucaaaugcugccauuggcgcagucuuuguggacgagaaccaguggaauagugccaaggaggcuguugaagaugagcguuucugggaccuugugcaucgggaaagagagcugcacaaacaggggaagugcgccacgugcgucuacaacaugaugggaaaaagggaaaagaagcucggcgaguuugguaaagcgaaggggucccgcgcaaucugguacauguggcugggagcccgauucuuggaguucgaagcucugggcuuuaugaaugaggaucacugguucagccgggaaaacucucucucgggcguggagggggagggacuucauaaacuggguuauauuuuaagagacaucucaaagauaccuggcgggaauauguacgccgaugacaccgcaggaugggauacuaggaucacagaagacgaucugcagaacgaggcucgcauuaccgacaucauggaaccagagcacgccuugcucgcuagaagcauuuuuaaacugacuuaucaaaauaagguaguucgggugcagaggcccgccaaaaacggcacagucauggaugugaucucccgucgagaccagcgcgguaguggacaggugggaaccuacggccuaaauacauucacuaacauggaagcacaacuuauaagacagauggagucugagggcauuuuuagcccuuccgaacuggagaccccaaaccucgcggaacggguccuggauugguuggagaaguaugggguugaaagguuaaagcgcauggccaucucaggagacgacugugugguaaaacccaucgaugacagauucgcuacggcccugaccgcacucaaugauauggguaaggugcggaaagacauuccgcagugggagccuaguaagggcuggaacgauuggcagcaaguccccuuuugcucucaucacuuccaccagcuuauaaugaaagacgggagggagaucgugguuccaugucgaaaucaggaugaacuggugggacgugcuagagucagccagggcgccgguuggucccuacgcgagacagcaugccuggggaagucauacgcccaaauguggcagcucauguauuuucaucggagggacuugagacuggcggcuaacgccauuuguagcgcagugccuguagauuggauccccacuucucgcaccacaugguccauucacgcccaucaccaguggaugacuaccgaagacaugcuuaguguuuggaaucggguguggaucgaggaaaacccauggauggaggauaagacgcauauaagcucguggggagacguccccuaccugggcaaaagggaggaccaauggugcggcucccucaucggguuaacagcucgagccaccugggcaacuaauauucagguggcuaucaaccagguuagacggcugauuggaaaugaaaacuacuuggauuauaugacaucuaugaagagguucaaaaaugagucagacccugaaggugcccugugguga

SEQ ID NO: 13989 - RNA, 9879 nt, Artificial Sequence
  derived and/or modified CDS sequence (opt3) from DENV-1__EU482709__SS-prME
agcgugaccaugcugcucaugcuuguccccacagcccuggcuuuccacuugacuacgagaggaggggaaccucauaugaucguuuccaagcaggaaagaggaaaaucuuuacuguuuaagaccucagccggugugaauaugugcacacuaauugccauggaccucggcgaacugugugaagauacuaugaccuacaaaugcccacggauuacagagaccgaaccggacgauguagacuguuggugcaaugcgacugauacaugggugaccuaugggacguguagucaaacuggagagcaccgccgagacaagcguagcgucgcucuugcaccccaugugggccuggguuuggagaccagaacagaaacuuggauguccucugagggggcauggaaacagauccagaggguugaaaccugggcccuccggcacccuggauucacagugauugcucuguuucuggcacaugccaucggcaccucgauuacgcagaagggcaucauauucauccucuuaaugcuggucacuccaucaauggcuaugcgcugcguggggauuggaagcagagauuuuguagagggucuuaguggcgccacauggguugacguggucuuggagcacggguccugugugaccacuauggcgaaggauaaacccacacuggacaucgaacuacucaagaccgaggugacgaacccugcaguccugaggaaacuuugcauugaagccaagaucucuaauaccacaacugauagccgguguccaacccaaggagaggcuacacugguugaagaacaagacgccaacuucgugugccgccgaacuuuuguagauagaggcugggguaauggguguggauuguucggcaaaggcucccucauaaccugcgcaaaguuuaagugcgugacaaaacuggaggggaagauuguccaguacgaaaacuuaaaauauucagugaucguuaccgugcacacuggagaccagcaucaagucgguaaugagaguacggaacacggcacaaccgcuacuauuacaccccaagccccuaccaccgagauccagcugacugacuacggggcgcucacacuugauuguagcccaaggacgggacuggacuucaacgaaaugguguugcuaaccaugaaggagaaaucuuggcugguacauaagcagugguuucucgaucugccgcuucccuggacuuccggcgccucaacaagccaagagaccuggaaucggcaggaccuguugguuacauucaaaacugcacacgcuaagaagcaggaaguggucgugcucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugucauguguaccggaucguucaaacuggagaaggaaguggccgagacgcagcacgguacaguucuugugcagauaaaguacgagggcaccgacgcuccuugcaaaaucccauucucgacucaagaugaaaaggggguaacacagaacggacgcuugauuaccgcgaaucccaucgucacugacaaagagaagccugugaacauagaagcagagccacccuuuggcgagucuuauauuguuaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguguuuacguccgucgggaaacuugugcaucagauuuucggaaccgcauacggcguacuguuuucuggugugagcuggacuaugaagauagggaucggcguuuugcucacauggcugggauuaaauucacgaaguaccucccugagcaugacauguauugcggucggccuagugacucucuaccugggggugaugguccaggcugauucuggaugcguuaucaacuggaaaggccgcgaacuuaagugugguucagggaucuucgugaccaaugaggugcacacguggacagaacaauauaaguuucaggccgacaguccgaaaagauugagcgcagccauuggaaaggcuugggaggagggcguaugcgguauaagguccgccacccggcuggaaaacaucauguggaaacagauuucuaacgagcucaaucauauccuguuagaaaacgacaugaaguucacugucgugguuggcgauguggcagggauucuggcucagggcaaaaagaugauccgcccucaacccauggaguacaaauauucguggaaaagcuggggcaaggccaagauaaucggggcggacguccagaauaccacauuuauuaucgauggaccaaacacuccugaaugucccgacgaucagagagccuggaauauuugggagguggaggacuacggcuucgguaucuuuaccacaaacauauggcuuaaguugagggauuccuauacgcagguuugcgaccaccgucucaugucagcugcaauuaaagauaguaaggccgugcacgcugacaugggguacuggaucgaaucugagaaaaaugaaaccuggaagcuggcccgggcauccuucauugagguaaagacuuguaucuggccaaaaucccauacacuauggucaaacggaguccuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgugguggucgaugagcacugcgggaacagaggacccucccugaggacgacuaccguuacaggcaagauuauccacgaaugguguugccgcaguuguaccuuaccuccacuccgguucagaggugaggacgggugcugguauggaauggagauaaggcccgugaaagaaaaggaggaaaaucugguaaagagcauggugucugccggcuccggugaggucgacucauuuagucuuggccuguuguguauuagcaucaugaucgaagaggugaugcgcucgcgauggucccggaaaaugcucaugacugggacacuggcuguuuucuuucuacugauuaugggacagcucaccuggaacgaucugauccgucuuugcauuauggugggcgccaaugcaucugacagaauggggaugggaacaacuuacuuggcucugauggccaccuucaagaugaggccuauguuugcagucggcuuacucuuccgccggcugacgagcagagaggugcuucugcuaacaauaggucucucacugguugccaguguggaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaaugguccuuucaauuguaagccucuucccccuguguuugaguacgacaucucagaagaccacuuggcugccgguguuacucggcucccuggggugcaagccucuuacaauguuucugaucgcugagaauaaaauauggggaaggcgaagcuggccauugaacgaagguaucauggccguuggcauugugucgauccuccugucaucucuacugaagaacgaugucccccuugccgggccucucauugcuggaggcaugcugaucgcauguuacgugauaagugguuccagcgccgacuugucuuuagagaaagcggcugagguaagcugggaagaggaagccgagcauuccggggcaucacacaauauucugguggaaguccaggaugacggaaccaugaagaucaaagaugaggagcgcgacgauacucucacaauccugcuuaaggccacccuguuggcuguuaguggcguguauccccuaagcauuccagcaacgcuguucgugugguacuucuggcagaaaaagaagcagcggucuggcguccucugggacacuccuucacccccagaaguggagagagccguucuggaugacgggauauauaggaucaugcagcguggacuuuuaggucgcagccagguaggcgugggggucuuucaagaaaacguguuccauaccauguggcacguuacacggggagcggugcugauguaccagggcaaaagacucgagccgaguugggcuagcgucaagaaagacuugauuuccuacggugggggauggaggcugcagggcucuuggaauaccggcgaggaagugcagguaaucgccgucgagccugggaagaaccccaaaaaugugcaaacagcaccaggaacuuuuaagacccccgaaggugagguuggcgccauugcucucgauuucaagccugggacgucgggaagcccaaucgugaaccgagaaggcaaaauagucggucuguaugggaauggagugguuacaacuucaggcaccuacguguccgccaucgcacaggcuaaggccagucaggagggcccccuuccugagauugaagacgaggucuuucggaaacgcaaccugacaaucauggauuugcacccggggucuggaaagaccagaagguaucuaccagcgauugugcgggaagccaucaaacgaaagcugagaacucucauauuagcacccacccgcguaguggcuagcgagauggccgaagcucugaaggguaugccuauuagguaccaaacaacggcaguuaaauccgagcauacuggcaaggagaucgucgaccuuaugugccacgccaccuucacaaugcgucugcucucaccagugcgggugcccaauuauaacaugaucauuauggaugaagcccauuuuaccgacccuucuagcaucgcugcgagaggguacauaaguacuagggucggaaugggcgaggcagccgcuauuuucaugacagccaccccgcccgguuccguagaagcauuuccacagagcaaugccgugauccaggaugaggaacgcgacauuccugagcgaucuuggaacucaggguaugaguggaucacggauuuccccggaaaaacuguuugguuugugccauccauaaagaguggcaaugacauugcuaacuguuugaggaaaaauggcaagcgggucauccagcugagcaggaagacauucgauaccgaauaccagaaaaccaagaacaacgacugggacuacgugguuacuacagauaucucggagaugggggcgaauuuccgcgccgaccgugugauugauccuagacggugccucaaacccgucauccugaaggacggaccagaaagggugauucuugcagguccgaugccuguaaccguggcuucugccgcacagcgccgaggcagaauagggcggaaccacaauaaagagggagaucaguauaucuacaugggccagccccuaaacaaugacgaggaucaugcccacuggacagaagcuaagaugcuguuggacaacauuaauacuccagaggguaucauccccgccuuauuugaaccugagagggaaaaguccgcggcaauugauggggaguaucgccugagaggcgaggccaggaaaacguucguugaacucaugcggcguggagaccugccagucuggcuuagcuacaagguggcuucagagggcuuucaauauagugaucgccgauggugcuucgacggggaaagaaacaaucaggugcuggaggaaaacauggaugucgagauauggaccaaagagggagaaaggaagaaacuccggccccgcugguuggacgccagaacauacucugacccucuggcucuaagggaguuuaaggaguucgcagccggucggcgauccguuagcggcgaucugauccucgagauugggaaacuuccgcagcaccugacucagagagcucaaaaugccuuagacaacuuggugaugcugcauaauucagaacagggaggccgcgcauauaggcacgcgauggaggagcucccagauaccaucgaaacacugaugcuucuggcccucauugcuguauugaccgguggggugacucuguuuuucuuaaguggccggggacuaggcaagacgagcaucgggcugcucugugucauggccuccucugugcuucuguggauggcaagcguugagccccauuggauagcugccuccaucauuuuggaauuuuuccugauggugcuccugaucccugagcccgaccgucagagaaccccacaggauaaccaacuugcauacgucguaauuggacuccuguuuaugaucuugacaguggccgcuaaugagaugggucuguuagaaacuaccaagaaagaccuaggcauagggcacguugcgguggagaaccaccaucacgccgcaaugcuggaugucgaccuccauccugcuucagccuggacacuuuacgccguggcaaccacuauuaucacacccaugaugaggcacacgauugaaaacaccacugcuaauaucucucugacagccauagcgaaccaggcugccaucuugaugggacuggauaagggcuggccaauuaguaaaauggacaucggugucccucuccuggcacuugggugcuauagccaggugaauccguuaacccugaccgccgcuguucucauguugguggcacauuacgccauuaucggccccggacugcaagcgaaggcuacacgcgaggcccagaaacggacugcagccggcauaaugaagaacccaacgguagaugggauuguggcuaucgaccuagauccugucguuuaugacgccaaguucgaaaaacagcugggacagaucaugcuccuuauucuguguaccagccaaaucuugcugaugcgaacaacuugggcacucugcgaguccauaacccuggcuacaggccccuuaaccacucuuugggaggguucuccagggaaguuuuggaauacgacaauugccgugucaauggcgaacaucuucagaggaagcuaccuggccggcgcaggucucgcuuucucccuaaugaaaagucugggcgggggaaggcgcggcaccggggcccagggagaaacuuugggcgagaaguggaaacggcagcugaaucagcucucuaagagcgaauuuaacaccuauaagagaucagguauuauggaggucgaccguuccgaagcaaaagaggggcuuaagaggggagagacaacuaaacacgcugugagucggggcaccgccaagcugcgcugguucguagaacgaaauuuggugaaaccugaggguaagguuaucgaucugggcugugggagaggaggcuggagcuacuauugcgccgggcucaagaaagugacagaagucaagggauacacgaaaggcggucccgggcacgaggaaccgauaccaauggcgaccuacggauggaacuuagugaagcugcauucuggcaaagacgucuuuuucaucccucccgagaagugugauacucuucugugcgacauuggcgaguccucaccaaaucccacaaucgaagaggggaggacccuacgggugcucaaaaugguugaaccuuggcugcgcggaaaccaauuuuguauuaagaucuugaauccguauaugcccagcguaguggagacucuggagcagaugcagagaaagcacgguggcaugcucgucaggaacccacuuucgcgaaauucuacacaugaaauguacugggugaguugcgggaccggaaacauuguuuccgcugugaauaugacgagccggaugcuguuaaaccguuucaccauggcacacagaaaaccuacauaugagcgcgaugucgaccugggcgccgguacuaggcacguggcuguagaacccgagguggccaacuuggauaucauagggcagcggauugaaaauaucaagcaugagcacaaaucaaccuggcauuacgacgaggauaacccuuauaagacaugggcauaccacggauccuaugaaguuaaaccaucuggcagcgccaguuccauggucaauggcguggugaagcuccugacuaagcccugggacgucaucccuaugguuacccaaauugcuaugacagauaccacuccauuugggcagcagagaguguucaaagagaagguagacacgcgcacacccaaagcgaagaggggaaccgcccaaauaauggaagugacugcaaaauggcuaugggguuuucuuagccgaaacaagaagccgcggaucuguaccagagaggaguucacaaggaaaguccgcucuaaugcugccauuggcgcaguguuuguugacgagaaccaguggaacucagccaaggaggcuguggaagaugagcguuucugggaccugguccaucgggaaagagagcuccacaaacaggggaagugcgccacgugcguguacaacaugaugggaaaaagggaaaagaagcugggcgaguuugguaaagcgaaggggagucgcgcaaucugguacaugugguugggagcccgauuccuggaguucgaagcucucggcuuuaugaaugaggaucacugguucucccgggaaaacagccuuucuggcguagagggggagggacugcauaaauuagguuauauucugagagacaucucgaagauaccuggcgggaauauguacgccgaugacaccgcaggaugggauacuaggaucacagaagacgauuugcagaacgaggcucgcauuaccgacaucauggaaccagagcacgcccuccuggcuaaaucaauuuuuaagcuaacuuaucaaaauaaaguugugagaguccagcggcccgccaagaacggcacagugauggaugugaucagcaggcgugaccagcgagguuccgggcaggucggaaccuacggccuuaauacauucacuaacauggaagcacaacugauacgccagauggagagugagggcauauuuucuccuagcgaacucgagaccccaaaccuggcggaaagaguuuuggauugguuagagaaguaugggguggaacggcugaaaaggauggccaucuccggagacgacuguguagugaagcccaucgaugaccgcuucgcuacggcccucaccgcacuuaaugauauggguaaagucagaaaggacauuccgcagugggagccuucaaaaggcuggaacgauuggcagcaagugcccuuuugcagucaucacuuccaccagcugauaaugaaggacgggcgggagaucguugugccauguaggaaucaggaugagcuagucggacgagcucgugugucucagggcgccgguuggagccugagagagacagcaugccucgggaaguccuacgcccaaauguggcaguugauguauuuucaucgccgggaccugaggcuugcggcuaacgccauuuguucagcaguaccuguugauuggauccccacuagcagaaccacauggucuauucacgcccaucaccaguggaugacuaccgaagacaugcuguccguguggaaucgcgucuggaucgaggaaaacccauggauggaggauaaaacgcauauaaguagcuggggagacgugcccuaccucggcaagcgggaggaccaauggugcggcucguuaaucgggcugacagcuagggccaccugggcaacuaauauucagguugcuaucaaccaggugcgaagauugauuggaaaugaaaacuaccuggauuauaugacauccaugaaacgguucaagaaugagucugacccugaaggugcccucugguga

SEQ ID NO: 13990 - RNA, 9879 nt, Artificial Sequence
  derived and/or modified CDS sequence (opt3) from DENV-1__EU482710__SS-prME
agcgugaccaugcugcucaugcuuaugcccaccgcccuggcuuuccacuugacuacgagaggaggggaaccucauaugaucguaaccaagcaggaaaggggaaaauccuuacuguuuaagacaucugccgguguuaacaugugcacuuuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaacacucguggaaaagcuggggcaaggccaaaaucauaggggcggacguccagaauacuaccuuuaucauugauggaccaaacacaccugaaugucccgacgaucagagagccuggaauaucugggagguggaggacuacggcuucgguauuuuuacuaccaacaucuggcuuaaguugagggauuccuauacacagguuugcgaccaucgucucaugucagcugcaauaaaagauaguaaggccgugcacgcugacaugggguacuggauugaaucugagaaaaaugaaacguggaagcuggcccgggcauccuucaucgagguaaagaccuguauuuggccaaaaucccauacucuauggucaaacggaguccuggaaagcgagaugaucauacccaagaucuauggcgguccuauuucucaacacaaucaccgaccaggcuacuucacacagaccgcggggccguggcaucucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguauggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaccuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgucagcuuguucccccuguguuuaaguaccacgucucagaagacaaccuggcucccggugcugcuuggcucccuggggugcaaaccuuugacuauguuucucauuacagagaauaagaucuggggaagaaaaagcuggccacugaacgaagguauaauggcuguuggcguggucucgauccuacugucaucucuucucaagaacgaugugccccuggccgggccuuugauugccggaggcauguuaaucgcuuguuauguaauuagugguuccagcgcagaccugucucucgagaaagccgcggaggugagcugggaagaggaagcugagcacuccggggccucacacaauauccuggucgaaguucaggaugacggaaccaugaagauaaaagaugaggagagggacgauacucuuacaauucuguugaaggcaacccuacuggccgugaguggcguguacccccucagcaucccagcuacgcuguucgucugguauuuuuggcaaaagaaaaagcagcgaucuggcgugcuuugggacacuccuucacccccagaaguugagcgcgcaguauuagaugacgggaucuaccggauuaugcagagaggacugcucgguaggagccaggugggcgucgggguguuccaagaaaacguuuuccauaccauguggcacgugacacguggagccgucuugauguaucagggcaaacgccuggagccgaguugggcgagcgugaagaaagaccucauauccuacggugggggauggcggcugcagggcucuuggaauaccggcgaggaaguacaggucaucgcuguggagccugggaagaaccccaagaauguucaaacagccccaggaacuuuuaaaacccccgaaggugaggugggcgcaauugcccuugauuucaagccugggacgucgggaagcccaaucgucaacagagaaggcaaaauugugggucuguaugggaauggaguugugacaacuucaggcaccuacgucuccgcuaucgcccaggcaaaggcuagucaggagggccccuugccugagauagaagacgagguguuuaggaaacgaaaccuaacaaucauggaucugcauccggggucuggaaagacccggcgcuaccucccagccauuguaagagaagcgaucaagaggaaauuacggacucugauucuugcccccacccgagugguugcaagcgagauggcugaagcccugaaggguaugccuaucagauaucaaacaacggcugucaaauccgagcacacuggcaaggagauaguggaccucaugugccaugcaaccuucacaaugcgcuugcugucaccagugaggguccccaauuacaacaugauuaucauggaugaagcccacuuuaccgacccuucuagcaucgccgcucguggguauauuaguacucggguaggaaugggcgaggcggcagccaucuucaugacagcuaccccgcccgguuccguggaagccuuuccacagagcaaugcaguuauacaggaugaggaaagagacauuccugagaggucuuggaacucaggguacgaguggaucacggauuuccccggaaaaacugugugguuugucccauccauuaagaguggcaaugacaucgccaacugucuccgcaagaauggcaaacgagugauacagcugagcagaaagacauucgauaccgaauaucagaaaaccaagaacaacgacugggacuacguugugacuacagauauuucggagaugggggcuaauuuucgggcggacagggucaucgauccucgccguugccuuaaacccgugauccuaaaggacggaccagaaagaguaauucuggccgguccgaugccugugaccguugcaucugcugcccagcggaggggccgcaucgggcgaaaccacaauaaggagggagaucaguauauuuacaugggccagcccuugaacaaugacgaggaucaugcacacuggacagaagccaaaauguuacuggacaacauaaauacuccagaggguaucauucccgcucucuucgaaccugagagagaaaaguccgccgcgaucgauggggaguaccggcugaggggcgaggcacgcaaaacguucgucgaacuuaugagaaggggagaccugccaguguggcucagcuauaagguggccucagagggcuuucaauacagugaucggcguuggugcuucgacggggaacgcaacaaucaggucuuggaggaaaacauggauguugagaucuggaccaaagagggagaacgaaagaaacugagacccagguggcuagacgcucggacauauucugacccucuggcccuccgcgaguuuaaggaguucgcugcagguagaagguccgugagcggcgaucuuauuucagagauagggaagcugccgcagcauuuaacucagcgggcccaaaaugcuuuggacaaccugguaaugcuccacaauagugaacagggaggccgagccuacagacacgcaauggaggagcugccagauaccaucgaaacacuuaugcugcucgcguugauugccgugcugaccgguggggucacuuuauuuuuccuaagcggccgcggacugggcaaaacguccaucgggcuccuuugugugauggcuucuagcguucuguuguggauggccuccguggagccccauuggauugcagcuucaaucauacuggaauuuuuccucaugguccugcuuaucccugagcccgacaggcagcggaccccacaggauaaccaacucgccuauguagugauuggacuguuguuuaugauccugacaguugcagccaaugagauggguuuacuagaaacuaccaagaaagaccugggcauugggcacguggcugucgagaaccaucaccaugcgacaaugcucgauguggaccuucacccugccucugcauggacccuguacgcugucgccacuacaaucauaacgcccaugaugcgucacaccauugaaaacacuacagccaauaucaguuugaccgcaauugcuaaccaggccgcgauccugaugggacucgauaagggcuggccaauaucgaaaauggacaucggugugccucugcuugcuuuagggugcuauagccagguuaauccgcugacccucacagccgcaguguugaugcugguagcccauuacgcuauuaucggccccggacuacaagcaaaggccacuagagaggcgcagaagaggacggcugccggcauuaugaaaaacccaaccguggaugggaucauagcaauugaccuggauccugucguuuacgacgccaaguucgaaaaacagcucggacagaucaugcuucugaucuuguguacaucccaaauucugcucaugcgcacuaccugggcucugugcgagucuaucacauuagccaccggcccccuuacuacgcugugggaggguucaccagggaaguuuuggaauacaaccauagcagugagcauggcuaacauuuuccggggauccuaucucgccggcgcgggucuagccuuuagucugaugaaaucuuugggcgggggacgaagaggcacuggggcacagggagaaacccugggcgagaaguggaagaggcagcucaaucagcuuagcaaaucagaguucaacaucuacaagcgcuccgguauuauggaggucgaccggagugaagcuaaagaggggcugaagagaggagagacaacucgucacgccgugagcaggggcaccgcaaaauugcggugguucguagaacgcaaucuggugaagccugaggguaagguuaucgaucucggcugugggcgaggaggcuggucuuauuacugcgcugggcuaaagaaggugacagaagucaaaggauauacgaagggcggucccgggcaugaggaaccgauaccaauggccaccuacggauggaaccuggugaaacuucacuccggcaaggacgucuuuuucacuccucccgagaaaugugauacacugcuaugcgacaucggcgagucaagcccaaaucccaccauugaagaggggagaacucucagggugcugaagaugguugaaccuugguugcggggaaaccaauuuuguaucaagauucugaauccguauaugcccucgguaguggagacacucgagcagaugcagcgcaaacacgguggcaugcuugucagaaacccacugucuaggaauaguacccaugaaauguacuggguguccugcgggacgggaaacaucguuagcgccgugaauaugaccucacgaauguuacugaaccgguucacaauggcgcaccguaagccuacuuacgagagagaugucgacuugggcgcugguacccgccauguggcaguagaacccgagguggccaaccucgauauuaucgggcagaggauagaaaauauuaaacacgagcauaaguccacauggcacuaugacgaggauaacccuuacaaaacuugggcuuaucacggaucuuacgaaguuaagccaagcggcagugccuccagcauggucaauggcguggugaagcugcuaaccaaacccugggacgucaucccuaugguuacacaaaucgcaaugaccgauacuacgccauuugggcagcagcggguguucaaggagaaaguagacacaagaacccccaaggccaaacgcggaacugcucaaauuauggaagugaccgcgagguggcuuugggguuuucugucucgaaacaagaagccgcggauauguacaagagaggaguucacgaggaaaguccgcucaaaugccgcaaucggcgcuguguuuguugacgagaaccaguggaauagugccaaggaggcaguggaagaugagcguuucugggaccucguccagaaagaacgggagcugcauaagcaggggaaaugcgcaaccugcguguauaacaugaugggaaagagagaaaagaaauugggcgaguuugguaaggcuaaaggguccagggccauuugguacauguggcugggagcgcgcuuccucgaguuugaagcacuuggcuucaugaaugaggaucacugguucagccgagaaaacucucugucgggcguagagggggagggauuacauaagcuggguuauaucuugcgggacauuucaaaaaucccuggcgggaauauguacgccgaugacacugcuggaugggauacaagaauaaccgaagacgaucuccaaaacgaggccaagaucacugacauuauggaaccagagcacgcacugcuagcuacaagcaucuuuaaacuuaccuaccagaauaagguugugaggguccagcgccccgccaagaacggcacagugauggaugugauuuccagacgggaccagagggguagugggcaagucggaacuuauggccugaauaccuucacgaacauggaagcucagcucauccgucagauggagucugagggcauauuucugccuagcgaauuggagaccccaaacuuagccgaacgaguucuggauuggcucgagaaauacgggguggaacgccuuaagagaauggcaauuuccggagacgacuguguagugaaacccaucgaugaccgguucgcgacagcccugacugcucuaaaugauauggguaaggucaggaaagacaucccgcagugggagccuucaaagggcuggaacgauuggcaacaggugcccuuuugcagucaccauuuccaccagcugauuaugaaggacgggcgcgagauaguugugccauguagaaaucaggaugaacucgucggacgggccagggugucucaaggcgcagguuggagcuugcgagagaccgcuugccuggggaaauccuaugcccagauguggcagcuuauguacuuucaucguagagaccugcgccucgcagccaacgcgaucuguucagcuguaccuguugauugggugcccacaagccggacuaccuggucuauucacgcccaucaccaauggaugacgacagaagacauguuauccgucuggaauaggguguggaucgaggaaaacccauggauggaggauaagacccacguuaguagcuggggagacgugcccuaucugggcaaaagagaggaccaguggugcggcucguugauugggcugacugcacgcgccacaugggcuuccaauauccaggucgccauaaaccaggugcggaggcucaucggaaaugaaaacuaccuugauuauaugaccucuaugaagcgauucaaaaaugagggugacccugaaggcgcacugugguga

SEQ ID NO: 13991 - RNA, 9879 nt, Artificial Sequence
  derived and/or modified CDS sequence (opt3) from DENV-1__EU482712__SS-prME
agcgugaccaugcugcucaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaauuauggcgguccuaucucccagcacaacuaccgaccaggcuacuuuacacaaaccgccgggccguggcaucugggaaagcucgagcuggauuucgaccuuugcgaaggcacuacagucgugguggaugagcacugcgggaauagaggacccaguuugaggaccacgacugucaccggcaaaauuauccacgaaugguguugccgcagcuguacacugccuccauuacgguuuaagggugaggacgggugcugguauggaauggagauuagacccguuaaggaaaaagaggaaaaccucgugaagucuaugguauccgcuggcucaggugagguggacaguuucagccugggccuucuguguaucucgauaaugauugaagaggucaugaggucccgcuggucucgaaaaauguugaugaccgggacucucgccgugcuguuucuacugaucaugggacagcucacauggaaugaucugauccggcuuugcauuaugguuggcgcaaacgcuagcgaccguauggggaugggaaccacauacuuggcccugauggcaacuuucaagaugagaccuauguuugccgugggcuuacucuucaggcgccugaccucacgggagguccuucugcuaacgaucggucucagucugguggcuuccguugaauugccaaauucucuggaggaauuaggggauggacucgcgaugggcauuaugauacugaaacuucugacagacuuucagagccaucaauugugggccacccuccugucccuaacuuucaucaagaccacauuuucacugcacuaugcauggaagacuauggcuauggugcuuagcauugucagucucuucccccuguguuugucuaccacgucccagaaaacaaccuggcugccgguauuacucggcagccuggggugcaagccucuuacuauguuucugaucgccgagaacaaaauuuggggaagaaagucguggccauugaacgaagguaucauggccgugggcauaguuucaauccuccugucuagucuacugaaaaaugaugugccccuugcugggccucucauugcaggaggcaugcugaucgccuguuacgucauuuccgguagcucugcggacuugagcuuagagaaggcugccgagguguccugggaagaggaagcagagcauucaggggccagucacaacauccugguagaagugcaggaugacggaacaaugaaaauaaaggaugaggagagggacgauacccucacuauucugcuuaaggcuacacuguuggcagucagcggcguuuauccccuaucuaucccagccacccuguucgugugguacuucuggcagaaaaagaaacaacgauccggcgugcucugggacacgccuucacccccagaagucgagcgcgcggugcuggaugacgggaucuaucggauuaugcagagaggacuuuuagguaggagucagguuggcguagggguguuucaggaaaaugucuuccauacuauguggcacgugacccguggagcuguucugauguaccaaggcaagcgccucgagccgagcugggccuccgugaaaaaggacuugauaucuuacggugggggauggcggcugcagggcucguggaacacaggcgaggaaguccaggugaucgcaguagagccugggaagaaucccaaaaacguccagaccgccccaggaacauuuaagacuagcgaaggugaggugggcgcuauugcccucgauuucaaacccgggaccucaggauccccuaucguuaauagagaaggcaagauugugggucuguaugggaacggagucgugacgacaaguggcacuuacguuucugcaaucgcucaagccaaagcgagccaggagggcccacuucccgagauagaagacgagguguuuaggaagcgaaaucugaccaucauggauuugcacccuggguccggaaagacacggcgcuaucuaccggccauugucagagaagcaaucaaaaggaagcugcggacccucauuuuagcuccaacucgagugguagccucagagauggcugaagcacugaaagguaugcccaucagauaccagaccacagccgugaagucugagcauacgggcaaagagauaguugaccuuaugugccacgccacuuucaccaugcgccugcucagcccugucagggugccaaacuauaauaugauuaucauggaugaagcucauuuuacagaccccaguuccaucgcggcacguggguacauuagcacccgggugggaaugggcgaggccgcugccaucuucaugacugcaacaccuccggguucugucgaagccuuuccccaaucaaacgcuguaauacaggaugaggaaagagacauuccagagagguccuggaauaguggguaugaguggaucaccgauuucccuggaaagacggugugguuuguucccagcauuaagucgggcaacgacaucgcgaauuguuugcgcaaaaacggcaagcgagugauacagcugucuagaaaaacuuucgauacagaauaccagaagaccaaaaacaaugacugggacuacgucgugaccacugauauuuccgagaugggggccaacuuccgggcagacaggguuaucgauccacgccguugccucaagccugugauccugaaggacggacccgaaagagucauucuugcugguccaaugccggugacaguagccagcgcagcccaacggaggggccgcaucgggcgaaaucacaacaaagagggagaucaguauauuuacaugggccagccucuaaauaacgacgaggaucaugcucacuggaccgaagccaagaugcuguuggacaauauaaacacacccgaggguaucauuccagcguuauuugaacccgagagagaaaaaucagcagccaucgauggggaguaucggcugaggggcgaggcucgcaagacuuucguggaacucaugagaaggggagaccugccuguuuggcuuaguuacaaagucgccucugagggcuuucaguauuccgaucggcguuggugcuucgacggggaacgcaauaaccaagugcuggaggaaaauauggauguggagaucuggacgaaggagggagaacgaaagaaacucagaccaaggugguuggacgcucggaccuacagcgacccccuggcacuacgcgaguuuaaagaguucgccgcugguagaaggucagucaguggcgaucugauucucgagauagggaaacuuccucagcaccugacacagcgggcccagaacgcauuagacaauuugguuaugcugcauaacagcgaacaaggaggccgagcguauagacacgccauggaggagcucccggauacuaucgaaacccugaugcuucuggcucucauugccguguugacaggugggguaacccuguuuuucuuauccggccgcggacuaggcaagacuucuaucgggcugcucugugugauggcaagcuccguccuucuguggauggcuucaguggagccacauuggauugccgcaucuaucauauuggaauuuuuccugaugguucuccugauccccgagccugacaggcagcggacgccccaggauaaucagcuugccuacguggucauuggacuccuguuuaugaucuugaccguagcugcgaacgagaugggucuguuagaaacaacuaaaaaggaccuaggcauugggcacguggccguugagaaccaccaucacgcagcuaugcuggauguggaccuccauccagccagugccuggacccuuuacgcagucgcuacaaccaucauaacuccuaugaugcgucacacaauugaaaauacgaccgccaacaucucgcugacugcgauugcuaaucaagccgcaaucuugaugggacuggauaaaggcuggcccauaagcaagauggacaucggugugccacuccuggcccuugggugcuauucccaggucaacccuuuaacacugaccgcugcagugcucauguugguugcccauuacgcgauuaucggcccgggacugcaggcuaaggccaccagagaggcacaaaagaggacagccgcuggcauuaugaagaaucccacuguggaugggaucguagccauagaccuagauccaguggucuaugacgcaaaauucgaaaagcagcugggacagauuaugcuccuuauccuguguacgucucagaucuugcugaugcgcaccacaugggcucucugcgagucaauuacucuggccaccggcccuuuaacaacccuuugggaggguagccccgggaaauuuuggaacacuacgaucgcgguuuccauggccaauauauuccggggaaguuaccuggcaggcgcuggucucgccuucucucuaaugaaaagccugggcgggggacgaagaggcacaggggcacaaggagaaaccuugggcgagaaguggaaaaggcagcugaaccagcucucaaaguccgaauuuaauacuuauaaacgcagugguauuauggagguggaccggagcgaagcuaaggaggggcuuaaaagaggagagaccacaaagcacgccgucucucguggcacugccaagcugaggugguucguggaacggaacuugguaaaaccagaggguaaggugaucgaucugggcugugggcgcggaggcugguccuacuauugcgcggggcucaaaaagguuaccgaagugaaaggauacacaaagggcgguccugggcacgaggaacccauuccgauggcuacguacggauggaauuuagucaaacugcauucaggcaaggacguguuuuucaucccaccugagaagugugauacccuucugugcgacauaggcgagagcucgcccaacccaacuaucgaagaggggcgaacacuaagaguccucaaaaugguggaacccuggcugaggggaaaucaguuuuguauuaagaucuugaacccuuauaugccgucuguuguagagacccuggagcaaaugcagcggaaacacgguggcaugcucgugcgcaauccccuuaguagaaacuccacucaugaaauguacugggucagcugcgggacaggaaauauugugucagcaguuaacaugaccuccaggaugcuguuaaaccgauucacgauggcccaccggaagccaaccuaugagcgugauguggaccugggcgcugguacaagacacgucgccguggaaccugagguagcaaauuuggauaucauugggcagcgcaucgaaaacauaaaacaugagcacaagucuacuuggcauuacgacgaggauaaucccuauaagaccugggccuaccacggaagcuaugaagugaaaccuaguggcuccgcuagcucuaugguuaacggcgucgugaagcuccugacaaaaccaugggacgugauucccauggucacucagaucgcgaugaccgauacaaccccuuuugggcaacagaggguuuucaaggagaaaguggacacucggacgccaaaggccaagagaggaacagcacagaucauggaaguaaccgcuaaauggcuaugggguuuucuuucacgcaauaagaaacccaggauuuguacucgagaggaguucacccggaaggugagaaguaacgccgcaauaggcgccgucuuuguggacgagaaucaauggaacuccgcuaaagaggccguugaagaugagagguucugggaccuggugcaucgcgaacgugagcuccacaagcaggggaagugcgcgacaugcgucuacaauaugaugggaaaacgggaaaagaaacugggcgaguuugguaaggcaaaagggagcagagccaucugguacaugugguugggagcuagguuccuggaguucgaagcccucggcuuuaugaacgaggaucacugguucucucgcgaaaauucgcuuucaggcguggagggggagggacugcauaaguuagguuauauucugcgagacaucagcaaaauuccgggcgggaacauguacgcagaugacacggcuggaugggauacccggaucacugaagacgauuugcagaaugaggccaagauaacagacaucauggaaccugagcacgcucuccuggccaaguccauuuuuaaacuaaccuaucagaacaagguaguuagagugcaaaggccagccaagaauggcacugucauggaugugaucagucgcagagaccagcgggguucuggacaggugggaacauacggccuuaacaccuucacaaacauggaagcgcagcugauuaggcaaauggagagcgagggcaucuuuucccccucagaacucgagacuccuaaucuggccgggcgugucuuggauugguuagaaaagcauggaguugagcgacugaaacgcauggcuauaaguggugacgacugugugguaaagccaauugaugacagauucgccaccgcacucacggcucuuaacgauaugggcaaggugcggaaagacaucccccagugggaaccgucuaagggguggaaugauuggcagcaggucccuuuuugcagccaccacuuccaucaacugaucaugaaagacggaagggagauugugguucccugucgcaaccaggaugagcuagugggcagagcccgggucucccagggugcaggguggucacugagggaaaccgccugccucggaaagagcuaugcgcagauguggcaauugauguacuuucaccgacgugaccugagacuugcugccaaugcaauauguucugccgugccaguagauuggguuccuacaucccgcacuaccuggaguauccaugcucaccaucaguggaugacaacugaggacaugcugagcguguggaaccgggucuggauugaagagaaucccuggauggaagauaaaacccacaucucguccuggggcgacgugccauaucucggcaagagggaggaccaguggugcgggucuuuaauuggacugacggccagagcaacaugggcuaccaacauccaaguugccauaaaucaggugcgccgguugaucgguaacgagaauuaccuggauuacaugacuucaaugaagagguucaaaaacgaaagcgaccccgagggcgcgcucugguga

SEQ ID NO: 13992 - RNA, 9879 nt, Artificial Sequence
  derived and/or modified CDS sequence (opt3) from DENV-1__EU249490__SS-prME
agcgugaccaugcugcuaaugcuuaugcccaccgcacuggcuuuccacuugacuacgaggggcggggaaccucauaugaucgucuccaagcaggaaagggggaaaucuuuacuguuuaagaccucagccgguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagacggacuuucgauacagaauaccagaaaaccaagaacaacgacugggacuacgucgugaccacugauaucuccgagaugggggccaauuuuagggcagaccgcguuaucgauccacguagaugccugaaaccugugauucucaaggacggacccgaacgggucauccuggcugguccaaugccggugacaguagccagcgcagcccaaaggcgcggccgaauugggagaaaccacaauaaggagggagaucaguauauauacaugggccagccucuuaacaaugacgaggaucaugcucacuggaccgaagccaaaaugcuacuggacaacaucaauacacccgaggguauuaucccagcguuguucgaacccgagcgggaaaagucagcagccaucgauggggaguauagguuacgcggcgaggcuagaaaaacuuuuguggaacugaugaggcggggagaccucccuguuuggcugaguuacaaggucgccucugagggcuuccaguauuccgaucgucgcuggugcuuugacggggaacgaaacaaucaagugcuugaggaaaacauggauguggagauuuggacgaaagagggagaaagaaagaaacugaggccacgguggcucgacgcucgcaccuacagcgaccccuuggcacugagagaguucaaggaauuugccgcugguaggcggucagucaguggcgaucuaauacuggagaucgggaagcucccucagcaccuuacacagcgagcccagaaugcacuggacaacuuaguuauguugcauaauagcgaacaaggaggcagagcguaucgccacgccauggaggagcugccggauacuauugaaacccucaugcugcuugcucugaucgccgugcucacaggugggguaaccuuguucuuucuguccggcaggggauuaggcaaaacuucuauugggcuacugugugugauggcaagcuccgcucuccuuuggauggccucagucgagccacauuggaucgcagccucuauaauccuggaguucuuuuugauggugcugcucauucccgagccugaccggcagcguacgccccaggauaaccagcuggcuuacguugugaucggacuucucuucaugauucugaccgucgcggccaaugagauggguuugcuggaaacaacuaagaaagacuuaggcaucgggcacguagcaguggagaaccaccaucacgcugccaugcuagauguugaccugcauccagccagugcauggacccucuacgcuguggccacaaccauaauuacuccuaugaugagacacacaaucgaaaacacgaccgcgaauauuucgcuuacugcuaucgccaaccaagcagccauacugaugggauuggauaagggcuggcccaucagcaaaauggacauuggugucccacugcucgcucuggggugcuauucccaggugaauccucuuacauuaaccgcagccguccugaugcucguggcgcauuacgcuaucauuggcccgggauugcaggccaaggcaaccagggaggcccaaaagcgcacagcugccggcaucaugaaaaaccccacuguugaugggauaguggcaauugaccuggauccaguaguguaugacgcuaaguuugaaaaacagcuaggacagaucaugcugcucauccuuuguacgucucagauucuguugaugcggaccacaugggcccugugcgagucaaucacucucgcgaccggcccucugacaaccuuaugggaggguagccccgggaaguucuggaauacuacgauagccgucuccauggcaaacauuuuccgaggaaguuaccuugcuggcgccggucuggcauuuucucucaugaaaagccuaggcgggggaagaaggggcacaggggcucaaggagaaacccugggcgagaaguggaagcgccaguugaaucagcugucaaaauccgaguucaacacuuauaagcggagugguaucauggagguugacagaagcgaagccaaagaggggcucaagcguggagagaccacaaaacacgccgugucuaggggcacugcgaaacuucggugguuugucgaacgcaaucuggugaagccagaggguaaaguaauugauuugggcugugggcgaggaggcugguccuacuauugcgcugggcugaagaaagugaccgaaguuaagggauacacaaaaggcgguccugggcacgaggaacccaucccgauggcaacguacggauggaaccucgugaaguuacauucaggcaaagacgucuucuuuauaccaccugagaagugugauacccugcuuugcgacaucggcgagagcucgcccaauccaacuauugaagaggggagaacacugagggugcuaaagauggucgaacccuggcuccggggaaaccaguucuguaucaaaauucugaauccuuauaugccgucugugguugagaccuuggagcaaaugcagcgcaagcacgguggcaugcugguaagaaacccccucaguagaaauuccacucaugaaauguacugggugagcugcgggacaggaaacaucgucucagccgugaauaugaccucccgaaugcuucugaaccgguuuacgauggcucaccguaaaccaaccuaugagagagauguugacuuaggcgccgguacacgccacguggcagucgaaccugagguggccaaccuggauauuaucgggcagaggauagaaaauauuaagcaugagcacaaaucuacuuggcauuacgacgaggauaaccccuauaagaccugggcuuaccacggaagcuaugaaguaaagccuaguggcuccgcgagcucuauggugaauggcguugucaaauugcucacaaagccaugggacgugauccccauggugacucagaucgccaugaccgauacaaccccuuucgggcaacagcgggucuuuaaagagaagguugacacuagaacgccaaaagcaaagcgcggaacagcucagauuauggaagugaccgccaaguggcugugggguuuccuaucaaggaacaaaaagccccgaauauguacucgggaggaauuuaccagaaaaguaaggaguaaugcagccaucggcgcuguguucgucgacgagaaccaauggaacuccgccaaggaggcgguggaagaugagcgcuuuugggaccuuguucaucgugaacgggagcugcacaaacaggggaagugcgcaacaugcguguacaacaugaugggaaagagagagaaaaagcucggcgaguucgguaaagccaaggggagcagggcuauuugguacauguggcugggagcccgcuucuuggaguuugaagcacugggcuucaugaaugaggaucacugguuuucucgagaaaacucgcucucaggcgucgagggggagggacuucauaaacuggguuauaucuuacgggacauuagcaagaucccgggcgggaauauguacgcugaugacacggccggaugggauaccagaauaacugaagacgaucugcagaacgaggcuaaaaucacagacauuauggaaccugagcacgccuugcucgcaaaguccaucuucaagcugaccuaucagaauaaagugguaaggguucaacgcccagcgaagaacggcacugugauggaugucauuaguagacgggaccagagggguucuggacaggugggaacauacggccuaaauaccuuuacaaacauggaagcccagcuuauccgucaaauggagagcgagggcauauucucccccucagaacuggagacuccuaaccucgcugggcgagugcuggauugguuggaaaaacauggagucgagcgcuuaaagagaauggccauuaguggugacgacuguguugugaaaccaaucgaugaccgguuugcaaccgcucugacggcccucaaugauaugggcaagguaaggaaggacaucccccagugggaaccgucuaaaggguggaacgauuggcaacaggugccuuucugcagccaccacuuucaucaacuuauuaugaaggacggacgcgagauagucgugcccuguagaaaucaggaugagcugguuggccgggcaagggugucccagggugccggguggucacuacgagaaaccgcgugccugggaaaaagcuaugcucagauguggcaacucauguacuuccaccguagagacuugcgccuggccgcaaacgccaucuguucugcugucccaguggauuggguaccuacaucccggacuaccuggaguauucaugcccaccaucaguggaugacaacugaggacaugcuuagcguuuggaauaggguguggaucgaagagaaccccuggauggaagauaagacccacauuucguccuggggcgacgucccauaucugggcaaaagagaggaccaguggugcgggucucucaucggauuaacggcacgcgcuacaugggccaccaauauacaaguggcgaucaaccagguucggaggcugauugguaaugagaacuacuuggauuacaugacuucaaugaagcgauuuaagaaugaaagcgaccccgagggcgcucugugguga

SEQ ID NO: 13993 - RNA, 9879 nt, Artificial Sequence
  derived and/or modified CDS sequence (opt3) from DENV-1__EU249491__SS-prME
agcgugaccaugcugcucaugcuuaugcccacagcacuggcuuuccacuugacuacgagaggaggggaaccucauaugaucgucuccaagcaggaaaggggaaaaucuuuacuguuuaagaccucagccgguguuaacaugugcacauuaauugccauggaccucggcgaacugugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaauugcucaagacagaggugaccaacccugccgugcugaggaaacuuugcauugaagcuaagaucucuaauacgaccacagauagccgguguccaacucaaggagaggccacccuggucgaagaacaggacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuaccacagagauccagcugaccgacuacggggcccucacucuugauuguagcccaaggacaggacuggacuucaacgaaauggucuugcuaacgaugaaggagaaaucuuggcuggugcauaagcagugguuucucgaucugccgcuucccuggaccuccggcgcaucaacuagccaagagacauggaaucggcaggaccuguugguaaccuucaaaacagcucacgccaagaagcaggaaguugugguccucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugugauguguacuggaucguucaaacuggagaaggaagucgcugagacccagcacgguacggugcuuguucagauaaaguacgagggcacagacgcgccuugcaaaaucccauucucgacccaagaugaaaagggggugacucagaacggacgcuugauuacagcaaaucccaucguaaccgacaaagagaagccugucaacauagaagccgagccacccuuuggcgagucuuauauugugaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguuuuuacauccguggggaaacuuguccaucagauuuucggaacggcguacggcgugcuguuuucugguguaagcuggaccaugaagauagggaucggcguguugcucacuuggcugggauuaaauucacgaaguacaucccugagcaugaccuguauugcuguuggccuagucacacucuaccugggggccauggugcaggcagauucuggaugcgugaucaacuggaaaggccgcgaacuuaagugugguucagggaucuucgucacuaaugagguucacaccuggacggaacaauauaaguuucaggccgacaguccgaaaagauugagcgcugccauuggaaaggcaugggaggagggcgugugcgguauaagguccgcuacacggcuggaaaacaucauguggaaacagauuucuaacgagcucaaucauauccuguuagaaaacgacaugaagcugaccgugguagucggcgauguggccgggauucuuggacagggcaaaaagaugauccgcccucaacccauggaguacaaauauucguggaaaagcugggggaaggcgaaaauaaucggagccgacgcucagaauacuaccuucauuaucgauggcccaaacacaccugaaugucccgacgaucagagagcauggaauauuugggagguugaggacuacgguuuugggaucuucacuaccaacauaugguugaagcucagggauuccuauacacaggugugcgaccaccgucugaugucagccgcuauuaaagauaguaaggccguccacgcagacaugggauacuggaucgaaucugagaaaaaugaaacguggaagcuagcgcgggccagcuuuauugaggugaagaccuguaucuggccaaaaucccauacucuguggucaaacggcguucucgaaagcgagaugauaauccccaagauuuaugguggcccuaucucucaacacaauuaccgaccaggguacuucacacagaccgcuggaccguggcaucugggcaaacuugaguuggauuucgaccugugcgaagggacuacagugguagucgaugagcacugcggaaacagaggccccuccuuaaggaccacgacugugaccgguaagauuauccacgaaugguguugccgcaguuguacacucccuccacugcgguuuagaggggaggacggaugcugguauggcauggagauaaggcccgugaaagaaaaggaggaaaaucuugucaagagcaugguuucugccgguuccggcgagguggacucauucagucugggguugcucuguauuagcaucaugaucgaagagguaaugcgcucgcgauggucccggaaaaugcugaugaccggaacucuagcaguguuuuuccugcucauuaugggccagcugacauggaacgaucuuauccguuugugcauuauggucggggcuaaugccucugacagaaugggaaugggcaccacauaccuggcauuaauggccacuuuuaagaugaggccuauguucgcugugggucuccuguuucgccggcuuaccagcagagagguucugcuacucacgauagggcugucauugguggcgagugucgaacugccaaacuccuuagaggaacucggagauggccuggccaugggcaucaugauucuuaaacuguugacagacuuccaaucucaucagcucugggcaacccugcuaagccugacuuuuaucaagaccacauucucccuucacuaugcuuggaaaacuauggccauggugcucucaauuguuagccuguuucccuugugucugaguaccacgucucagaagacaaccugguuaccggugcuccuggggucccuuggaugcaagccucugacuauguucuugaucgccgagaauaaaauaugggguaggaaguccuggccacucaacgaaggcaucauggcugucgggauuguaucgauccugcuaucaucucugcuuaaaaacgaugugccccucgcaggaccucugauugccggcgguauguugaucgcguguuacguuauaaguggguccagcgcugacuuaucucuggagaaggccgcagaggugagcugggaagaggaagccgagcauuccggagcuucacacaauauucucgucgaagugcaggaugacggcacaaugaaaaucaaggaugaggagcgagacgauacccugacuauccuucugaaagcaacauugcuagccguaaguggcguguauccccugagcauuccagcgacccucuuugucugguacuucuggcaaaagaagaaacagcgcucugggguucugugggacacgccuucacccccagaaguggagcgggcugugcuugaugacggaauauauagaaucaugcagagggguuuacugggccguagccaggucggggugggaguuuuccaagaaaacguauuucauacuauguggcacgugacccgcggcgccguccucauguaccaggguaagcgguuggagccgaguugggcaagcgugaaaaaggaccugauuuccuacgggggaggcuggagacucaggggcucuuggaauacaggggaggaaguucaggugaucgccgucgagccuggcaaaaaucccaagaaugugcagaccgcuccagguacauucaagacucccgaaggcgagguaggggccauugcacuggauuuuaaaccuggaaccucgggcagcccaaucgucaaccgagaagguaagauaguggggcuuuauggaaauggcguugugacgacaucaggcacuuacgucuccgcuaucgcccaagcgaaagccagucaggaggggccccugccugagauugaagacgagguguuccggaagcgcaacuugaccaucauggaucuacacccgggaucugguaaaacaagaagguaucugccagcaauuguucgggaagcuaucaagcgaaagcucagaaccuuaauacuggcccccacucgcguggucgcuagcgagauggcagaagcccuuaaaggcaugccuauuagguaccagaccacagccgugaaguccgagcauacggggaaagagaucguagaccugaugugccacgcuacuuuuaccaugcgucucuugucaccagugcggguucccaauuauaacaugaucauuauggaugaagcgcauuucacagacccuucuagcaucgcagccagaggauacauaaguaccagggucggcaugggugaggcugccgcaauuuuuaugacugccacaccgcccggguccguggaggcuuucccacaaagcaaugcggugauccaggaugaggaacgcgacauuccugagcgaucuuggaacucaggauaugaguggaucaccgauuuucccggcaagacggucugguucguaccauccauaaaaaguggcaaugacauugccaacugucugagaaagaaugggaagcgggugauccagcucagcaggaaaacuuuugauacagaauaccagaagaccaaaaacaacgacugggacuacguugugaccacugauaucucggagaugggagcaaauuuccgcgcugaccgugucauugauccuagacggugccugaagcccgugauccuuaaagacgguccagaaaggguuauucuagccggcccgaugccugugacagucgcaucugccgcucaacgccgagggagaauaggacggaaccacaauaaggagggcgaucaguauaucuacaugggucagccccugaacaaugacgaggaucaugcccacuggaccgaagcgaagauguuguuagacaacauuaauacaccagaggggaucauccccgcacuguucgaaccugagagggaaaaauccgccgcuguggauggcgaguaucgccucagaggagaggccaggaagacuuuuguagaacugaugcggcguggcgaccuuccaguguggcugagcuacaaaguugcuucagagggguuccaguauagugaucgccgauggugcuuugacggagaaagaaacaaucaaguccucgaggaaaacauggauguggagauuuggacgaaggagggugaaaggaaaaaguugcggccccgcuggcuggacgcaagaaccuacucugacccucuagcccugagggaguucaaagaauuugcugccggccggcgauccgugagcggggaucucauacuugagaucggaaagcugccgcagcacuuaacacagagagcacagaaugcguuggacaaccuggucaugcuccauaauucagaacaaggcggucgcgccuauaggcacgcuauggaggagcugccagauacuauugaaacccuuaugcugcucgccuugaucgcaguucugacagggggcgugaccuuauucuuucuaaguggacggggccuggggaagacuagcauuggacuccuuuguguaauggcuuccucugugcuguuguggauggccagcgucgagccccauuggaucgcagccuccauaauccuggaguucuuucucauggugcugcuuauuccugagcccgaccgucagagaacgccacaggauaaccagcucgcuuacguugugaucggucuguuguucaugauucugaccgucgcggccaaugagaugggcuuacuagaaacaacuaaaaaggaccuggggaucggacacguagcaguggagaaccaccaucacgcugccaugcucgauguugaccuucauccugccucagcauggacccuguacgcuguggccacaaccauaauuacucccaugaugaggcacacaaucgaaaacacgaccgcgaauauuucuuugacugcuaucgccaaccaagcagccauacugaugggccucgauaaagguuggccaaucaguaagauggacauuggggucccucugcuugcuuuaggcugcuauagccaggugaauccgcugacacucaccgcagccgucuugaugcugguggcgcauuacgcuaucauuggacccggccuacaggccaaagcaacccgcgaggcccaaaagcggacagcugccgggaucaugaagaacccaacuguugauggaauaguggcaauugaccuggauccuguaguguaugacgcuaaauuugaaaagcagcucggccagaucaugcuucugaucuuguguacgagccagauucugcucaugcgaaccacaugggcccugugcgaguccaucacuuuagcgaccgguccccuuacaacccugugggaggggucuccaggaaaauucuggaauacuacgauagccgucucaauggcaaacauuuuuagaggcagcuaccucgcuggugccggccuagcauucucccugaugaagagucuagggggaggcaggcgcgggacaggagcucaaggcgaaacccugggugagaaauggaagcggcagcucaaucagcuuucuaagagcgaguucaacacuuauaaaagaucagggaucauggagguugaccguuccgaagccaaggagggacugaaaaggggcgagaccacaaagcacgccgugagucgggguacugcgaaauugcgcugguuugucgaacgaaaucuggugaagccugagggcaagguaauugaucucggguguggaagaggcggguggagcuacuauugcgcuggacuaaagaaggugaccgaaguuaaaggcuacacaaagggugggcccggacacgaggaaccgaucccaauggcaacguacggcuggaaccuggugaaacuucauucuggcaaggacgucuucuuuauaccucccgagaaaugugauacccugcuaugcgacaucggggaguccucaccaaaucccacuauugaagagggaaggacacuccgggugcugaagauggucgaaccuugguugcgcgguaaccaguucuguaucaagauucugaauccguauaugcccagcgugguugagacccucgagcaaaugcagagaaaacacggcgggaugcuuguaaggaacccacugucgcgaaauucuacucaugaaauguacugggugaguugcggaacaggcaacaucgucuccgccgugaauaugaccagccggauguuacugaaccguuuuacgauggcucacagaaagccuaccuaugagcgcgauguugacuuggguacagggacuaggcacguggccgucgaacccgagguggcaaaccucgauauuaucggacagcggauagaaaauauuaaacaugagcacaagucaaccuggcauuacgacgaggauaacccuuauaaaacaugggccuaccacggcuccuaugaaguaaagccaucuggcagcgcuaguuccauggugaaugggguugucaagcugcuaacuaaacccugggacgugaucccuauggugacccagaucgcgaugacagauaccacuccauucggacaacagagagucuuuaaggagaaaguugacacgcgcacacccaaggccaaaagggguaccgcacagauuauggaagugacugcucgauggcuuuggggcuuccugagccggaacaagaagccgagaauauguaccagggaggaauuuacacgcaaaguacguucuaaugccgcaaucggggccguguucgucgacgagaaccaauggaacucagcuaaggaggccguggaagaugagcgguuuugggaccucguucauagagaaagggagcugcacaaacagggaaagugcgcgacgugcguguacaacaugaugggcaaacgcgaaaagaaguugggugaguucgggaaagcaaagggaagucgagccauuugguacauguggcugggcgcucgguuucucgaguucgaagcccuuggcuucaugaaugaggaucacugguuuuccagagaaaacagccugucuggggucgagggagaggguuuacauaaacugggcuauaucuugagggacauuucgaagaucccugggggaaauauguacgcagaugacaccgcuggcugggauacucgcauaacagaagacgaucuccagaacgaggccaaaaucaccgacauuauggaaccagagcacgcucugcuagccaaggcaaucuucaaacuuacuuaucagaauaaggugguaagaguucaacggcccgcgaagaacgguacagugauggaugucauuucaaggcgugaccagcgagggagcggacaggugggcaccuacggccugaauacauuuacuaacauggaagcccagcucauccgccaaauggaguccgaggggauauucaguccuucugaacuggagaccccaaacuuggcugaaagagccuuagauuggcuggagaaauauggaguggaacggcucaagaggauggcaauuagcggugacgacugugucguuaaacccaucgaugaccgcuuugcuacggcccuuaccgcacugaaugauaugggcaaggugagaaaagacaucccgcagugggagccuuccaagggguggaacgauuggcagcagguacccuucugcucacaucacuuucaccaacuaauuaugaaggacggacgggagauaguggucccauguaggaaucaggaugaacuggugggccgagcccguguuagucagggugcgggguggucucucagagagacagcuugcuugggaaaaagcuacgcccagauguggcaacugauguauuuccaucgccgggaccuuaggcuggcagccaacgcuaucuguuccgccgugccugucgauugggugcccacuucaagaaccacauggagcauucacgcacaucaccaguggaugacuaccgaagacaugcucucuguauggaaucgcguuuggaucgaggaaaacccauggauggaggauaagacgcauauuuccaguugggaggacgugcccuacuuaggcaaacgggaagaccaguggugcggcagccugaucggguugacagcuagggccaccugggcgacuaauauacaagucgcuaucaaccaggugcgaagacugauuggaaaugagaacuaccucgauuauaugacaucgaugaagcgguuuaaaaaugaauccgacccugagggugcccuuugguga

SEQ ID NO: 13994 - RNA, 9879 nt, Artificial Sequence
  derived and/or modified CDS sequence (opt3) from DENV-1__EU249492__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccagaugugcgaccaccgucucaugagugcagccauuaaagauucuaaggcugugcacgccgacaugggguacuggaucgaaagcgagaaaaaugaaacauggaagcuggcacgggcguccuucauugagguuaagacguguaucuggccaaaaucacauacccuauggagcaacggagugcuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacuguagucguggaugagcacugcgggaacagaggacccagucugaggacaaccacggugacuggcaagauuauccacgaaugguguugccgcagcuguaccuuaccuccacuccgguucaaaggugaggacgggugcugguauggaauggagauaagacccgucaaggaaaaggaggaaaaucugguuaaaucuaugguguccgcuggcucaggugagguagacaguuuuagccuuggccuguuguguauuucgaucaugaucgaagaggugaugaggucccgcuggucucgaaagaugcucaugacagggacccuggccgucuucuuucuacugauuaugggacagcucacuuggaacgaucugauccggcuuugcauuauggugggcgcaaaugcuagcgaccguauggggaugggaacaaccuacuuggcccugauggcaacauucaaaaugagaccuauguuugccguuggcuuacucuucaggcgccugacuucacgggaggugcuucugcuaaccauaggucucagucuggucgcuuccguggaauugccaaacucucuggaggaauuaggggauggacucgcgaugggcaucaugauucugaagcuucugacggacuuucaaagccaucaguugugggccacacuccuguccaugaccuucaucagaacuaccuuuucacuacacuaugcauggaaaacaauggcuaugguucugagcauugugagucuuuucccccucugucugucuacuaccucccagaagacgacaugguugccgguccuguuaggcagccucgggugcaagccucugaccauguuucuuaucgccgagaauaaaauauggggaaggaagucguggccacugaacgaagguaucauggccguaggcauugugucaaucuugcucucuagucugcuaaaaaacgauguuccccuggcugggccucuuauugcaggaggcaugcucaucgccuguuacgugauauccgguagcucugcggaccugagcuuggagaaggcugccgaggucuccugggaagaggaagcagagcauucaggggccagucacaauauuuuaguggaaguacaggaugacggaacuaugaaaaucaaggaugaggagcgagacgauacacugaccauccuccugaaagcuacucuucuggcagugagcggcgucuaucccuugucuauuccagccacacuauucguuugguacuucuggcaaaagaagaaacagcgcuccggcgugcugugggacaccccuucacccccagaagugcagcgggcgguccucgaugacgggauauauagaaucaugcagaggggacugcuuggucguagucaagugggcguugggguauuucaggagaacguguuccauacgauguggcacgucacucgcggagcuguguuaauguaccagggcaagcggcuggaaccgagcugggccuccguuaaaaaggaccucauuucuuacggugggggauggagauugcagggcucguggaauaccggcgaggaggugcaagucaucgcaguggaaccugggaaaaaccccaagaauguacagacagccccaggaaccuuuaagacaagcgagggugaagucggcgcuauugcccuggauuucaaacccgggacuucaggauccccuaucgugaacagggagggcaagauaguuggucucuaugggaauggaguggucaccacgaguggcacauacgugucugcaaucgcucaggccaaagcgagccaagaaggcccacugcccgagauugaggacgaaguuuuucgaaagcggaaccuuacuaucauggaucugcacccuggguccggaaaaacccgcagauauuugccggccauugugagggaggcaaucaagcggaagcuacgaacacugauacucgcuccaaccagagucguggccucagaaauggcugaggcauuaaaagguaugcccauucgcuaccagacuaccgccguaaagucugaacauacaggcaaagagaucguggaccugaugugccacgccacguucacuaugaggcuucugagcccuguucgugucccaaauuauaacaugaucauuauggaugaggcucauuuuaccgaccccaguuccaucgcggcacggggguacauaagcacaagagugggaaugggcgaagccgcugccauuuucaugaccgcaacuccuccggguucuguggaggccuuuccccagucaaaugcugucauccaggaugaagagagggacauuccagaacgcuccuggaacaguggguaugaguggaucacagauuucccuggaaagaccguaugguuugugcccagcauaaaaucgggcaaugacauugcgaacugucuccgaaagaauggcaagagaguuauccaauugucucggaaaacguucgauacugaguaccagaagacaaaaaacaacgacugggacuacguggucaccaccgauaucuccgaaaugggggccaauuucagggcagaccgcgugauugauccacguagaugccugaagccuguuauccucaaagacggacccgagcgggugauucuggcugguccaaugccggucacuguggccagcgcagcccagaggcgcggccgaauagggagaaaccacaauaaggaaggagaucaguauaucuacaugggccaaccucuuaacaaugacgaggaucaugcucacuggacagaggccaagaugcuacuggacaacauuaauacccccgaagguaucaucccagcguuguuugagcccgaacgggagaaaucagcagccauugauggggaauauagguuacgcggcgaggcuagaaagacauucguagagcugaugaggcggggagaccucccuguguggcugaguuacaaaguugccucugaaggcuuucaguauuccgaucgucgcuggugcuucgacggggagcgaaacaaucagguccuugaagagaacauggauguggaaauauggacuaaggagggagagagaaaaaagcugaggccacgguggcucgacgcucgcacguacagcgaccccuuggcacugagagaauuuaaagaguucgccgcugguaggcggucagugaguggcgaucuaauccuggaaauugggaagcucccucagcaccuuacccaacgagcccagaaugcacuggacaacuuagucauguugcauaauagcgagcagggaggcagagcguaucgccacgccauggaagagcugccggauacaaucgagacucucaugcugcuugcucugauugccguucucaccgguggggugacauuguuuuuccuguccggcaggggauuaggcaagaccucuaucgggcuacuguguguaauggcaagcuccgugcuccuuuggauggcuucagucgaaccacauuggauagccgcaucuaucauucuggaguuuuucuugauggugcugcucauccccgaaccugaccggcagcguacuccccaagauaaccagcuggccuacguugugauuggacuucucuuuaugauccugacggucgcugcgaaugagauggguuugcuggagaccacaaaaaaggacuuaggcauagggcacguagccguggaaaaccaccaucacgcagcuaugcuagauguugaccugcauccagccagugccuggacucucuacgcaguggcuaccacaauuaucaccccuaugaugagacacacuauugagaacacaacggccaauaucucgcuuaccgcgauagcuaaccaggccgcaauccugaugggauuggauaaaggcuggcccauuagcaagauggacaucggugucccacugcucgcccuggggugcuauucccaagugaauccucuuacuuuaacagcugcaguccugaugcucguggcccauuacgcgauuaucggcccgggauugcaggcuaaagccaccagggaagcacagaagcgcaccgccgcuggcauaaugaagaaccccacaguugaugggauuguggccaucgaccuggauccaguaguguaugacgcaaaauucgagaagcagcuaggacaaaucaugcugcucauucuuuguacuucucagauccuguugaugcggacgaccugggcucugugcgaaucaauaacacucgccacuggcccucugaccacauuaugggaggguagccccgggaaauuuuggaauaccacuauugcggucuccauggccaacaucuuccgaggaaguuaccuugcaggcgcuggucuggccuucucucucaugaagagccuaggcgggucaagaaggggaacgggcgcacagggggagacacugggagaaaaauggaagcgccaguugaaucaacuguccaagagugaguuuaacaccuauaaacggagcggcauuauggaaguugacagaucugaggcuaaggaaggucucaaacguggggagacuaccaagcacgccguguccaggggaacagccaaacuucggugguucgucgagcgcaaucuggugaagccagaaggcaagguaaucgauuuggguuguggccgagggggauggucauacuauugcgcgggccugaaaaaggugacugagguuaaaggguacaccaagggaggcccuggucacgaagagcccauaccgauggcuacauacggguggaaccucgugaaauuacauagcggaaaggacgucuuuuucaucccaccugaaaaaugugauacgcugcuuugcgacauuggcgagucgucucccaauccaaccaucgaggaaggcagaacucugagggugcuaaagauggucgagcccuggcuccgggggaaccaguuuuguauuaagauccugaauccuuauaugccgagugugguugaaacauuggagcagaugcagcgcaaacacggagguaugcugguaagaaacccccucuccaggaauagcacccaugagauguacugggugucaugcggcacugggaacauugucuccgcagugaauaugacaucucgaaugcuucugaaccgguucaccauggcccaccguaagccaacguaugaaagagauguugacuuaggagcuggcacccgccacguggccgucgagccugaaguggcaaaccuggauaucauaggucaaaggauugagaauaucaaacaugaacacaagagcacauggcauuacgacgaggauaaccccuauaaaacuugggccuaccacgggaguuaugagguaaagccuuccggaagcgcuucuucaauggugaauggcguugucaaguugcucaccaaaccaugggacgugauccccauggugacacagauugcgaugacugauaccacaccuuuuggccagcaacgggucuucaaggaaaaaguugacaccagaacuccaaaggccaaacgcgggacggcacagauaauggaggugacagcuaaguggcuguggggauuucuaaguaggaacaagaaaccccgaaucuguacccgggaagaguucacuagaaagguaagguccaaugccgcaauuggugccguguuugucgacgaaaaccaguggaauagcgcuaaagaggccguggaggaugaacgcuucugggaccuuguucaucgugagcgggaacugcacaagcagggcaaaugcgcgaccugcguguacaacaugauggggaagagagagaagaaacucggagaauuuggcaaggcaaaagguucuagggccaucugguacauguggcugggggcucgcuucuuggaguucgaggcccugggauuuaugaaugaagaucacugguucucgcgagagaacucacucagcggcgucgaaggcgaggggcuucauaagcugggauauauuuuacgggacaucuccaaaauaccggguggcaauauguacgcagaugacacagcugggugggauacgagaaucaccgaggacgaucugcaaaacgaagccaagauuacugacaucauggagccugaacacgcuuugcucgccaaaaguauuuuuaagcugacauaucagaauaaggugguaaggguucagcgcccagcaaaaaacggaaccgugauggaugucaucucuagacgggaccagaggggcagcggucaaguggggacuuacggacuaaauacauucaccaacauggaggcgcagcuuauacgucagauggaauccgagggcauuuuuucacccagugagcuggauacaccuaaccucgccggccgagugcuggacugguuggaaaagcauggggucgagcgcuuaaaaagaauggcuaucucuggagacgauuguguugugaagccaaucgacgaucgguucgccacugcacugaccgcucucaaugacauggguaaaguaaggaaggauauuccccagugggaaccgagcaagggcuggaacgacuggcaacaggugccuuuuugcucccaccacuuccaucagcuuauaaugaaagaugggcgcgagaucgucgugcccuguagaaaucaggacgaacugguuggacgggccagggugucacaaggcgcagguuggagccuacgagagacggccugccuggggaagucuuaugcgcagauguggcagcucauguacuuucaccguagagauuugcgccuggcugccaacgcaauuuguuccgccgucccaguggacuggguaccuaccagucggacaacuuggagcauccaugcucaccaucaauggaugaccacagaggauaugcuuucgguuuggaauaggguguggauugaagagaaccccuggauggaagacaaaacucacaucuccucuuggggagacgucccauaucugggcaagagagaggaucaguggugcggcucacucauaggguuaaccgcccgcgcaacgugggcuacaaauauccagguggccauuaaccagguucggaggcuguugggaaaugaaaacuaccuggacuacaugaccagcaugaaacgauucaagaaugagaguggucccgagggcgcgcucugguga

SEQ ID NO: 13995 - RNA, 9879 nt, Artificial Sequence
  derived and/or modified CDS sequence (opt3) from DENV-1__EU249493__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuacuauugcgcggggcugaaaaagguuaccgaagugaaaggauacacaaagggcgguccugggcacgaggaacccaucccgauggcuacguacggauggaaccucgucaaauuacauucaggcaaggacguguucuuuauaccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuauaugccgucuguuguagagaccuuggagcaaaugcagcggaaacacgguggcaugcuggugcgcaacccccucaguagaaauuccacucaugaaauguacugggucagcugcgggacaggaaacaucgugucagcaguuaauaugaccuccaggaugcuucugaaccgauuuacgauggcccaccggaagccaaccuaugagcgugauguggacuuaggcgcugguacaagacacgucgccguggaaccugagguagcaaaccuggauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgacaugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacacggcuggaugggauacccggauaacugaagacgaucugcagaacgaggccaagaucacagacauuauggaaccugagcacgcuuugcucgccaaguccaucuucaaacugaccuaucagaauaagguaguuagagugcaaaggccagccaagaacggcacugucauggaugugauuagucgcagagaccagcgggguucuggacaggugggaacauacggccuaaauaccuuuacaaacauggaagcgcagcuuaucaggcaaauggagagcgagggcauauucucccccucagaacuggagacuccuaaccucgccgggcguguccuggauugguuggaaaagcauggaguugagcgauuaaaacgcauggcuauuaguggugacgacugugugguaaagccaaucgaugacagauuugccaccgcacugacggcucucaaugauaugggcaaggugcggaaagacaucccccagugggaaccgucuaagggguggaacgauuggcagcaggucccuuucugcagccaccacuuucaucaacuuauuaugaaagacggaagggagauagugguucccugucgcaaucaggaugagcuggugggcagagcccgggucucccagggugcaggguggucacuaagggacaccgccugccugggaaagagcuaugcgcagauguggcaacucauguacuuccaccgacgugauuugagacuggcugccaacgcaaucuguucugccgugccaguagacuggguuccuacaucccgcacuaccuggaguauucaugcucaccaucaguggaugacaacugaagauaugcuuagcguguggaaucgggucuggaucgaggaaaaccccuggauggaggacaaaacccacauuucguccuggggcgacgugccauaucugggcaagagggaagaucaguggugcgggucucucaucggauuaacggccagagcaacaugggcuaccaauauacaaguugccaucaaccaggugcgccggcugauugguaaugagaacuacuuggacuacaugacuucaaugaagagguuuaaaaaugagagcgaucccgaaggcgcgcugugguga

SEQ ID NO: 13996 - RNA, 9879 nt, Artificial Sequence
  derived and/or modified CDS sequence (opt3) from DENV-1__EU249494__SS-prME
uccgugaccaugcugcucaugcuuaugcccaccgcccuggcuuuccacuugacuacgaggggaggggaaccucauaugaucgucaccaagcaggaaaggggaaaauccuuacuguuuaagacaucugcggguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggccaugguccaggcagauucuggaugcgugaucaacuggaaaggccgcgaacuuaagugugguucagggaucuucgugacuaaugagguccacaccuggacggaacaauauaaguuucaggccgacaguccgaaaagauugagcgcugccauuggaaaggcaugggaggagggcguuugcgguauaagguccgcuacacggcuggaaaacaucauguggaaacagauuucuaacgagcucaaucauauccuguuagaaaacgacaugaaguucaccguggugguaggcgaugucguggggauucuggcccagggcaaaaagaugauccgcccucaacccauggagcacaaauacucguggaaaagcuggggcaaggcgaagauaaucggggccgacguucagaauacuaccuuuauuaucgauggaccaaacacaccugaaugucccgacgaucagagagcuuggaauauuugggagguggaggacuauggcuucgguaucuuuacuaccaacauauggcuuaaguugagggauuccuacacacaggucugcgaccaccgucucaugucagcagccauuaaagauaguaaggcugugcaugccgacaugggguauuggaucgaaucugagaaaaaugaaacguggaagcuggcacgggcgagcuucauugagguuaagaccuguaucuggccaaaaucccacacucuauggucaaacggagugcuggaaagcgagaugauaauccccaagauuuacggcgguccuaucucucaacauaauuaucgaccaggcuacuucacacagaccgccgggccguggcaccucggaaaacuggagcuugauuuugacuugugcgaaggcacuacaguagucguggaugagcacugcgggaacagaggacccucccugaggaccacgacugugaccggcaagauuauccaugaaugguguugccgcaguuguacauuaccuccacuccgguucaaaggugaggacgggugcugguacggaauggagauaagacccgucaaggaaaaggaggaaaaucugguuaaaagcauggugucugcuggcuccggugagguagacucauuuagucuuggccuguuguguauuagcaucaugaucgaagaggugaugaggucgcgcuggucccgaaagaugcucaugaccgggacucuggccgucuuccuacugcucauuaugggacagcugacauggaacgaucuuauccgguugugcauuauggugggcgcaaaugcuucugaccguauggggaugggaaccacauaucuggccuuaauggcaacuuuuaaaaugagaccuauguucgccguuggccuccuguuuaggcgccuuaccagccgggaggugcugcuacucacgauaggucugucauuggucgcuaguguggaacugccaaacuccuuagaggaacucggggauggacuggcgaugggcaucaugauucuuaagcuguugacagacuuccaaucucaccagcucugggccacccugcuaagccugacuuuuaucaaaaccacacuuucccuccauuacgcauggaagacuauggcuaugguucugucaauugugagcuuguucccccuguguuuaaguaccacgucucagaagacaaccuggcucccgguccugcuuggcucccuggggugcaaaccuuugacuauguuucucaucgccgagaauaagauauggggaagaaaaagcuggccacugaacgaagguaucauggccguaggcgugguuucgauucuacugucaucucuucucaagaacgaugugccccuggcugggccuuugaucgcaggaggcauguuaauugccuguuaugucaucagugguuccagcgcggaccugucucucgagaaagcugccgaggugagcugggaagaggaagcagagcacuccggggccucacauaauauacugguagaagugcaggaugacggaacaaugaagauuaaagaugaggagagggacgauacccuuacuauccuguugaaggcuacacuacuggcagucaguggcguuuacccccucagcaucccagccacccuguucgugugguauuuuuggcaaaagaaaaagcagcgaucuggcgugcuuugggacacgccuucacccccagaagucgagcgcgcgguguuagaugacgggauuuaccggauaaugcagagaggacugcucgguaggagccagguuggcguagggguguuccaagaaaacgucuuccacacuauguggcacgugacccguggagcuguuuugauguaucagggcaaacgccuggagccgaguugggccagcgugaagaaagaccucaucuccuacggugggggauggcggcugcagggcucuuggaauacaggcgaggaaguccaggugauugcaguagagccugggaagaaccccaagaauguccaaaccgccccaggaacauuuaaaacucccgaaggugaggugggcgcuaucgcccuugauuucaagccugggaccucgggaagcccaauuguuaacagagaaggcaaaaucgugggucuguacgggaauggagucgugacgacaucaggcacuuauguuuccgcaauagcucaggccaaggcgagucaggagggccccuugccugagaucgaagacgagguguuuaggaaacgaaaccuaaccauuauggaucugcauccggggucuggaaagacacggcgcuaccucccagccaucgucagagaagcaauuaagaggaaauuacggacccugauccuugcucccacucgagugguagccagcgagauggcugaagcacugaaggguaugccuauaagauaucaaaccacagccgugaaauccgagcacacgggcaaggagauuguugaccucaugugccaugccacuuucaccaugcgcuugcugucaccagucagggugcccaauuacaacaugaucaucauggaugaagcucacuuuacagacccuucuagcauugcggcacguggguauaucaguacccgggugggaaugggcgaggccgcugccauauucaugacugcaacaccgcccgguuccgucgaagccuuuccacagagcaaugcuguaauucaggaugaggaaagagacaucccugagaggucuuggaacucaggguacgaguggauuaccgauuuccccggaaaaacggugugguuuguuccauccaucaagaguggcaaugacauagcgaacugucuccgcaagaauggcaaacgagugauucagcugagcagaaagacuuucgauacagaauaucagaaaaccaagaacaacgacugggacuacgucgugaccacugauaucucggagaugggggccaauuuucgggcagacaggguuaucgauccucgccguugccuuaaacccgugauucuaaaggacggaccagaaagagucauccuggcugguccgaugccugugacaguagccucugcagcccagcggaggggccgcauugggcgaaaccauaauaaggagggagaucaguacauauauaugggccagcccuugaacaaugacgaggaucacgcucacuggaccgaagccaaaauguuacuggacaacaucaauacaccagaggguauuauccccgcacucuucgaaccugagagagaaaaguccgcagccaucgauggggaguaccggcugaggggcgaggcucgcaaaacuuucguggaacuuaugagaaggggagaccugccaguuuggcucagcuauaaggucgccucagagggcuuucaauacagugaucggcguuggugcuucgacggggaacgcaacaaucagguguuggaggaaaacauggauguggagauuuggacgaaagagggagaacgaaagaaacugagacccagguggcuagacgcucggaccuauucugacccucuggcacuccgcgaguuuaaggaguucgccgcugguagaagguccgucagcggcgaucuuauacuggagaucgggaaguuaccgcagcauuugacacagcgggcccaaaaugcacuggacaaccucguuaugcugcacaauucagaacagggaggccgagcguacagacaugccauggaggagcuuccagauacuauugaaacccugaugcucuuggcucugaucgccguguuaacaggugggguaacccuauuuuuccugaguggccgcggacucggcaaaacuagcauugggcuucugugugugauggcauccucugucuugcuguggauggcuagcguggagccccacuggaucgccgcauccauaauccucgaauuuuuccugaugguucuucucauuccugagcccgacaggcagcggacgccacaggauaaccaacuggccuauguggucaucggauugcuguuuaugauuuuaaccguagcugcgaaugagaugggucuacuggaaacaacuaagaaagaccucggcaucgggcacguggccguugagaaccaucaccaugcaaccaugcuugauguggaccugcacccugcuucagccuggacauuguacgccgucgcaaccacuauaauuacacccaugaugcgucauacgaucgaaaacaccacugcuaauauuucucugacagccaucgcgaaccaggcugccauacucaugggacuggauaagggcuggccaaucaguaaaauggacauuggugugccucuuuuagcacuggggugcuacucgcaggucaauccgcucaccuugaccgccgcugugcugaugcuaguugcacacuaugccaucauuggccccggacugcaagcgaaggcuacaagagaggcccagaagaggacugcagccggcaucaugaaaaacccaacgguggaugggauaguagcuauugaccucgauccuguggucuacgacgccaaguucgaaaaacagcuuggacagaucaugcuguugauccuguguaccagccaaauucuccugaugcgcacaacuugggcauuaugcgaguccaucacccuugcuacaggcccccugaccacucucugggaggguucuccagggaaguuuuggaauacgacaauagccguuucaauggcgaacauuuuccggggaagcuaucuagccggcgcaggucuggcuuuuuccuugaugaaaagucugggcgggggacgaagaggcaccggggcccagggagaaacucucggcgagaaguggaagaggcagcuuaaucagcugucuaaaagcgaguucaacaucuacaagcgcucagguauuauggagguggaccgguccgaagcaaaagagggguugaagagaggagagaccacacgucacgcugucaguaggggcacugccaaacugcggugguucguggaacgcaaucucguaaagccugaggguaaggugaucgauuuaggcugugggcgaggaggcuggagcuauuacugcgccgggcugaaaaagguuaccgaagugaaaggauauacaaagggcggucccgggcaugaggaaccgauaccaauggcgacguacggauggaaccuugucaaacugcacucuggcaaggacguguuuuucaccccucccgagaaaugugauacucuacucugcgacaucggcgaguccucaccaaaucccacaauugaagaggggagaacccugagggucuugaagaugguggaaccuuggcugcggggaaaccaauuuuguaucaagauucucaauccguacaugcccagcguuguagagacucuugagcagaugcagcgcaaacaugguggcaugcuggugagaaacccauuaucgagaaauucuacacacgaaauguauugggucaguugcgggaccggaaacaucguguccgcuguuaauaugacgagccgaaugcuguugaaccgguucaccauggcacaccguaagccuacauacgagagagauguggaccucggcgccgguacucgccaugucgcuguggaacccgagguagccaaccuggauauuaucgggcagaggauagaaaauauuaaacacgagcauaagucaaccuggcacuaugacgaggauaacccuuacaaaacaugggcauaucauggauccuacgaagugaagccaucuggcagcgccaguuccaugguuaauggcgucgugaagcuacuuacuaaacccugggacgugaucccuauggucacccaaaucgcuaugacagauaccacuccauuugggcagcagcggguuuucaaggagaaaguggacacgagaacacccaaggcgaaacgcggaaccgcccaaauuauggaaguaacugcaagguggcugugggguuuucucagccgaaacaagaagccgcggauauguaccagagaggaguucacaaggaaagugcgcucuaaugcugccaucggcgcagucuuuguggacgagaaccaguggaacucagccaaggaggcuguugaagaugagcguuucugggaccuggugcagaaagaacgggaguugcacaagcaggggaaaugcgccacgugcgucuauaacaugaugggaaagagagaaaagaaacugggcgaguuugguaaggcgaaagggaguagggcaauuugguacauguggcucggagcccgcuuccuugaguuugaagcucugggcuucaugaaugaggaucacugguucucccgagaaaacagcuuaucuggcguggagggggagggacugcauaaguuggguuacauccuccgggacauuucgaaaaucccuggcgggaauauguaugccgaugacaccgcaggaugggauacuagaauaacagaagacgaucugcaaaacgaggcuaagaucaccgacauuauggaaccagagcacgcccuacuugcuacuucaaucuuuaaacugacauaccagaauaagguaguuagggugcagcgccccgccaagaacggcaccgucauggaugugauuagcagacgggaccagagggguuccgggcaagugggaacauauggccucaauacuuucaccaacauggaagcacagcugauccgucagauggagagugagggcauauuuucuccuagcgaauuggagauuccaaacuuagcggaacgaguccuggauuggcucgagaaauacgggguugaacgccuuaagagaauggccaucuccggagacgacugugugguaaaacccaucgaugaccgguucgcuacggcccugaccgcacuaaaugauauggguaaggugaggaaagacgucccgcagugggagccuucaaagggcuggaacgauuggcaacaggugcccuuuugcagucaucacuuccaccagcugauuaugaaggacgggcgcgagauaguugugccauguagaaaucaggaugaacucgucggacgggcuagggugucucaaggcgccgguuggagcuugcgagagacagcaugccuggggaaauccuaugcccagauguggcagcuuauguacuuucaucguagagaccugcgccucgcggcuaacgccaucuguucagcaguaccuguugauugggugcccacuagccggaccacauggucuauucacgcccaucaccaauggaugacuaccgaagacauguuauccgucuggaauaggguguggaucgaggaaaacccauggauggaggauaagacgcauguuaguagcuggggagacgugcccuaucugggcaaaagagaggaccaguggugcggcucguugauugggcugacagcucgcgccaccugggcauccaauauccaggucgcuauaaaccaggugcggaggcucaucggaaaugaaaacuaccuugauuguaugacuucuaugaagcgauucaaaaaugagggugacccugaaggcgcccugugguga

SEQ ID NO: 13997 - RNA, 9879 nt, Artificial Sequence
  derived and/or modified CDS sequence (opt3) from DENV-1__EU249495__SS-prME
agcgugaccaugcugcucaugcuuaugcccacagcccuggcuuuccacuugacuacgagaggcggggagccucauaugaucgucaccaagcaggaaaggggaaaauccuuacuguuuaagacaacugcagguguuaacaugugcacccuaauugccauggaccucggcgagcugugugaagauacaaugaccuacaaaugcccacggauaacugaggcggaaccggacgauguggacuguuggugcaaugcuacagauaccuggguaacguaugggacuuguucucaaaccggagagcaccgccgagacaagcguucaguggcccuugcaccccaugucggccuggguuuggagacaagaacugaaaccuggaugaguagcgagggggccuggaaacagauccagaggguggaaacaugggcucuccggcacccuggauucaccguuauugcacuguuucuggcccaugcuaucggcacguccauuacucagaagggcaucauauucauccucuuaaugcuggugacaccaucuauggccaugcgcugcgucgggauuggaucgagagauuuuguggagggucuuucaggcgcgaccuggguagacguuguguuggagcacgggagcugugucacuacaauggcaaaggauaaacccacccuggacaucgaacuacucaagacggaggugaccaacccugccgugcugaggaaacuuugcauugaagcuaagaucaguaauacaacuaccgauucccgguguccaacacaaggagaggccacucugauggaagagcaggacgcaaacuucgucugccgccgaaccuuuguugauagaggcugggguaauggguguggauuguucggcaaaggcucucucauaacaugcgcuaaguuuaagugcgugaccaaacuggaggggaagauuguacaguacgaaaacuuaaaauauagcgugaucgucacugugcacacgggagaccagcaucaaguugguaaugaguccacagaacacggcaccacugccaccauuacaccccaggcgccuaccucagagauccagcugacugacuacggggcccucacacuugauuguaguccaaggacgggacuggacuucaacgaaaugguguugcuaaccaugaaggagaaaagcuggcugguccauaagcagugguuucucgaucugccgcuucccuggacuucuggcgcauccacaucacaagagaccuggaaucggcaggaccuguuggugacauucaaaacugcucacgccaagaagcaggaaguaguugugcucgguagccaagagggggcuaugcacaccgcccugacgggcgcaaccgaaauccagacaaguggaacuaccacaauuuuugccggccauuuaaaaugccgucugaagauggauaaacuaacucucaaggggaugucuuaugucauguguaccggauccuucaaacuggagaaggaaguggcugagacgcagcacgguacaguccuugugcagauaaaguacgagggcaccgacgcgccuugcaaaaucccauucagcacucaagaugaaaaggggguuauucagaacggacgcuugaucacagcaaaucccauagugaccgacaaagagaagccuguaaacauugaagccgagccacccuuuggcgagucguauaucgucaucggugugggggaaaaagcucugaagcucucuugguucaagaaaggcuccucaauuggaaagauguuugaggccacugcaagaggcgccaggcggauggcuauccugggggauaccgccugggacuucggaaguauugguggcguuuuuacaagcguggggaaacuuguccaucagauauucggaacggcauacggcgugcuguuuuccgguguaucuuggaccaugaagaucgggauuggcguguugcucacuuggcugggauuaaauagccgaucaacaagucuguccaugaccuguaucgcgguuggccuagucacacucuaccugggggugauggugcaggcugauagcggaugcgucaucaacuggaaaggccgcgaacuuaagugugguucugggauuuucguuacuaaugaggugcacaccuggacggaacaauauaaguuucaggccgacucaccgaaaagauugagugcagccauaggaaaggcuugggaggagggcgugugcgguaucaggagcgccacacggcuggaaaacauuauguggaaacagaucuccaacgagcucaaucauauucuguuagaaaacgacaugaaguucaccguagucgugggcgauguuguggggauccuggcacagggaaaaaagaugauacgcccucaacccauggagcacaaauacucuuggaagucguggggcaaggcuaaaaucauuggggccgacguccagaauacuaccuuuaucauugauggaccaaacacaccugaaugucccgacgaucagagagcguggaauaucugggagguggaggacuauggcuucgguauauuuacuaccaacauuuggcuuaaguugagggauagcuacacacaggccugcgaccaccgucucauguccgcugcaaucaaagauucaaaggccguucaugcugacaugggguauuggauugaaagugagaaaaaugaaacguggaagcuggcccgggcaucuuucaucgaggugaagaccuguauauggccaaaaagccacacucuaugguccaacggaguacuggaaucagagauggucauccccaagauuuacggcgguccuaucagccaacauaauuaucgaccaggcuacuucacacagaccgcggggccguggcaccucggaaaacuggagcuugauuuugacuugugcgaaggcacuacagugguggucgaugagcacugcgggaacagaggacccucucugaggaccacgacuguuaccggcaagauuauccaugaaugguguugccgcuccuguacauuaccuccacuccgguucaaaggugaggacgggugcugguacggaauggagauaagacccgugaaggaaaaggaggaaaaucugguaaaaaguauggugagcgccggcucuggugaggucgacuccuuuucacuuggccuguuguguauuaguaucaugaucgaagaggugaugaggagccgcuggucgcgaaagaugcucaugaccgggacucuggcuguuuuccuacugcucauuaugggacagcugacauggaacgaucuuauccgguugugcauuauggugggcgccaaugcauccgaccguauggggaugggaaccacauaucuggcuuuaauggccacuuuuaaaaugagaccuauguucgcagucggccuccuguuuaggcgccuuaccucucgggaggugcugcuacucacgauaggucugagcuugguugccucaguggaacugccaaacaguuuagaggaacucggggauggacuggcuaugggcaucaugauucuuaagcuguugacagacuuccaaucccaccagcucugggcgacccugcuaucucugacuuuuaucaaaaccacacuuagccuccauuacgccuggaagacuauggcaaugguccuguccauuguaucauuguucccccuguguuuaagcaccacgagucagaagacaaccuggcucccggugcugcuuggcucucuggggugcaaaccuuugacuauguuucucaucgcugagaauaagauauggggaagaaaauccuggccacugaacgaagguaucauggccguuggcguggucagcauucuacugucgucacuucucaagaacgaugugccccuggccgggccuuugaucgcuggaggcauguuaauugcauguuauguaaucucugguaguuccgccgaccugagccucgagaaagcggcugaggugucuugggaagaggaagccgagcacagcggggcaucccauaauauacuggucgaaguucaggaugacggaacaaugaagauuaaagaugaggagagggacgauacccuuacuauccuguugaaggccacacuacuggcugugucaggcguguacccccucaguaucccagcaacccuguucgucugguauuuuuggcaaaagaaaaagcagcgaagcggcgugcuuugggacacgccuucucccccagaaguugagcgcgccguauuagaugacgggauuuaccggauaaugcagagaggacugcucgguaggucccaggugggcgucgggguguuccaagaaaacguuuuccacacuauguggcacgugacccguggagcggucuugauguaucagggcaaacgccuggagccgucaugggcuagugugaagaaagaccucaucagcuacggugggggauggcggcugcagggcuccuggaauacaggcgaggaaguacaggucauugccguggagccugggaagaaccccaagaauguucaaaccgcaccaggaacauuuaaaacucccgaaggugaggugggcgccaucgcucuugauuucaagccugggaccucuggaucgccaauugucaacagagaaggcaaaaucgugggucuguacgggaauggaguugugacgacaagcggcacuuaugucucagccauagcacaggcuaaggccucccaggagggccccuugccugagaucgaagacgagguguuuaggaaacgaaaccuaaccauuauggaucugcauccggggaguggaaagacacggcgcuaccucccagcgaucguaagagaagccauuaagaggaaauuacggacccugauccuugcacccacucgagugguugcuucugagauggccgaagcucugaaggguaugccuauaagauaucaaaccacagcagucaaaagcgagcacacgggcaaggagauuguggaccucaugugccaugccacuuucaccaugcgcuugcuguccccagugaggguccccaauuacaacaugaucaucauggaugaagcccacuuuacagacccuucaucuauugcugcgcguggguauaucagcacccggguaggaaugggcgaggcagccgcuauauucaugacugccacaccgcccgguaguguggaagcauuuccacaguccaaugccguuauucaggaugaggaaagagacaucccugagaggagcuggaacucuggguacgaguggauuaccgauuuccccggaaaaacggugugguuugucccaucaaucaaguccggcaaugacauagcuaacugucuccgcaagaauggcaaacgagugauucagcugaguagaaagacuuucgauacagaauaucaaaaaaccaagaacaacgacugggacuacguugugaccacugauaucagcgagaugggggcgaauuuucgggccgacagggucaucgauccucgccguugccuuaaacccgugauucuaaaggacggaccagaaagaguaauccuggcagguccgaugccugugacaguugcuucggccgcacagcggaggggccgcauugggcgaaaccauaauaaggagggagaucaguacauauauaugggccagcccuugaacaaugacgaggaucacgcccacuggaccgaagcuaaaauguuacuggacaacaucaauacaccagaggguauuauccccgcccucuucgaaccugagagagaaaagucugcggcaaucgauggggaguaccggcugaggggcgaggcccgcaaaacuuucgucgaacuuaugagaaggggagaccugccaguguggcucuccuauaagguggcuagcgagggcuuucaauacucagaucggcguuggugcuucgacggggaacgcaacaaucaggucuuggaggaaaacauggauguugagauuuggacgaaagagggagaacgaaagaaacugagacccagguggcuagacgcccggaccuauagugacccucuggcucuccgcgaguuuaaggaauucgcagccgguagaaggucuguguccggcgaucuuauacuggagaucgggaaguuaccgcagcauuugacacagcgggcucaaaaugcccuggacaaccucguaaugcugcacaauagcgaacagggaggccgagcauacagacaugcgauggaggagcuuccagauacuauugaaacccugaugcucuuggcccugaucgcuguguuaacagguggggucacccuauuuuuccugucaggccgcggacucggcaaaacuaguauugggcuucugugugugauggccagcuccguuuugcuguggauggcaucuguggagccccacuggaucgcugccagcauaauccucgaauuuuuccugaugguccuucucauuccugagcccgacaggcagcggacgccacaggauaaccaacuggcauauguagugaucggauugcuguuuaugauuuuaaccguugccgcuaaugagaugggucuacuggaaacaacuaagaaagaccucggcaucgggcacguggcggucgagaaccaucaccaugccaccaugcuugauguggaccugcacccugcauccgcuuggacauuguacgccgucgccaccacuauaauuacacccaugaugcgucauacgaucgaaaacaccacugcaaauauuucacugacagcuaucgccaaccaggcggcuauacucaugggacuggauaagggcuggccaaucucuaaaauggacauuggugugccucuuuuagcccuggggugcuacagucagguuaauccgcucaccuugaccgcagccgugcugaugcuaguagcucacuaugcaaucauuggccccggacugcaagccaaggcgacaagagaggcucagaagaggacugccgcaggcaucaugaaaaacccaacgguggaugggauagucgccauugaccucgauccuguuguguacgacgcuaaguucgaaaaacagcuuggacagaucaugcuguugauccuguguaccucgcaaauucuccugaugcgcacaacuugggccuuaugcgagagcaucacccuugcaacaggcccccugaccacucucugggaggguuccccagggaaguuuuggaauacgacaauagcugucucuauggccaacauuuuccggggaucauaucuagcgggcgccggucuggcauuuagcuugaugaaaucccugggcgggggacgaagaggcaccggggcucagggagaaacucucggcgagaaguggaagaggcagcuuaaucagcugaguaaaucugaauucaacaucuacaagcgcagcgguauuauggagguggaccggucagaagccaaagagggguugaagagaggagagaccacacgucacgcaguauccaggggcacugcuaaacugcggugguucguggaacgcaaucucguuaagccugaggguaaggugaucgauuuaggcugugggcgaggaggcuggaguuauuacugcgccgggcugaaaaaggucaccgaagugaaaggauauacaaagggcggucccgggcaugaggaaccgauaccaauggccacguacggauggaaccuugucaaacugcacagcggcaaggacguguuuuucaccccucccgagaaaugugauacucuacucugcgacaucggcgagucuuccccaaaucccacaauugaagaggggagaacccugaggguuuugaagaugguagaaccuuggcugcggggaaaccaauuuuguaucaagauucucaauccguacaugcccucaguggucgagacucuugagcagaugcagcgcaaacaugguggcaugcuggugagaaacccauuaagcaggaauucgacacacgaaauguauuggguuucuugcgggaccggaaacaucgugagugcggucaauaugacgucccgaaugcuguugaaccgguucaccauggcucaccguaagccuacauacgagagagauguggaccucggcgcagguacucgccauguagccguggaacccgagguugcuaaccuggauauuaucgggcagaggauagaaaauauuaaacacgagcauaagagcaccuggcacuaugacgaggauaacccuuacaaaacaugggccuaucauggaucauacgaagucaagccauccggcucugcaagcaguauggugaauggcguggucaagcuacuuacuaaacccugggacguuaucccuauggugacccaaaucgccaugacagauaccacuccauuugggcagcagcggguauucaaggagaaaguggacacgagaacacccaaggcuaaacgcggaaccgcgcaaauuauggaagucacugccagguggcugugggguuuucucucccgaaacaagaagccgcggauauguaccagagaggaauucacaaggaaagugcgcagcaaugcagcuaucggcgccguuuuuguggacgagaaccaguggaauucugcaaaggaggccgucgaagaugagcguuucugggaccuggugcagaaagaacgggaguugcacaagcaggggaaaugcgcuacgugcguauauaacaugaugggaaagagagaaaagaaacugggcgaguuugguaaggccaaagggucaagggcgauuugguacauguggcucggagcacgcuuccuugaguuugaagcccugggcuucaugaaugaggaucacugguucagucgagaaaacuccuuaagcggcguugagggggagggacugcauaaguuggguuacauccuccgggacauuucuaaaaucccuggcgggaauauguaugcugaugacaccgccggaugggauacuagaauaacagaagacgaucugcaaaacgaggcaaagaucaccgacauuauggaaccagagcacgcucuacuugccacuucgaucuuuaaacugacauaccagaauaagguggucagggugcagcgccccgcuaagaacggcaccgugauggaugucauuucaagacgggaccagagggguagcgggcaaguuggaacauauggccucaauacuuucaccaacauggaagcccagcugauccgucagauggaguccgagggcauauuuuugccuagugaauuagagacgccaaaccuggcagaacgagugcucgauuggcuugagaaacaugggguagaacgccugaagagaauggcgauuucuggagacgacuguguggucaaacccaucgaugaccgguucgccaccgcucuaacagcccugaaugauauggguaaggugaggaaagacaucccgcagugggagccuagcaagggcuggaacgauuggcaacagguucccuuuugcucccaccacuuccaucagcucauuaugaaggacgggcgcgagauaguggucccauguagaaaucaggaugaauuggugggacgggcaaggguaucacaaggcgcugguuggagucugcgagagacugccugccuugggaaaucuuacgcacagauguggcagcugauguauuuucaccguagagaccuccgcuuagccgcgaacgcuaucuguagcgccguuccuguggauuggguccccaccucccggacaacuuggucaauucaugcacaccaucaauggaugaccacggaagacaugcugagcguguggaauaggguuuggaucgaggaaaacccauggauggaggauaagacacacgugucuuccuggggagacguccccuacuugggcaaaagagaggaccaguggugcggcagucugauugggcucaccgcccgcgcuacuugggccagcaauauccagguggcaauaaaccagguacggaggcuuaucggaaaugaaaacuaucuggauuacaugacaucgaugaagcgauucaaaaaugagggugacccugaaggcgcucuaugguga

SEQ ID NO: 13998 - RNA, 9879 nt, Artificial Sequence
  derived and/or modified CDS sequence (opt3) from DENV-1__EU482794__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaauaugugcacucuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcguggguggcguuuuuacauccguggggaaacuuguccaucagaucuucggaacggcguacggcgugcuguuuucugguguaagcuggaccaugaagauugggauaggcguguugcucacuuggcugggauuaaauucacgaaguacaucccugagcaugaccuguaucgcuguuggccuagucacacucuaccugggggugauggugcaggccgauucuggaugcgucauuaacuggaaaggccgcgaacuuaagugugguucagggaucuucguuacuaaugaggugcacaccuggacggaacaauauaaguuucaggcagacaguccgaaaagauugagcgccgcuaucggaaaggccugggaggagggcgugugcgguauuagguccgcaacacggcuggaaaacauaauguggaaacagaucucuaacgagcucaaucauauucuguuagaaaacgacaugaaguucaccguagucgugggcgauguuguggggauccuggcucagggcaaaaagaugauucgcccucaacccauggagcacaaauacucguggaaaagcuggggcaaggccaagaucauaggggcggacguccagaauacuaccuuuaucauugauggaccaaacacaccugaaugucccgacgaucagagagccuggaauaucugggagguggaggacuauggcuucgguauuuuuacuaccaacaucuggcuuaaguugagggauuccuacacacagguuugcgaccaccgucucaugucagcugcaauaaaagauaguaaggccgugcaugcugacaugggguauuggauugaaucugagaaaaaugaaacguggaagcuggcccgggcauccuucaucgagguaaagaccuguauuuggccaaaaucccacacucuauggucaaacggaguccuggaaagcgagaugaucauacccaagaucuacggcgguccuauuucucaacauaauuaucgaccaggcuacuucacacagaccgcggggccguggcaccucggaaaacuggagcuugauuuugacuugugcgaaggcacuacagugguggucgaugagcacugcgggaacagaggacccucccugaggaccacgacuguuaccggcaagaucauucaugaaugguguugccgcaguuguacauuaccuccacuccgguucaaaggugaggacgggugcugguacggaauggagaucagacccgugaaggaaaaggaggaaaaucugguaaaaagcauggugucugccggcuccggugaggucgacucauuuagucuuggccuguuguguauaagcauuaugaucgaagaggugaugaggucgcgcuggucccgaaagaugcucaugaccgggacucuggcuguuuuccuacugcucaucaugggacagcugacauggaacgaucuuauucgguugugcaucauggugggcgccaaugcaucugaccguauggggaugggaaccacauaucuggcuuuaauggccacuuuuaaaaugagaccuauguucgcagucggccuccuguuuaggcgccuuaccagccgggaggugcugcuacucacgauuggucugucauugguugccaguguggaacugccaaacuccuuagaggaacucggggauggacuggcuaugggcauaaugauccuuaagcuguugacagacuuccaaucucaccagcucugggcgacccugcuaagccugacuuuuauuaaaaccacacuuucccuccauuacgccuggaagacuauggcaaugguccugucaaucgcuagcuuguucccccuguguuuaaguaccacgucucagaagacaaccuggcucccgguacugcuuggcucccuggggugcaaaccuuugacuauguuucucauuacagagaccaagaucuggggaagaaaaagcuggccacugaaugaagguauaauggccgugggcguugugucgauccuacugucaucucuucucaagaacgaugucccccuggccgggccuuugauugcuggaggcauguuaaucgcauguuaugugauuagugguuccagcgccgaccugucucucgagaaagcggcugagguaagcugggaagaggaagccgagcacuccggggcaucacauaacauccugguggucguucaggaugacggaacuaugaagauaaaagaugaagagagggacgauacacuuaccauucuguugaaggccacgcuacuggcugugaguggcguguacccccucagcaucccagcaacucuguucgucugguauuuuuggcaaaagaaaaagcagcgaucuggcgugcuuugggacaccccuucacccccagagguugaacgcgccguauuagaugacgggaucuaccggauuaugcagagaggacugcucgguaggagccaggugggcgucgggguguuccaagagaauguuuuccacacaauguggcacgugacccguggagcggucuugauguaucagggcaaacgccuggaaccgaguugggcuagcgugaagaaagaccucauauccuacggugggggauggcggcugcagggcucuuggaacacaggcgaggagguacaggucaucgccguggaaccugggaagaaucccaagaacguucaaacugcaccaggaaccuuuaaaacgcccgagggugaagugggcgccauugcucuugauuucaagccugggacaucgggaagcccaaucgucaauagagagggcaaaauugugggucuguacgggaacggaguugugacuaccucaggcacauaugucuccgccaucgcacaggcuaaggccagucaggaaggccccuugccugagauagaggacgaaguguuuaggaaacgaaaucuaaccaucauggaucugcauccggggucuggaaagacucggcgcuaccucccagcgauuguaagagaggccaucaagaggaaauuacggacccugauucuugcacccacacgagugguugcuagcgaaauggccgaggcucugaaggguaugccuaucagauaucaaacgacugcagucaaauccgaacacaccggcaaggagauaguggaccucaugugccaugccacauucaccaugcgcuugcugucaccagugaggguccccaacuacaauaugauuaucauggaugaggcccacuuuacugacccuucuagcaucgcugcgcguggguauauuaguacacggguaggaaugggcgaagcagccgcuaucuucaugaccgccacgccgcccgguuccguggaggcauuuccacagagcaacgccguuauacaggaugaagagagagacauuccugaaaggucuuggaacucaggguacgaguggaucacugauuuccccggaaaaacagugugguuugucccauccauuaagaguggcaacgacaucgcuaauugucuccgcaagaacggcaaacgagugauacagcugagcagaaagaccuucgauaccgaguaucagaaaacuaagaauaacgacugggacuacguugugacaaccgauauuucggaaaugggggcgaacuuucgggccgacagggucaucgauccucgccguugccuuaaacccgugauccuaaaggacggaccagagagaguaauucuggcagguccgaugccugugacaguugcuucugccgcacagcggaggggccgcaucgggcgaaauuacaacaaggaaggagaucaguauauuuacaugggccagcccuugaauaacgacgaggaucaugcccacuggacugaggcuaaaauguuacuggacaauauaaacacgccagaagguaucauucccgcccucuucgagccugaaagagagaaguccgcggcaaucgauggggaauaucggcugaggggcgaggcccgcaaaaccuucgucgagcuuaugagaaggggagaccugccaguguggcucagcuacaagguggcuucagaaggcuuucaauauagugaucggcguuggugcuucgacggggagcgcaauaaccaggucuuggaagagaauauggauguugaaaucuggacaaaagagggagagcgaaagaaacugagacccagguggcuagacgcccggacuuacucugacccucuggcucuccgcgaauuuaaggaguucgcagccgguagaagguccgugagcggcgaucuuauucuggaaauagggaaguuaccgcagcacuugacccagcgggcucaaaacgcccuggacaaucucguaaugcugcauaacucagagcagggaggccgagcauauagacacgcgauggaggaacuuccagauacaaucgagacccugaugcucuuggcccugauugcuguguuaacugguggggucacgcuauuuuuccugaguggccgcggacucggcaaaaccagcaucgggcuucugugugugauggccuccucuguuuugcuguggauggcaagcguggaaccccauuggauugcugccuccaucauacucgaguuuuuccugaugguccuucucaucccugaacccgacaggcagcggacaccacaggauaaucaacuggcauacguagugauuggauugcuguuuaugaucuuaacuguugccgcuaacgagaugggucuacuggagaccacaaagaaagaccucggcauugggcacguggcggucgaaaaucaccaucacgccaccaugcuugauguggaccugcauccugcaucagcuuggacuuuguacgccgucgccacaacgaucauaacccccaugaugcgucacacuauugagaacacaaccgcaaacaucucucugaccgcuauugccaaucaggcggcuauccucaugggacuggauaagggcuggccaauaaguaaaauggacaucggugugccucuuuuagcccuggggugcuauucgcagguuaacccgcucacauugacugcagccgugcugaugcuaguagcucauuacgcaauuaucggccccggacugcaagccaaggcgacgagagaagcucagaagaggaccgccgcaggcauuaugaaaaauccaacaguggaugggaucgucgccauagaccucgauccuguuguguaugacgcuaaguucgagaaacagcuuggacagauuaugcuguugauccuguguacuagccaaauccuccugaugcgcaccacaugggccuuaugcgaauccauuacccuugcaacuggcccccugacgacacucugggaggguucuccagggaaguuuuggaacaccacuaucgcugucucaauggccaauauauuccggggaagcuaccuagcgggcgccggucuggcauuuuccuugaugaaaagucugggcgggggacgaagaggcaccggggcucagggagagacacucggcgaaaaguggaagaggcagcuuaaccagcugucuaaaagcgaguucaauauuuauaagcgcucagguaucauggaaguggaccgguccgaggccaaagaaggguugaagagaggagagacuacccgucacgcaguaaguaggggcacagcuaaacugcggugguucguggagcgcaaccucguuaagccugaagguaaggugauugauuuaggcugugggcgaggaggcuggagcuacuauugcgccgggcugaaaaaggucacggaggugaaaggauacaccaagggcggucccgggcacgaggagccgaucccaauggccacuuacggauggaaucuugucaaacugcauucuggcaaggacguguuuuucacaccucccgaaaaaugugauacccuacucugcgacauaggcgaguccucaccaaaccccacuaucgaggaagggagaacacugaggguuuugaagaugguagagccuuggcugcggggaaaucaauuuuguauuaagauccucaacccguauaugcccagcguggucgaaacccuugagcagaugcagcgcaaacacgguggcaugcuggugagaaauccauuaucgaggaacucuacgcaugagauguacuggguuaguugcgggaccggaaauauuguguccgcggucaacaugacaagccgaaugcuguugaaucgguucacuauggcucaccguaagccuaccuaugaaagagauguggaccucggcgcagguacacgccacguagccguggagcccgaaguugcuaaccuggauaucauugggcagaggaucgagaacauaaaacaugaacacaagucaacuuggcauuacgacgaggauaauccuuauaaaaccugggccuaccacggauccuaugaggucaagccaucuggcagcgcaaguuccauggugaacggcguggucaagcuacuuacaaaacccugggacguuauuccuauggugacccaaaucgccaugacugauacgacaccauuugggcagcagcggguauucaaggaaaaaguggacaccagaacucccaaggcuaaacgcggaaccgcgcaaaucauggaggucacagccagguggcugugggguuuucucagccgaaauaagaagccgcggauuuguacgagagaagaguucaccaggaaagugcgcucuaacgcagcuauaggcgccguuuuuguggacgaaaaucaguggaacucagcaaaggaggccgucgaggaugaacguuucugggaccuggugcagaaagagcgggaauugcauaagcaggggaaaugcgcuacuugcguauacaauaugaugggaaagagagagaagaaacugggcgaauuugguaaggccaaagggaguagggcgaucugguacauguggcucggagcacgcuuccuugaguuugaggcccugggcuucaugaacgaagaucacugguucucccgagagaauagcuuaucuggcguugaaggggagggacugcacaaguuggguuauauucuccgggacaucucgaaaauuccuggcgggaacauguacgcugaugacacagccggaugggauaccagaaucacugaggacgaucugcaaaaugaagcaaagauaacagacaucauggagccagaacaugcucuacuugccaccucaauuuuuaaacugacauaucagaacaagguggucagggugcagcgccccgcuaagaauggcacugugauggaugucaucagcagacgggaccagagggguuccgggcaaguuggaaccuacggccucaacacguucaccaauauggaggcccagcugauucgucagauggaaagugagggcaucuuuuugccuucugaguuagaaacaccaaaccuggcagagcgagugcucgauuggcuugaaaaauaugggguagagcgccugaagagaauggcgauaagcggagacgacuguguggucaaacccauugaugaccgguucgccacugcucuaaccgcccugaacgauauggguaaggugaggaaagacaucccgcagugggaaccuuccaagggcuggaaugauuggcaacagguucccuuuugcucacaccauuuccaccagcucaucaugaaggacgggcgcgagauuguggucccauguagaaaccaggaugaguuggugggacgggcaaggguaagucaaggcgcugguuggucucugcgagaaacagccugccuugggaaaagcuacgcacagauguggcagcugauguauuuucaccguagagaccuccgcuuagccgcgaaugcuauauguuccgccguuccuguggauuggguccccacuucacggaccacguggagcauccaugcacaccaucaauggaugacaaccgaggacaugcugucuguguggaacaggguuuggauugaagagaauccauggauggaagauaagacucacguguccaguuggggagacguccccuacuugggcaaaagagaggaccaguggugcggcagccugaucgggcucacagcccgcgcuaccugggccucgaacauucagguggcaaucaaucagguacggaggcuuauaggaaacgagaauuaccuggauuauaugacuuccaugaagcgauucaaaaacgaaggugacccugagggcgcucuaugguga

SEQ ID NO: 13999 - RNA, 9879 nt, Artificial Sequence
  derived and/or modified CDS sequence (opt3) from DENV-1__EU482795__SS-prME
agcgugaccaugcugcucaugcuuaugcccacugcacuggcuuuccacuugacuacgagaggcggggaaccucauaugaucgucuccaagcaggaaagggggaaaucuuuacuguuuaagaccucagccgguguuaacaugugcacccugauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucagcggccaucugaagugccguuuaaaaauggauaagcugacacuaaaagggaugucguaugugauguguacuggaucuuucaagcucgagaaggaagucgccgagacccagcacgguacggugcugguucagauuaaauacgagggcacagacgcuccuugcaagauaccauuuuccacccaggaugaaaaaggggugacucaaaacggacgccuuaucacagcgaaucccauuguaaccgacaaggagaaaccugucaacaucgaagcagagccacccuucggcgagucauauauagugauuggugccggggaaaaggcuuugaagcugaguugguuuaaaaagggcagcuccaucggaaaaauguucgaggccacugcaagaggcgccaggcggauggcuauccucggggauaccgccugggacuuuggaucuauugguggcguuuucacaagcguggggaagcugguccaucagaucuuuggaacggcauacggcgugcuuuucucagguguaaguuggaccaugaaaauugggauaggcgugcuguugacuuggcucggacuaaauucccgaagcacaucuuuaucaaugaccuguaucgcgguuggccuggucacacuauaccucggggugauggugcaggcugauaguggaugcgucauuaacuggaagggccgcgaacugaagugugguagcgggaucuuuguuacuaaugaggugcacaccuggacggaacaguauaaauuccaagccgacuccccgaagagacuuucugcagccaucggaaaggcuugggaggagggcgugugcgguauuaggucggccacacgguuggaaaacauaauguggaagcagaucagcaacgagcugaaucauauucuccuggaaaacgacaugaaauuuaccguagucgugggcgauguugcagggaucuuagcucagggaaagaaaaugauucgcccucagcccauggaguacaaguauuccuggaagucauggggcaaagccaagaucauaggggcggacgugcaaaauacuaccuucaucauugauggaccaaacacaccugaaugucccgacgaucagagagccuggaauaucugggaggucgaggacuacggcuuugguauuuucacuaccaacaucuggcugaaacuuagggauaguuauacacaggugugcgaccaccguuugaugucugcugcaauaaaggauagcaaagccguucacgcugacaugggguacuggauugaauccgagaagaaugaaacguggaagcucgcccgggcaucauucaucgaggugaaaaccuguauuuggccaaagagccauacucuguggucuaacggaguacuagaauccgagaugaucauacccaaaaucuauggcgguccuauuagucagcacaauuaccgaccaggcuacuuuacacaaaccgcggggccguggcaucugggaaagcucgagcuggauuucgaccuuugcgaaggcacuacagucgugguggaugagcacugcgggaacagaggacccagcuugaggaccacgacugucaccggcaaaaucauucacgaaugguguugccgcucuuguacacugccuccauuacgguuuaagggugaggacgggugcugguauggaauggagaucagacccguuaaggaaaaagaggaaaaucucgugaaguccaugguaucagccggcaguggugagguggacagcuucucgcugggccuucuguguauauccauuaugaucgaagaggucaugaggucucgcuggagccgaaaaauguugaugaccgggacucucgcuguguuuuuccugcuaaucaugggacagcugacauggaacgaucucauucggcugugcaucaugguuggcgccaaugcaucagaccguauggggaugggaaccacauaccuugcuuugauggccacuuuuaagaugagaccuauguucgcagugggccuguuauuuaggcgccucaccagucgggagguccugcuucugacgauuggucuaucccucguggccucuguugaacugccaaacagcuuggaggaacugggggauggauuagcuaugggcauaaugauccucaaacugcuuacagacuuccagucccaucaacugugggcgaccuugcucucacugacuuuuauuaagaccacauucagccuacacuaugccuggaagacuauggcaauggugcugaguaucgucucucuucucccccuguguuuguccaccacgagccagaaaacaaccuggcugccgguauuacucggcucgcuggggugcaagccucuuacuauguuucugauugcugagaauaaaaucuggggaagaaagucauggccauugaacgaagguauaauggccgugggcaucguuucuauucuccugaguucccuacugaaaaacgaugugccccuugccgggccucucaucgcuggaggcaugcugauugcauguuacgucaucagcgguucuagcgccgacuuguccuuagagaaggcggcugaggugucaugggaagaggaagccgagcauaguggggcaagccacaauauacugguagaagugcaggaugacggaacaaugaaaauuaaggaugaggagagggacgauacccucacuauccugcuuaaggccacacuguuggcugucucuggcguuuauccccuauccaucccagcaacccuguucgugugguacuucuggcagaaaaagaaacaacgaucaggcgugcucugggacacgccuagucccccagaagucgagcgcgccgugcuggaugacgggauuuaucggauaaugcagagaggacuuuuagguaggagccagguuggcguagggguguuucaggaaaacgucuuccauacuauguggcacgugacccguggagcgguucugauguaccaaggcaagcgccucgagccguccugggcuucugugaaaaaggacuugaucucguacggugggggauggcggcugcagggcagcuggaauacaggcgaggaaguccaggugauugccguagagccugggaagaaccccaaaaauguccagaccgcaccaggaacauuuaagacuucagaaggugaggugggcgccaucgcucucgauuucaaacccgggaccuccggaaguccuauuguuaacagagaaggcaagaucgugggucuguaugggaauggagucgugacgacaucuggcacuuacguuagcgccauagcacaagcuaaagccucccaggagggcccacuucccgagaucgaagacgagguguuuaggaagcgaaaccugaccauuauggauuugcacccugggucaggaaagacacggcgcuaucuaccggcgaucgucagagaagccauuaaaaggaagcugcggacccucaucuuagcaccaacucgagugguagcuucugagauggccgaagcucugaaagguaugcccauaagauaccagaccacagcagugaaaagcgagcauacgggcaaagagauuguugaccuuaugugccacgccacuuucaccaugcgccugcucaguccugucagggugccaaauuauaacaugaucaucauggaugaagcccauuuuacagaccccuccagcauugcugcgcguggguacaucucuacccgggugggaaugggcgaggcagccgcuauauucaugacugccacaccuccggguucagucgaagcauuuccccaauccaaugccguaauucaggaugaggaaagagacaucccagagaggaguuggaacagcggguaugaguggauuaccgauuucccuggaaagacggugugguuuguucccucgaucaagucuggcaaugacauagcuaacuguuugcgcaaaaauggcaagcgagugauucagcuguccagacggacuuucgauacagaauaccagaaaaccaagaacaacgacugggacuacgucgugaccacugauaucagcgagaugggggcgaauuucagggccgaccgcguuaucgauccacguagaugccucaaaccugugauucugaaggacggacccgaacgggucauccuugcagguccaaugccggugacaguagcuucagccgcacaaaggcgcggccgaauugggagaaaccacaauaaggagggagaucaguauauauacaugggccagccucuaaacaaugacgaggaucaugcccacuggaccgaagcuaaaaugcuguuggacaacaucaauacacccgaggguauuaucccagccuuauuugaacccgagcgggaaaagagugcggcaaucgauggggaguauaggcugcgcggcgaggccagaaaaacuuucguggaacucaugaggcggggagaccugccuguuuggcuuucuuacaaggucgcuuccgagggcuuucaguauagcgaucgucgcuggugcuucgacggggaacgaaacaaucaagugcuggaggaaaacauggauguggagauuuggacgaaagagggagaaagaaagaaacucaggccacggugguuggacgcccgcaccuacucagacccccuggcucuaagagaguuuaaggaguucgcagccgguaggcggagugucagcggcgaucugauacucgagaucgggaaacuuccucagcaccugacacagcgagcucagaaugccuuagacaacuugguuaugcugcauaauuccgaacaaggaggcagagcauaucgccacgcgauggaggagcucccggauacuauugaaacccugaugcuucuggcccucaucgcuguguugacaggugggguaacccuguuuuucuuaucuggcaggggacuaggcaaaacuagcauugggcugcucugugugauggccuccucagcacuucuguggauggcuucugucgagccacauuggaucgccgcaaguauaaucuuggaauuuuuccugauggugcuccugauucccgagccugaccggcagcguacgccccaggauaaccagcuugccuacguugugaucggacuccuguuuaugauuuugaccgucgcugcgaaugagaugggucuguuagaaacaacuaagaaagaccuaggcaucgggcacguagccguggagaaccaccaucacgcagcuaugcuggauguugaccuccauccagccucggccuggacccuuuacgcaguggcuacaaccauaauuacuccuaugaugagacacacaaucgaaaacacgaccgccaauauuagccugacugcgaucgcuaaccaagccgcaauauugaugggacuggauaagggcuggcccaucuccaaaauggacauuggugucccacuccuggcccuugggugcuauucucaggugaauccuuuaacacugaccgcugcaguccucauguugguggcccauuacgcgaucauuggcccgggacugcaggcuaaggccaccagggaggcacaaaagcgcacagccgcuggcaucaugaaaaaccccacuguugaugggauaguggccauugaccuagauccaguaguguaugacgcaaaguucgaaaaacagcugggacagaucaugcuccuuauccuguguacgucacagauuuugcugaugcggaccacaugggcucucugcgagagcaucacucuggccaccggcccuuuaacaacccuuugggaggguucccccgggaaguuuuggaauacuacgauagcggucaguauggccaacauuuuccgaggaucuuaccuggcaggcgcuggucucgccuucagccuaaugaaaucacugggcgggggaagaaggggcacaggggcacaaggagaaaccuugggcgagaaguggaagcgccagcugaaucagcucuccaaaagugaauuuaacacuuauaagcggagcgguaucauggagguugacagaucugaagcuaaagaggggcuuaagcguggagagaccacaaaacacgccguguccaggggcacugccaagcugcggugguucgucgaacgcaauuuggugaagccagaggguaaaguaauugaucugggcugugggcgaggaggcuggucauacuauugcgcggggcucaagaaagugaccgaaguuaagggauacacaaaaggcgguccugggcacgaggaacccaucccgauggcuacguacggauggaacuuagugaagcugcauagcggcaaagacgucuuuuucauaccaccugagaagugugauacccuucugugcgacaucggcgagucgucucccaauccaacuauugaagaggggagaacacuaagggugcucaagauggucgaacccuggcugcggggaaaccaguuuuguaucaaaauuuugaauccuuauaugccgagugugguugagacccuggagcaaaugcagcgcaagcacgguggcaugcucguaagaaacccccuuuccaggaauagcacucaugaaauguacugggugucaugcgggacaggaaacaucgucuccgcagugaauaugaccucucgaaugcuguuaaaccgguucacgauggcccaccguaaaccaaccuaugagagagauguugaccugggcgcugguacacgccacguggccgucgaaccugagguggcaaacuuggauauuaucgggcagaggauagaaaauauuaagcaugagcacaaaagcacuuggcauuacgacgaggauaaccccuauaagaccugggccuaccacggaaguuaugaaguaaagccuuccggcagcgcuucuucaauggugaauggcguugucaaacuccugacaaagccaugggacgugauccccauggugacucagaucgcgaugaccgauacaaccccuuuugggcaacagcgggucuucaaagagaagguugacacuagaacgccaaaagccaagcgcggaacagcacagauuauggaagugaccgcuaaguggcuaugggguuuucuuaguaggaacaaaaagccccgaauauguacucgggaggaguucaccagaaaaguaagguccaaugccgcaaucggcgccguguuugucgacgagaaccaauggaauagcgcuaaggaggccguggaagaugagcgcuucugggaccugguucaucgugaacgggagcuccacaaacaggggaagugcgcgacaugcguguacaacaugaugggaaagagagagaagaagcugggcgaguuugguaaagcaaaggggucuagggccauuugguacaugugguugggagcucgcuuccuggaguucgaagcccucggcuuuaugaaugaggaucacugguucucgcgagaaaacucacuuagcggcgucgagggggagggacugcauaaauuagguuauauccugcgggacauuuccaagaucccgggcgggaauauguacgcagaugacacggcuggaugggauaccagaauaacugaagacgauuugcagaacgaggccaaaaucacagacauuauggaaccugagcacgcucuccuggccaagaguaucuuuaagcuaaccuaucagaauaaagugguaaggguucaacgcccagcaaagaacggcacugugauggaugucauuucuagacgggaccagagggguagcggacaggugggaacauacggccuuaauaccuucacaaacauggaagcgcagcugauccgucaaauggaguccgagggcauauuuucacccagugaacucgagacuccuaaccuggccgggcgaguguuggauugguuagaaaaacauggagucgagcgccugaagagaauggcuauuucuggugacgacuguguugugaaaccaaucgaugaccgguucgccaccgcacucacggcucuuaaugauaugggcaagguaaggaaggacaucccccagugggaaccgagcaaaggguggaacgauuggcaacaggugccuuuuugcucccaccacuuccaucaacugauuaugaaggacggacgcgagauagucgugcccuguagaaaucaggaugagcuaguuggccgggccagggugucacagggugcaggguggagccugcgagaaaccgccugccucggaaaaucuuaugcgcagauguggcaauugauguacuuucaccguagagaccugcgccuugcugccaacgcaaucuguuccgccgucccaguggauuggguaccuacaagucggacuaccuggagcauucaugcucaccaucaguggaugacaacugaggacaugcugucgguuuggaauaggguguggaucgaagagaaccccuggauggaagauaagacccacauuuccucuuggggcgacgucccauaucucggcaaaagagaggaccaguggugcgggucauuaaucggacugacggcccgcgcaacaugggcuaccaauauacaaguggccaucaaccagguucggagguugauugguaaugagaacuaccuggauuacaugacuagcaugaagcgauucaagaaugaaagugaccccgagggcgcgcucugguga

SEQ ID NO: 14000 - RNA, 9879 nt, Artificial Sequence
  derived and/or modified CDS sequence (opt3) from DENV-1__EU482796__SS-prME
agcgugaccaugcugcucaugcuuaugcccaccgcccuggcuuuccacuugacuacgagaggaggggagccucauaugaucgucaccaagcaggaaaggggaaaauccuuacuguuuaagacaucugccgguguuaauaugugcacuuuaauugccauggaccucggcgagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacugguagcuucaaacuggagaaggaaguggcugagacccagcacggaacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccauugggaaacuuguucaucagauauucggaacggcguacggcgugcuguuuucuggugucagcuggaccaugaagaucgggauuggcguguugcucacuuggcugggauuaaauucacgaaguacaucccugagcaugaccuguaucgcuguaggccuagugacacucuaccuggggguuaugguccaggccgauucuggaugcgugaucaacuggaaaggccgcgaacuuaagugugguucagggauuuucgugacuaaugagguccacaccuggacggaacaauauaaguuucaggcagacaguccgaaaagauugagcgccgcuauaggaaaggccugggaggagggcguuugcgguaucagguccgcaacacggcuggaaaacauuauguggaaacagaucucuaacgagcucaaucauauucuguuagaaaacgacaugaaguucaccguggugguaggcgaugucguggggauccuggcucagggcaagaagaugauacgcccucaacccauggagcacaaauacucguggaaaagcuggggcaaggccaaaaucauuggggcggacguucagaauacuaccuuuaucauugauggaccaaacacaccugaaugucccgacgaucagagagccuggaauaucugggagguggaggacuauggcuucgguauauuuacuaccaacauuuggcuuaagaugagggauuccuacacacaggucugcgaccaccguuugaugucagcugcaaucaaagauaguaaggccgugcaugcugacaugggguauuggauugaaucugagaaaaaugaaacguggaagcucgcccgggcauccuucaucgagguuaagaccuguauauggccaaaaucccacacucuguggucaaacggagugcuagaaagcgagaugaucauucccaagaucuacggcgguccuauuucucaacauaauuaucgaccaggcuacuucacacagaccgcggggccguggcaccugggaaaacucgagcuggauuuugaccuuugcgaaggcacuacaguagucguggaugagcacugcgggaacagaggacccuccuugaggaccacgacugugaccggcaagaucauacaugaaugguguugccgcaguuguacacugccuccauuacgguucaaaggugaggacgggugcugguacggaauggagauuagacccgucaaggaaaaggaggaaaaucucguuaaaagcauggugucugccggcuccggugagguagacucauuuagucugggccuucuguguaucagcaucaugauugaagaggugaugaggucgcgcuggucccgaaagauguugaugaccgggacucucgcugucuuccugcuacugaucaugggacagcucacauggaacgaucugauucggcuuugcauaauggugggcgccaaugcaucugaccguauggggaugggaaccacauauuuggcucugauggccacuuuuaaaaugagaccuauguucgcaguuggcuuacucuuuaggcgccugaccagccgggaggugcuucugcuaacgaucggucucucacuggucgccaguguggaauugccaaacucccuggaggaauuaggggauggacucgcuaugggcauuaugauccugaaacuucugacagacuuccaaucucaccaguugugggcgacccuccugagccuaacuuuuauuaaaaccacacugucccuucauuacgccuggaagacuauggcaaugguucucucaaucgugagccugauacccuugugucugaguaccacgucucagaagacaaccugguuaccgguccuccugggcucccuugggugcaaaccucugacuauguucuugaucgcugagaauaagauuuggggaagaaaaagcuggccacucaacgaagguaucauggccguaggcgugguuucgauucugcuaucaucucugcuuaagaacgaugugccccucgccgggccucugaucgcuggaggcauguugauagcauguuaugucauuagugguuccagcgccgacuuaucucuggagaaagcggcugaggugagcugggaagaggaagccgagcacuccggggcaucacauaauauccucguagaagugcaggaugacggaacaaugaagaucaaagaugaggagagggacgauacccugacuauucuucugaaggccacauugcuagcugucaguggcguuuacccccugagcauaccagcaacccucuuugugugguauuucuggcaaaagaaaaagcagcgaucuggcgugcugugggacacgccuucacccccagaagucgagcgcgccgugcuugaugacgggaucuaccggauuaugcagagaggauuacuggguaggagccagguuggcguagggguguuucaagaaaacgucuuccacacuauguggcacgugacccguggagcgguucucauguaucagggcaaacgcuuggagccgaguugggcuagcgugaagaaagaccugaucuccuacggugggggauggcggcuccagggcucuuggaauacaggcgaggaaguccaggugauugccguagagccugggaagaaccccaagaauguccaaaccgcaccaggaacauucaaaacucccgaaggugaggugggcgccaucgcucuggauuuuaagccugggaccucgggaagcccaauaguuaacagagaaggcaaaaucgugggucuuuacgggaauggagucgugacgacaucaggcacuuauguuuccgccauugcacaggcuaaggccagucaggagggcccccugccugagaucgaagacgagguguucaggaaacgaaacuugaccauuauggaucuacauccggggucuggaaagacacggcgcuaccugccagcgaucgucagagaagccauaaagaggaaacuccggaccuuaauucuggcacccacucgagugguagcuagcgagauggccgaagcucuuaaggguaugccuaucagauaucaaaccacagcagugaaauccgagcacacgggcaaggagaucguugaccugaugugccaugccacuuuuaccaugcgccucuugucaccagucagggugcccaauuacaacaugauuaucauggaugaagcccacuucacagacccuucuagcauagcugcgcguggguauauuaguacccgggugggaaugggcgaggcagccgcuaucuuuaugacugccacaccgcccgguuccgucgaagcauucccacagagcaaugccguaauucaggaugaggaaagagacaucccugagaggucuuggaacucaggguacgaguggauaaccgauuuucccggaaaaacggugugguucguuccauccauuaagaguggcaaugacaucgcuaacugucugcgcaagaauggcaaacgagugauccagcucagcagaaagacuuuugauacagaauaucagaagaccaagaacaacgacugggacuacgucgugaccacugauauuucggagaugggggcgaauuuccgggccgacaggguuaucgauccucgccguugccugaaacccgugauucuuaaggacggaccagaaagagucauacuagcagguccgaugccugugacaguagcuucugccgcacagcggaggggccgcaucgggcgaaaccauaauaaggagggagaucaguacauuuauaugggccagccccugaacaaugacgaggaucacgcccacuggaccgaagcuaaaauguuguuagacaacaucaauacaccagaggguaucauucccgcccuguuugaaccugagagagaaaaguccgcggcaauagauggggaguaccggcucaggggcgaggcccgcaaaacuuucguggaacugaugagaaggggagaccuuccaguuuggcugagcuauaaggucgcuucagagggcuuccaauacagugaucggcguuggugcuuugacggggaacgcaacaaucaggugcucgaggaaaacauggauguggagaucuggacgaaagagggagaacgaaagaaauugagacccagguggcuggacgcccggaccuauucugacccucuagcucugcgcgaguucaaggaauuugcagccgguagaagguccgucagcggcgaucucauucuugagaucgggaagcugccgcagcauuuaacacagcgggcucaaaaugccuuggacaaccugguuaugcuccacaauucagaacagggaggccgagcauacagacaugcgauggaggagcugccagauacuauugaaacccuuaugcugcucgccuugaucgcugugcugacaggugggguaaccuuauucuuucuaaguggccgcggacugggcaaaacuagcauagggcuccuuugugugauggccuccucuguccuguuguggauggcaagcguggagccccacuggaucgcugccuccauuauccuggaguucuuucucaugguucugcuuauuccugagcccgacaggcagcggacgccacaggauaaccaacucgcauauguggucaucggacuguuguucaugauacugaccguagccgcuaaugagauggguuuacuagaaacaacuaagaaagaccugggcauugggcacguggcgguugagaaccaucaccaugccaccaugcucgauguggaccuucacccugcaucagcuuggacacuguacgccgucgccaccacuaucauuacacccaugaugcgucauacgaucgaaaacaccacugcaaauauaucuuugacagcuaucgccaaccaggcggcuauucugaugggacucgauaagggcuggccaaucaguaaaauggacauuggugugccucugcuugccuuagggugcuacucgcaggucaauccgcugacccucaccgcagccguguugaugcugguugcucacuaugcaaucauaggccccggacuacaagccaaggcgacaagagaggcucagaagaggacugccgcaggcauuaugaaaaacccaacgguggaugggaucguagccaucgaccuggauccuguggucuacgacgcuaaguuugaaaaacagcucggacagauuaugcuucugaucuuguguaccagccaaauacugcucaugcgcacaacuugggcccugugcgaguccauuaccuuagcaacaggcccccuuaccacucugugggaggguucuccagggaaguucuggaauacgacaaucgcuguuucaauggccaacauuuuucggggaagcuaucucgcgggcgccggucuagcauucucccugaugaaaaguuugggcgggggacgaagaggcaccggggcucagggagaaacucugggcgagaaguggaagaggcagcucaaucagcuuucuaaaagcgaauuuaacaucuacaagcgcucagguauaauggagguggaccgguccgaagccaaagaggggcugaagagaggagagaccacacgucacgcagucaguaggggcacugcuaaauugcggugguucguggaacgcaaucugguaaagccugaggguaaggugaucgaucucggcugugggcgaggaggcuggagcuauuacugcgccgggcuaaagaagguuaccgaagugaaaggauauacaaagggcggucccgggcaugaggaaccgauuccaauggccacguacggauggaaccuggucaaacuucacucuggcaaggacguguucuuuaccccucccgagaaaugugauacucugcuaugcgacaucggcgaguccucaccaaaucccacaauugaagaggggagaacccucaggguccugaagaugguggaaccuugguugcggggaaaccaauucuguaucaagauucugaauccguacaugcccagcguuguagagacucucgagcagaugcagcgcaaacaugguggcaugcuugugagaaacccacugucgagaaauucuacacacgaaauguauugggucaguugcgggaccggaaacaucguguccgcgguuaauaugacgagccgaauguuacugaaccgguuuaccauggcucaccguaagccuacauacgagaaagauguggacuugggcgcagguacuagacaugucgccguggaacccgagguagcuaaccucgauauaauugggcagcgcaucgaaaauaucaagcacgagcauaaaucaaccuggcacuaugacgaggauaacccuuacaagacaugggccuaucauggauccuacgaagugaagccaucuggcagcgcaaguuccaugguuaauggcgucgugaaacugcuaacuaagcccugggacgugauuccuauggucacccaaauagccaugacagauaccacuccauucgggcagcagaggguuuuuaaagagaagguggacacgcggacacccaaagcuaagagaggaaccguacaaaucauggaagugacugcgcgcuggcuuugggguuuccugagcaggaacaagaaaccgcgaauuuguacccgggaggaauuuacaagaaaggucaggucuaaugccgcaaucggcgcuguguucguugacgagaaccaguggaacucagccaaagaggcaguggaagaugagcgcuuuugggaccucgucaagaaagaacgugagcugcacaagcaggggaagugcgccacgugcguguauaacaugaugggaaaacgggaaaagaaauugggcgaguucgguaaggcuaaagggaguagagccauuugguacauguggcugggagcgagguuucucgaguucgaagcacuuggcuuuaugaaugaggaucacugguucucccgcgaaaacagccugucuggcguagagggggagggauuacauaagcuggguuacaucuugcgagacauaucgaaaaucccuggcgggaauauguaugccgaugacaccgcuggaugggauacucggauuacagaagacgaucuccagaacgaggccaagaucaccgacauuauggaaccagagcacgcacugcuagcuacuucaaucuucaaacuuacauaccaaaauaaaguugugagaguccagaggcccgccaagaacggcaccgugauggaugugauaagccgcagagaccagcgggguuccgggcaggucggaacauauggccugaauacuuuuaccaacauggaagcucaacucauuaggcagauggagagugagggcaucuuccugccuucugaauuggagacgccaaacuuagccgaacguguucuggauuggcucgagaaauacgggguggaacgacuuaagcgcauggcaaucagcggagacgacuguguagugaaacccauugaugacagauuugcgaccgcccugacagcucuaaaugauauggguaagguccggaaggacauaccgcagugggagccuuccaaaggcuggaacgauuggcagcaagugcccuucugcucacaucacuuucaccagcugaucaugaaggacgggagggagauuguugugccaugucgcaaucaggaugaacucgucggaagggcacgggugagucagggcgcagguuggucuuugagggagacugcuugccuggggaaaagcuaugcccaaauguggcagcuuauguacuuccaucgacgugaccugagacucgcagccaacgcgaucuguuccgcuguaccuguugauugggugcccaccucacgcacaacuuggagcauucacgcccaucaccaguggaugaccacggaagacauguuaucugucuggaaucggguguggaucgaggaaaacccauggauggaggauaagacacauguuuccaguuggggagacgugcccuaucugggcaaaagggaggaccaauggugcggcagcuugauagggcugaccgcaagagccacuugggcuucgaauauccaggucgccauuaaccaggugcgccggcucaucggaaaugaaaacuaccuugauuacaugacauccaugaagagguuuaagaaugagggugacccugaaggcgcacugugguga

SEQ ID NO: 14001 - RNA, 9879 nt, Artificial Sequence
  derived and/or modified CDS sequence (opt3) from DENV-1__EU482797__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuacuauugcgcggggcugaaaaagguuaccgaagugaaaggauacacaaagggcgguccugggcacgaggaacccaucccgauggcuacguacggauggaaccucgucaaauuacauucaggcaaggacguguucuuuauaccaccugagaagugugauacccugcuuugcgacaucggcgagagcucgcccaauccaacuauugaagaggggcgaacacugagaguccuaaaaaugguggaacccuggcucaggggaaaccaguucuguaucaagauucugaauccuuauaugccgucuguuguagagaccuuggagcaaaugcagcggaaacacgguggcaugcuggugcgcaacccccucaguagaaauuccacucaugaaauguacugggucagcugcgggacaggaaacaucgugucagcaguuaauaugaccuccaggaugcuucugaaccgauuuacgauggcccaccggaagccaaccuaugagcgugauguggacuuaggcgcugguacaagacacgucgccguggaaccugagguagcaaaccuggauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaaguugcucacaaaaccaugggacgugauccccauggucacucagaucgcgaugaccgauacaaccccuuucgggcaacagaggguuuuuaaggagaaaguggacacucggacgccaaaggccaagagaggaacagcacagauuauggaaguaaccgcuaaauggcugugggguuuccuaucacgcaacaagaaacccaggauauguacucgagaggaauuuacccggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgacaugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacacggcuggaugggauacccggauaacugaagacgaucugcagaacgaggccaagaucacagacauuauggaaccugagcacgcuuugcucgccaaguccaucuucaaacugaccuaucagaauaagguaguuagagugcaaaggccagccaagaacggcacugucauggaugugauuagucgcagagaccagcgggguucuggacaggugggaacauacggccuaaauaccuuuacaaacauggaagcgcagcuuaucaggcaaauggagagcgagggcauauucucccccucagaacuggagacuccuaaccucgccgggcguguccuggauugguuggaaaagcauggaguugagcgauuaaaacgcauggcuauuaguggugacgacugugugguaaagccaaucgaugacagauuugccaccgcacugacggcucucaaugauaugggcaaggugcggaaagacgucccccagugggaaccgucuaagggguggaacgauuggcaacaggugccuuucugcagccaccacuuucaucaacuuaucaugaaagacggaagggagauuguugugcccugucgcaaucaggaugagcuggucggcagagcccgggugucccagggugcaggguggucacuaagggaaaccgccugccugggaaagagcuaugcgcagauguggcaacucauguacuuccaccgacgugacuugagacuggcugccaacgcaauauguucugccguaccaguugauugggugccuacaucccgcacuaccuggaguauccaugcucaccaucaguggaugacaacugaggacaugcuuagcgucuggaaucggguguggauugaagagaaccccuggauggaagauaaaacccacaucucguccuggggcgacguuccauaucugggcaagagggaggaccaguggugcgggucucucauuggauuaacggccagagcaacaugggcuaccaauauccaaguggccauaaaccagguccgccggcugaucgguaaugagaacuacuuggauuacaugacuucaaugaagagguuuaaaaaugaaagcgaccccgagggcgcgcugugguga

SEQ ID NO: 14002 - RNA, 9879 nt, Artificial Sequence
  derived and/or modified CDS sequence (opt3) from DENV-1__EU482799__SS-prME
uccgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauaacagaaaccgaaccggacgauguggacuguuggugcaaugcgacugauacauggguaaccuaugggacguguagucaaacuggagaacaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcccaugugaucggcaccucgauuacgcagaagggcaucauauucauccucuuaaugcuggucacuccaucaauggccaugcgcugcguggggauuggaagcagagauuuuguagagggucuuaguggcgcuacauggguugacguggucuuggagcacggguccugugugaccacuauggccaaggauaaacccacacuggacaucgaacuacucaagaccgaggugacgaacccugcgguccugaggaaacuuugcauugaagcaaagaucucuaauaccacaacugauagccgguguccaacccaaggagaggccacacugguugaagaacaagacgcuaacuucgugugccgccgaacuuuuguagauagaggcugggguaauggguguggauuguucggcaaaggcucccucauaaccugcgccaaguuuaagugcgugacaaaacuggaggggaagauuguccaguacgaaaacuuaaaauauucagugaucguuaccgugcacacuggagaccagcaucaagucgguaaugagaguacggaacacggcacaaccgcaacuauuacaccccaagcuccuaccaccgagauccagcugacugacuacggggcccucacacuugauuguagcccaaggacgggacuggacuucaacgaaaugguguugcuaaccaugaaggagaaaucuuggcugguacauaagcagugguuucucgaucugccgcuucccuggacuuccggcgcgucaacaagccaagagaccuggaaucggcaggaccuguugguuacauucaaaacugcccacgcaaagaagcaggaaguggucgugcucgguagucaagagggggcuaugcacaccgcccugacgggcgcuaccgaaauccagacaucuggaacuaccacaauuuuugccggccauuuaaaaugccgucugaagauggauaaacuaacucucaaggggauguccuaugucauguguaccgggucguucaaacuggagaaggaaguggcagagacgcagcacgguacaguucuugugcagauaaaguacgagggcaccgacgccccuugcaaaaucccauucucgacucaagaugaaaaggggguaacacagaacggacgcuugauuaccgcuaaucccaucgucacugacaaagagaagccugugaacauagaagcggagccacccuuuggcgagucuuauauuaucaucggugcaggggagaaaacccugaagcucuccugguucaagaaaggcucaaguauuggaaagauguuugaggccacagcuagaggcgccaggcggauggcaauccugggggauacggccugggacuucggaagcauugguggcguuuuuaccuccguggggaaacuuguccaucagauauucggaacugcuuacggcgugcuguuuucugguguaagcuggacaaugaagaucgggauuggcguguugcucaccuggcugggauuaaauucacgaaguacaucccugagcaugacuuguaucgccguuggccuagucacccucuaccugggggugauggugcaggcagauucuggaugcgucaucaacuggaaaggccgcgaacuuaagugugguucagggauuuucguuacgaaugagauacacacauggaccgaacaauauaaguuucaggcggacaguccgaaaagauugagcgcugccaucggaaaggcaugggaggagggcgugugcgguauuagguccgccacucggcuggaaaacaucauguggaaacagauuucuaacgagcucaaucauauccuguuagaaaacgacaugaaguucaccgugguagucggcgauguggcugggauacuggcccagggcaaaaagaugauccgcccucaacccauggaguacaaauauucguggaaaagcuggggcaaggcaaagauuaucggggcugacguucagaauacaacuuuuauuaucgauggaccaaacaccccugaaugucccgacgaucagagagccuggaauauaugggagguggaggacuacggcuucgguauuuuuacaacgaacaucuggcuuaaguugagggauuccuauacccaggucugcgaccaccgucucaugucagcggccauuaaagauaguaaggcugugcacgcagacaugggguacuggaucgaaucugagaaaaaugaaacuuggaagcuggcccgggcuagcuucauagagguuaagacauguaucuggccaaaaucccauacccuauggucaaacggagugcuggaaagcgagaugauuauccccaagauuuauggcgguccuaucucucaacacaauuaccgaccaggcuacuucacucagacagccgggccguggcaucucggaaaacuggagcuugauuuugacuugugcgaaggcaccacgguagucguggaugagcacugcgggaacagaggacccucccugaggacuaccacagugaccggcaagauaauucacgaaugguguugccgcaguuguacuuuaccuccacuccgguucagaggugaggacgggugcugguauggaauggagaucaggcccgucaaagaaaaggaggaaaaucugguuaagagcauggugucugcaggcuccggugagguagacucauuuagucuuggccuguuguguaucagcauuaugaucgaagaggugaugcgcucgcgauggucccggaaaaugcucaugacagggacccuggcggucuucuuucuacugauuaugggacagcucacauggaacgaucugauacgucuuugcaucauggugggcgccaaugcuucugacagaauggggaugggaacuaccuacuuggcccugauggcaacguucaagaugaggccuauguuugcuguuggcuuacucuuccgccggcugacaagcagagaggugcuucugcuaaccauuggucucucacuggucgccaguguggaauugccaaacucccuggaggaauuaggggauggacucgcaaugggcaucaugauucugaaacuucugacugacuuucaaucucaucaguugugggccacccuccugagccuaacauucaucaagacuaccuuuucccugcacuaugcuuggaaaacgauggcgaugguucuuucaauagugagccucuucccccuguguuugaguacaaccucucagaagacuacauggcugccggucuuacucggcucccuggggugcaagccucuuaccauguuucugaucgccgagaauaaaauuuggggaaggcgaagcuggccauugaacgaagguaucauggcaguaggcauugugucgauccuccugucaucucuacugaagaacgauguuccccuugcugggccucucauagccggaggcaugcugauugccuguuacgugaucagugguuccagcgcugacuugucuuuagagaaagcagccgaggucagcugggaagaggaagcggagcauuccggggcuucacacaauauccugguggaaguacaggaugacggaacuaugaagauuaaagaugaggagcgcgacgauacacucaccauacugcuuaaggccacgcuguuggcagugaguggcgucuauccccuaagcaucccagccacucuguucguuugguacuucuggcagaaaaagaagcagcggucuggcgugcucugggacaccccuucacccccagaaguggagagagcuguccuggaugacgggauuuauaggaucaugcagcguggacuuuuaggucgcagccaggugggcguugggguauuucaagaaaacguguuccauacaauguggcacgucacccggggagcagugcugauguaccagggcaaaagacucgagccgaguugggccagcguuaagaaagacuugauuuccuacggugggggauggaggcugcagggcucuuggaauacaggcgaggaagugcaggucaucgcgguggagccugggaagaaccccaaaaauguacaaacugcuccaggaaccuuuaagacgcccgaaggugaggucggcgccauagcacucgauuucaagccugggacaucgggaagcccaaucgugaaccgagaaggcaaaauuguuggucuguaugggaauggaguggucacuaccucaggcacauacguguccgccaucgcucaggccaaggcaagucaggagggcccccuuccugagauugaagacgagguuuuucggaaacgcaaccugaccaucauggauuugcacccggggucuggaaagacuagaagguaucuaccagcuauagugcgggaagccauuaaacgaaagcugagaacccucaucuuagcgcccacacgcgucguggccagcgagauggcagaagcucugaaggguaugccuaucagguaccaaacgacugccguaaaauccgagcauaccggcaaggagauuguggaccuuaugugccacgcuacauucaccaugcgucugcucucaccaguucggguccccaauuauaacaugaucauaauggaugaagcacauuuuacugacccuucuagcauugccgccagaggguacaucaguacaagggugggaaugggcgaggcugcggcaauuuucaugaccgccacgccgcccgguuccguggaggcuuuuccacagagcaaugccgucauccaggaugaggaacgcgacauaccugagcgaucuuggaacucaggguaugaguggauuacugauuuccccggaaaaacaguaugguuugugccauccaucaagaguggcaaugacaucgcaaacuguuugaggaaaaauggcaagcggguuauucagcugagcaggaagaccuucgauaccgaauaccagaaaacuaagaacaacgacugggacuacguggucacaaccgauaucucggagaugggggccaauuuccgcgcugaccgugugauugauccuagacggugccucaaacccguuauacugaaggacggaccagaaagggugauccuugcggguccgaugccugucacaguggccucugcagcucagcgccgaggcagaauugggcggaaccacaauaaagagggagaucaguauaucuacaugggccagccccuaaacaaugacgaggaucaugcccacuggacugaagcaaagaugcuguuggacaacaucaauacgccagaggguauuauacccgccuuauuugaaccugagagggaaaaguccgcugccaucgauggggaguaucgccugagaggcgaggcgaggaaaaccuucguagaacucaugcggcguggagaccugccaguguggcuuagcuacaagguugcaucagagggcuuucaauauagugaucgccgauggugcuucgacggggaaagaaacaaucagguccuggaggaaaacauggauguggagauuuggacaaaagagggagaaaggaagaaacuccggccccgcugguuggacgccagaacuuacucugacccucuggcucuaagggaguuuaaggaguucgccgcuggucggcgauccgugagcggcgaucugauccucgagauugggaaacuuccgcagcaccugacccagagagcacaaaaugccuuagacaacuuggucaugcugcauaauucagaacagggaggccgcgcuuauaggcacgccauggaggagcucccagauacaaucgaaacccugaugcuucuggcacucauagcgguuuugacugguggggugacgcuguuuuucuuaaguggccggggacuaggcaagaccagcaucgggcugcucuguguaauggccuccucugugcuucuguggauggcuagcgucgagccccauuggauugccgcauccaucauuuuggaauuuuuccugauggugcuccugaucccugagcccgaccgucagagaacaccacaggauaaccaacuugcuuacguugugauaggacuccuguuuaugauuuugacugucgccgcaaaugagaugggucuguuagaaaccacaaagaaagaccuaggcaucgggcacguagccguggagaaccaccaucacgcugcgaugcuggauguugaccuccauccugccucagcauggacccuuuacgcuguggccacuacaauuaucacgcccaugaugaggcacaccauagaaaacacuacagccaauaucucucugaccgcaauugcuaaccaggccgcgaucuugaugggacuggauaagggcuggccaauuaguaaaauggacaucggugucccucuccuggcucuugggugcuauagccaggugaauccguuaacccugacagccgcaguccucauguugguggcccauuacgcuauaauuggccccggacugcaagcaaaggccacucgcgaggcgcagaaacggacggcugccggcaucaugaagaacccaaccguugaugggaucguggcaauugaccuagauccuguaguguaugacgccaaguucgaaaaacagcugggacagaucaugcuccuuauacuguguacaagccaaauuuugcugaugcgaacuaccugggcucucugcgaguccaucacacuggccaccggccccuuaacuacgcuuugggaggguucuccagggaaguuuuggaauacaaccauugcagucucaauggcuaacaucuucagaggaagcuaccuggccggcgcgggucucgccuucucccuaaugaaaagucugggcgggggaaggcgcggcacuggggcacagggagaaaccuugggcgagaaguggaaacggcagcugaaucagcucucuaagagcgaauuuaacacauauaagagaucagguauaauggagguugaccguuccgaagcuaaagaggggcuuaagaggggagagacuaccaaacacgccgugagucggggcacagcaaagcugcgcugguucgucgaacgaaauuuggugaaaccugaggguaagguaaucgaucugggcugugggagaggaggcuggagcuacuauugcgcugggcucaagaaagugacggaaguuaagggauacaccaaaggcggucccgggcacgaggaaccgauuccaauggccacuuacggauggaacuuagugaagcugcauucuggcaaagacgucuuuuucaucccucccgagaagugugauacacuucugugcgacauuggcgaguccucaccaaaucccaccaucgaagaggggaggacucuacgggugcucaaaauggucgaaccuuggcugcgcggaaaccaauuuuguauuaagaucuugaauccguauaugcccagcgugguugagacacuggagcagaugcagagaaagcacgguggcaugcucguaaggaacccacuuucgcgaaauucuacccaugaaauguacugggugaguugcgggacgggaaacauagucuccgccgugaauaugaccagccggaugcuguuaaaccguuucacaauggcgcacagaaaaccuacuuaugagcgcgauguugaccugggcgcugguaccaggcacguggcagucgaacccgagguggccaacuuggauauuaucgggcagcggaucgaaaauauuaagcaugagcacaaaucaacauggcauuacgacgaggauaacccuuauaagacuugggcuuaccacggauccuaugaaguaaaaccaucuggcagcgccaguuccauggugaauggcguugucaagcuccugaccaagcccugggacgugauaccuauggugacacaaaucgcaaugaccgauacuacgccauuugggcagcagagagucuucaaagagaagguugacacacgcacccccaaagccaagaggggaacugcucaaauuauggaagugaccgcgaaauggcuaugggguuuucuuagccgaaacaagaagccgcggaucuguacaagagaggaguucacgaggaaaguacgcucuaaugccgcaauuggcgcuguguuugucgacgagaaccaguggaacucagccaaggaggcaguggaagaugagcguuucugggaccugguucaucgggaaagagagcuccacaaacaggggaagugcgcaaccugcguguacaacaugaugggaaaaagggaaaagaagcugggcgaguuugguaaagcuaaggggagucgcgccaucugguacaugugguugggagcgcgauuccuggaguucgaagcacucggcuuuaugaaugaggaucacugguucucccgggaaaacagccuuucuggcgucgagggggagggacugcauaaauuagguuauauacugagagacaucucgaagauuccuggcgggaauauguacgccgaugacacugcuggaugggauacaaggaucaccgaagacgauuugcagaacgaggcccgcauuacugacaucauggaaccagagcacgcacuccuggcuaaaucaauauuuaagcuaacauaucaaaauaaagugguaagaguucagcggcccgccaagaacggcaccgugauggaugucauuagcaggcgugaccagcgagguuccggacaggugggaacauacggccuuaauacuuucaccaacauggaagcucaacugauccgccagauggagagugagggcaucuuuucuccuagcgaacucgagacgccaaaccuggccgaaagaguguuggauugguuagagaaguauggggucgaacggcugaaaaggauggcaauuuccggagacgacuguguugugaagcccauagaugaccgcuucgcgaccgcccucacagcucuuaaugauauggguaaaguaagaaaggacaucccgcagugggagccuucaaaaggcuggaacgauuggcagcaagugcccuuuugcagucaucacuuccaccagcugauuaugaaggacgggcgggagaucgucgugccauguaggaaucaggaugagcuaguuggacgagcccgugugucucagggcgcagguuggagccugagagagacugcuugccucgggaaguccuacgcccaaauguggcaguugauguauuuucaucgccgggaccugaggcuugcagccaacgcgauuuguucagcugucccuguggauuggauccccaccagcagaacaacuuggucuauacacgcccaucaccaguggaugaccacggaagacaugcuguccguauggaaucgcguuuggaucgaggaaaacccauggauggaggauaaaacacauauuaguagcuggggagacgugcccuaccucggcaagcgggaggaccaauggugcggcucguuaaucgggcugaccgcaagggccacuugggcuacaaauauucaggucgccaucaaccaggugcgaagauugauuggaaaugaaaacuaccuggauuauaugaccuccaugaaacgguucaagaaugagucugacccugaaggugcacucugguga

SEQ ID NO: 14003 - RNA, 9879 nt, Artificial Sequence
  derived and/or modified CDS sequence (opt3) from DENV-1__EU482800__SS-prME
agcgugacaaugcugcuaaugcuuaugcccacagcacuggcuuuccacuugacuacgcgaggcggggagccucauaugaucgucuccaagcaggaaaggggaaaaucuuuacuguuuaagacaucagccgguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggacaacaccgccgagacaagcguagcguggcccuggcaccccaugucggccuuggucuggagacuagaaccgagacauggauguccucugaaggggccuggaaacagauccagaggguggagacuugggcuuugcggcacccuggauuuaccguuauugcacucuuccuggcccaugcuaucggcacaucgauuacccaaaagggcaucauauuuauccugcucauguuagugacgccaucaauggccaugcgcugcgucgggauuggaagcagagauuucguggaaggucugaguggcgcgacuuggguugacguugugcuugagcacggguccugugucacaaccauggcaaaggauaaacccacuuuggacaucgagcugcuaaagacagaagugaccaacccugccgugcucaggaaacugugcauugaggcuaagaucucuaauacgaccauagauagccgguguccaacacagggagaagccacucuugucgaggaacaggacgcaaacuuuguuugccgccgaaccuucguggauagaggcugggguaauggguguggacuguuuggcaaaggcuccuugauuacaugcgcuaaguucaagugcguaacuaaacucgaggggaagaccgugcaguacgagaaccugaaauauucagucaucgugacaguucacaccggagaccaacaucagguggguaaugaaaguacugagcacggcacgacagccaccauuacuccccaggcgccuagcaccgaaauccaguuaacagacuacggggcccugacccucgauuguucuccaaggacuggacuugacuuuaacgagaugguccuguugacaaugaaggaaaaauccuggcuagugcauaagcaaugguuccuggaucucccgcugcccuggacgucaggcgcaagcaccagucaggagacuuggaaucggaaagaccuucugguaacauuuaagaccgcucacgccaagaaacaggagguuguggucuuggguucucaagaaggggcuaugcacacagcccucacuggcgcaaccgagauccagacguccggaaccacaacuauuuucgccggccaucugaagugccguuuaaaaauggauaagcugacccuaaaagggaugagcuaugugauguguacaggaucguucaagcucgaaaaggaggucgcugaaacucagcacgguaccgugcugguucagauaaaauacgagggcacggacgcgccuugcaagaucccauuuucuacacaagaugagaaaggggugacccagaacggacgccuuauuacugcaaaucccaucguaacagacaaggaaaaaccugucaacauagaggccgaaccacccuucggcgaguccuauauugugaucggugcuggggagaaggccuugaagcugucaugguuuaaaaagggcaguagcaucggaaaaauguucgaagcaaccgccagaggcgcuaggcggauggccauucucggggauacugcaugggacuuuggauccaucgguggcguuuucaccucuguggggaagcugguccaucagauuuuuggaacagcguacggcgugcuuuucagcgguguaucauggacgaugaaaauagggaucggcgugcuguugaccuggcucggacugaauagucgauccacuagcuuaucuaugacauguauugcuguuggccuggucacccuauaccucggggugauggugcaggccgauucaggaugcgucaucaacuggaagggccgcgagcugaagugugguagugggaucuuuguuacaaaugaagugcacacuuggaccgagcaauauaaauuccaggcagacagcccgaagagacuuuccgccgcuauuggaaaagccugggaagagggcgugugcgguauaaggucuguaacgcgguuggagaacaucauguggaagcagauuucgaacgaacugaaucauauccuccuggagaacgacaugaaauuuacagucgugguuggcgauguggcagggauuuuagcucagggaaagaaaaugauccgcccucaacccauggaauacaaguauagcuggaaguccuggggcaaagccaagauaaucggggcggacguccagaauaccacuuucauuaucgauggaccaaacaccccugagugucccgacgaucagagagccuggaauauuugggaaguggaggacuacggcuuugguaucuucacaacuaacauauggcugaaacuuagggauucauauacccagguuugcgaccaccguuugaugagugcugcaauuaaggauucuaaagccgugcacgcugacaugggguacuggaucgagagcgaaaagaaugagacauggaagcucgcccgggcauccuucauugaaguaaaaacguguaucuggccaaagucacauacccuguggagcaacggaguccuagagucugaaaugauaauccccaaaauuuauggcgguccuaucucccaacacaauuaccgaccaggcuacuuuacucagacagcggggccguggcaucugggaaagcucgagcuggauuucgaccuuugcgagggcaccacugugguggucgaugaacacugcgggaacagaggacccaguuugaggacaaccacgguuacuggcaaaauuauccacgagugguguugccgcagcuguacccugccuccauuacgguuuaagggugaagacgggugcugguauggaauggagauaagacccgugaaggagaaagaagagaaucucguaaagucuaugguguccgccggcucaggugaagucgacaguuucagccugggccuucuguguauuucgaucaugaucgaggaagugaugaggucccgcuggucucgaaaaauguugaugacagggacccucgcuguauuuuuccugcuaauuaugggacagcugacuuggaacgaucucauccggcugugcauuauggugggcgccaaugcaagcgaccguauggggaugggaacaaccuaccuugcuuugauggccacauuuaagaugagaccuauguucgcagucggccuguuauuuaggcgccucacuucacgggaggugcugcuucugaccauaggucuaagucucguugccuccguggagcugccaaacucuuuggaagaacugggggauggauuagcuaugggcaucaugauucucaaacugcuuacggacuuccaaagccaucagcugugggcgacauugcucucccugaccuuuaucaagacuaccuucucacuacacuaugccuggaagacaauggcaaugguccugagcauuguaagucuuuuuccccucugucugucuacuaccucccagaaaacgacaugguugccggugcuguuaggcagccucgggugcaagccucugaccauguuccuuaucgcugaaaauaaaauauggggaagaaagucguggccacugaacgaggguaucauggccguuggcauugugucaaucuugcucucuagucugcucaagaaugaugucccccuggccgggccucuuauugcuggaggcaugcucaucgcauguuacgugauauccgguagcucugccgaccugagcuuggaaaaggcggcugagguauccugggaggaagaggccgaacauucaggggcaagucacaauauuuuaguggagguccaggaugacggaacuaugaaaaucaaggaugaagagagggacgauacacugaccauccuccugaaggccacucuucuggcuguuagcggcguguaucccuugucuauuccagcaacacuauucgugugguacuuuuggcagaagaagaaacagcgauccggcguccugugggacaccccuucacccccagagguggaacgcgccguucucgaugacgggauauaucggaucaugcagagaggacugcuugguaggagucagguaggcgugggggucuuccaagagaacguguuucauacgauguggcacguuacucguggagcgguguuaauguaccagggcaagcgccuggaaccgagcugggcuuccgucaaaaaggaccucauuucuuacggugggggauggcgguugcagggcucguggaauaccggcgaggaggugcagguaaucgccgucgaaccugggaagaaccccaaaaaugugcaaacagcaccaggaaccuucaagacaagcgagggugaaguuggcgccauugcucuggauuuuaaacccgggacuucaggauccccuaucgugaacagagagggcaagauagucggucucuaugggaauggagugguuaccacgaguggcacauacgugucugccaucgcacaggcuaaagccagccaggaaggcccacugcccgagauugaggacgaagucuucaggaagcgaaaccuuacuaucauggaucugcacccuggguccggaaagacccggcgcuauuugccggcgauugugagagaggccaucaaaaggaagcuacggacacugauacucgcaccaacccgaguaguggcuucagaaauggccgaggcuuuaaaagguaugcccauuagauaccaaacuaccgcaguuaagucugaacauacaggcaaagagaucgucgaccugaugugccacgccacguuuacuaugcgccuucugagcccugugagggugccaaauuauaacaugaucauuauggaugaggcccauuucaccgaccccaguuccaucgcugcgcguggguacauaagcacacgggucggaaugggcgaagcagccgcuauuuuuaugaccgccacuccuccggguucuguagaggcauucccccagucaaaugccgugauccaggaugaagagagagacauuccagaaagguccuggaacaguggguaugaguggaucacagauuuuccuggaaagaccguuugguucgugcccagcauaaagucgggcaaugacauugcuaacugucuccgcaaaaauggcaagcgagucauccaguugucuagaaaaacguucgauacugaguaccaaaagaccaaaaacaacgacugggacuacgugguuaccaccgauaucuccgaaaugggggcgaauuuucgggccgacagggugauugauccacgccguugccugaagccugucauccucaaggacggacccgagagagugauucuggcagguccaaugccgguaacuguggcuagcgccgcacagcggaggggccgcauagggcgaaaccacaauaaagaaggagaucaguauaucuacaugggccagccucuuaacaaugacgaggaucaugcccacuggacagaggcuaagaugcuacuggacaacauuaauacccccgaagguaucaucccagccuuguucgagcccgaaagagagaaaucagcggcaauugauggggaauaucgguuaaggggcgaggcccgcaagacauuuguugagcugaugagaaggggagaccucccugucuggcugaguuacaaaguggcuucugaaggcuuccaauauuccgaucggcguuggugcuuugacggggagcgcaacaaucaggugcuugaagagaacauggaugucgaaauauggacuaaggagggagagaggaaaaagcugagaccaagauggcucgacgcccggacguacagcgaccccuuggcucugcgcgaguucaaggaguuugcagccgguagaaggucaguuaguggcgaucuaauccuggaaauugggaaacucccucagcaccuuacccagcgggcucaaaaugcccuggacaacuuagugauguugcauaauagcgagcagggaggccgagcauauagacacgcgauggaagaacugccggauacaaucgagacucucaugcugcuugcccugauugcuguacucaccgguggggugacauuguucuuucuguccggccgcggauuaggcaagaccucuaucgggcuacugugugucauggccagcuccgugcuccuuuggauggcaucaguugaaccacauuggauagcugccucuaucauucuggaguucuuuuugauggugcugcucauccccgaaccugacaggcagcggacuccccaggauaaccaacuggcauacgucguaauuggacuucucuucaugauccugacgguggccgcuaaugagauggguuugcuggagaccaccaaaaaggacuuaggcauagggcacguugcgguggaaaaccaccaucacgccgcaaugcuagaugucgaccugcauccagcuagugccuggacucucuacgccguggcaaccacaauuaucaccccuaugaugcgucacacuauugagaacacaacggcuaauaucucgcuuaccgccauagcgaaccaggcugccauccugaugggauuggauaaaggcuggcccauuagcaagauggacaucggugucccacugcucgcacuggggugcuauucccaggugaauccucuuacuuuaacagccgcuguucugaugcucguggcacauuacgccauuaucggcccgggauugcaagcgaaggcuaccagagaagcccagaaaaggaccgcagccggcauaaugaagaaccccacaguagaugggauuguggcuaucgaccuggauccagucguuuaugacgccaaauuugagaagcagcuaggacagaucaugcugcucauucuuuguacuucucaaauccuguugaugcgcacgaccugggcacugugcgaaucaauaacacucgcuacuggcccucugaccacauuaugggaggguagccccgggaaauucuggaauaccacuauugccguguccauggcgaacaucuuccggggaaguuaccuugccggcgcaggucuggcuuuuucucucaugaaaagccuaggcgggggacgaagaggcacgggggcccagggagagacacugggcgaaaaguggaaaaggcaguugaaucagcugucaaaguccgaguucaacaccuauaaacgcagugguauuauggaagucgaccggagcgaggcaaaggaagggcucaaaagaggagagacuaccaagcacgcugugucucguggcacagccaaacuuaggugguuuguagagcggaaucuggugaaaccagaagguaagguuaucgauuugggcugugggcgcggaggcugguccuacuauugcgccgggcugaaaaaggugacugaggucaaaggauacaccaagggcgguccugggcacgaggaacccauaccgauggcgacauacggauggaaccucgugaaauuacauucaggcaaggacgucuucuuuaucccaccugaaaagugugauacgcugcuuugcgacauuggcgagagcucgcccaauccaaccaucgaggaagggcgaacucugagagugcuaaaaaugguugagcccuggcucaggggaaaccaauucuguauuaagauccugaauccuuauaugccgucuguaguggaaacauuggagcagaugcagcggaaacacgguggcaugcugguccgcaacccccucaguagaaauuccacccaugagauguacugggugagcugcgggacuggaaacauuguuucagcugugaauaugacauccaggaugcuucugaaccgauuuaccaugguccaccggaagccaacguaugaacgugauguggacuuaggcgcagguaccagacacguagccguggagccugaaguugcuaaccuggauaucauagggcagcgcauugagaauaucaaacaugaacacaagucuacauggcauuacgacgaggauaaccccuauaagacuugggccuaccacggaagcuaugaggucaaaccuaguggcuccgcaagcucuauggugaauggcguggucaaguugcucaccaaaccaugggacguuauccccauggugacacaaauugccaugacugauaccacaccuuucgggcagcagaggguauuuaaggaaaaaguggacacccggacuccaaaggcuaagagaggaacggcgcaaauaauggaggucacagccaaauggcugugggguuuccuaucacgcaacaagaaacccaggaucuguacccgagaagaguuuacucggaaggugagaaguaaugcagcuauuggcgccguuuucguggacgaaaaccaguggaacuccgcaaaagaggccgucgaggaugaaagguuuugggaccuugugcaucgcgagcgugaacugcacaagcaggggaagugcgcuaccugcguauacaacaugaugggaaaacgggagaagaaacucggcgaguucgguaaggccaaagggagcagagcgaucugguacauguggcugggagcaagguucuuggaguuugaggcccugggcuucaugaaugaagaucacugguuuucucgcgagaacucgcucucaggcguugaaggggagggacuucauaagcuggguuauauuuuacgagacaucagcaaaauaccgggcgggaauauguacgcugaugacacagccggaugggauacgcggaucaccgaggacgaucugcagaacgaagcaaagauuacugacaucauggagccugaacacgcuuugcucgccaaguccauuuucaaacugacauaucaaaauaagguggucagagugcagaggccagcuaaaaacggcaccgugauggaugucaucagucgcagagaccagcgggguucugggcagguuggaacuuacggccuaaauacauuuaccaacauggaggcccaacuuauaaggcagauggaaagcgagggcauuuucucccccucagagcuggaaacaccuaaccucgcagggcguguguuugauuggcuggagaagcauggaguagaacgauugaaacgcauggcgaucaguggugacgacuguguggucaagccaaucgaugacagauucgccacugcuuuaaccgcccugaaugauaugggcaaggugcggaaagacauuccccagugggagccgucuaagggguggaacgauuggcagcaaguuccuuuuugcagccaccacuuccaucagcucauaaugaaagacggaagggaaaucgugguccccugucgcaaucaggaugagcuugugggcagagcacggguaucccagggugcuggguggucacugagggagacggccugccuaggaaagagcuaugcacaaauguggcagcugauguacuuucaccgacgugaccucagauuggccgcgaacgcuauuuguucugccguuccaguggauugggucccuaccucccgcacaacuuggaguauccaugcacaccaucaguggaugaccacagaagacaugcugagcguguggaaucggguuuggauugaggaaaaccccuggauggaggauaaaacucacaucucguccuggggcgacgugccauaucuuggcaagagggaagaccaauggugcgggucucugauaggacucaccgccagagcuacgugggccacaaauauccaggucgcaauuaaccaggugcgccgguuaaucgguaaugagaacuaccuggauuacaugaccucaaugaagagguucaaaaaugagagcgaccccgaaggcgcuuugugguga

SEQ ID NO: 14004 - RNA, 9879 nt, Artificial Sequence
  derived and/or modified CDS sequence (opt3) from DENV-1__EU482801__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaauaugugcacacugauugccauggaccucggcgagcugugugaagauacuaugaccuacaaaugcccacggauuacagagaccgaaccggacgauguggacuguuggugcaaugcgacugauacaugggugaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgguagcuucaaacuggagaaggaagucgccgagacgcagcacggaacagugcuuguucagauaaaguacgagggcaccgacgcuccuugcaaaaucccauucucgacucaagaugaaaagggggugacacagaacggacgcuugauuaccgcgaaucccaucguaacugacaaagagaagccugucaacauagaagcagagccacccuuuggcgagucuuauauugugaucggugccggggaaaaagcucugaagcucuccugguucaagaaaggcucaaguaucggaaagauguuugaggccaccgcaagaggcgccaggcggauggcuauucugggggauacagccugggacuucggaagcaucgguggcguuuuuacguccguggggaaacuuguccaucagauuuucggaaccgcauacggcgugcuguuuucugguguaagcuggacuaugaagauagggaucggcguguugcucacauggcugggauuaaauucacgaaguaccucccugagcaugacauguauugcgguuggccuagucacucucuaccugggggugauggugcaggcugauucuggaugcgucaucaacuggaaaggccgcgaacuuaagugugguucagggaucuucguuaccaaugaggugcacacguggacagaacaauauaaguuucaggccgacaguccgaaaagauugagcgcagccauuggaaaggcuugggaggagggcgugugcgguauaagguccgccacccggcuggaaaacaucauguggaaacagauuucuaacgagcucaaucauauccuguuagaaaacgacaugaaguucacuguagucgugggcgauguugcagggauucuggcucagggcaaaaagaugauccgcccucaacccauggaguacaaauauucguggaaaagcuggggcaaggccaagauaaucggggcggacgugcagaauaccacauuuauuaucgauggaccaaacacuccugaaugucccgacgaucagagagccuggaauauuugggaggucgaggacuacggcuucgguaucuuuaccacaaacauauggcuuaaguugagggauuccuauacacaggugugcgaccaccgucucaugucagcugcaauuaaagauaguaaggccguucacgcugacaugggguacuggaucgaaucugagaaaaaugaaaccuggaagcuggcccgggcauccuucauugaggugaagacuuguaucuggccaaaaucccauacacuauggucaaacggaguacuggaaagcgagaugauaauccccaagauuuauggcgguccuaucucucaacacaauuaccgaccaggcuacuucacccagacugcggggccguggcaucucggaaaacuggagcuugauuuugacuugugcgaaggcacaaccgucgugguggaugagcacugcgggaacagaggacccucccugaggacgacuaccgucacaggcaagauuauccacgaaugguguugccgcaguuguaccuuaccuccacuccgguucagaggugaggacgggugcugguauggaauggagauaaggcccguuaaagaaaaggaggaaaaucugguaaagagcaugguaucugccggcuccggugagguggacucauuuagucuuggccuguuguguauuagcaucaugaucgaagaggucaugcgcucgcgauggucccggaaaaugcucaugacugggacacuggcuguguucuuucuacugauuaugggacagcucaccuggaacgaucugauccgucuuugcauuaugguuggcgccaaugcaucugacagaauggggaugggaacaacuuacuuggcucugauggccaccuucaagaugaggccuauguuugcagugggcuuacucuuccgccggcugacgagcagagagguccuucugcuaacaauaggucucucacugguggccaguguugaauugccaaacucccuggaggaauuaggggauggacucgcuaugggcaucaugauucugaaacuucugaccgacuuucaaucucaucaguugugggcgacucuccugagccuaaccuucaucaagacaacuuuuucccugcacuaugccuggaaaaccauggcaauggugcuuucaauugucagccucuucccccuguguuugaguacgacaucucagaagaccacuuggcugccgguauuacucggcucccuggggugcaagccucuuacaauguuucugaucgcugagaauaaaauauggggaaggcgaagcuggccauugaacgaagguaucauggccgugggcauuguuucgauccuccugucaucucuacugaagaacgaugugccccuugccgggccucucauugcuggaggcaugcugaucgcauguuacgucauaagugguuccagcgccgacuugucuuuagagaaagcggcugaggugagcugggaagaggaagccgagcauuccggggcaucacacaauauucugguagaagugcaggaugacggaaccaugaagaucaaagaugaggagcgcgacgauacucucacaauccugcuuaaggccacccuguuggcugucaguggcguuuauccccuaagcauuccagcaacgcuguucgugugguacuucuggcagaaaaagaagcagcggucuggcgugcucugggacacuccuucacccccagaagucgggagagccgugcuggaugacggaauauauaggaucaugcagcguggucuuuuaggccgcagccagguugggguaggaguguuucaagagaacgucuuccauaccauguggcacgugacacggggcgcgguucugauguaccaggguaaaagacucgaaccgaguugggcuagcgugaagaaagacuugauuuccuacgggggaggcuggaggcugcagggcucuuggaauaccggggaggagguccaggugaucgccguagaaccuggaaagaaccccaaaaauguccaaacagcaccagguacuuuuaagacccccgagggcgaagugggggccauugcucucgauuucaagccuggaacgucgggcagcccaaucguuaaccgagaggguaaaauaguggggcuguauggaaauggcgucgugacaacuucaggcaccuacguuuccgccaucgcacaggcuaaggccagucaggaagggccccuuccugagauugaggacgaaguguuucggaaacgcaaccugacaaucauggauuugcacccgggaucugguaagaccagaagguaucuaccagcgauuguccgggaggccaucaaacgaaagcugagaacucucauauuagcacccacccgcgugguagcuagcgaaauggccgaggcucugaagggcaugccuauuagguaccaaacaacggcagugaaauccgaacauacugggaaggagaucguugaccuuaugugccacgccaccuucacaaugcgucugcucucaccaguccgggugcccaauuauaacaugaucauuauggaugaggcccauuuuaccgacccuucuagcaucgcugcgagaggauacauaaguacuagggugggcaugggugaagcagccgcuauuuucaugacagccaccccgcccggguccgucgaggcauuuccacagagcaaugccguaauccaggaugaggaacgcgacauuccugaacgaucuuggaacucaggauaugaguggaucacggauuuccccggcaaaacugugugguuuguuccauccauaaagaguggcaaugacauugcuaacuguuugaggaaaaaugggaagcgggugauccagcugagcaggaagacauucgauaccgaguaccagaaaaccaagaacaacgacugggacuacgucgugacuacagauaucucggaaaugggagcgaauuuccgcgccgaccguguuauugauccuagacggugccucaaacccgugauccugaaggacgguccagagagggucauucuugcaggcccgaugccugugaccguagcuucugccgcacagcgccgagggagaauaggacggaaccacaauaaagaaggcgaucaguauaucuacaugggucagccccuaaacaaugacgaggaucaugcccacuggacagaggcuaagaugcuguuggacaacauuaauacuccagaagggaucauccccgccuuauuugagccugaaagggagaaguccgcggcaauugauggcgaauaucgccugagaggagaggccaggaaaacguucguggagcucaugcggcguggcgaccugccaguuuggcuuagcuacaaggucgcuucagaaggguuucaauauagugaucgccgauggugcuucgacggagagagaaacaaucaggugcuggaagagaacauggauguggaaauauggaccaaagagggugagaggaagaaacuccggccccgcugguuggacgccagaacauacucugacccucuggcucuaagggaauuuaaggaguucgcagccggccggcgauccgucagcggggaucugauccucgaaauuggaaaacuuccgcagcaccugacucagagagcucaaaaugccuuagacaacuugguuaugcugcauaauucagagcagggcggucgcgcauauaggcacgcgauggaggaacucccagauaccaucgagacacugaugcuucuggcccucauugcuguguugaccgggggcguaacucuguuuuucuuaaguggacggggccuagggaagacgagcaucggacugcucugugugauggccuccucuguccuucuguggauggcaagcguggaaccccauuggauagcugccuccaucauuuuggaguuuuuccugaugguucuccugaucccugaacccgaccgucagagaaccccacaggauaaccaacuugcauacguggucauuggucuccuguuuaugaucuugacaguagccgcuaaugagaugggccuguuagagacuaccaagaaagaccuagggauaggacacguggcgguugaaaaccaccaucacgccgcaaugcuggauguggaccuccauccugcuucagccuggacacuuuacgccgucgcaaccacuauuaucacacccaugaugaggcacacgauugagaacaccacugcuaauaucucucugacagccauagcgaaccaggcugccaucuugaugggccuggauaaggguuggccaauuaguaaaauggacaucggggugccucuccuggcacuuggcugcuauucgcaggucaauccguuaacccugaccgccgcugugcucauguugguugcacauuacgccauuaucggacccggccugcaagcgaaggcuacacgcgaagcccagaaacggacugcagccgggauaaugaagaacccaacgguggauggaauuguagcuaucgaccuagauccuguggucuaugacgccaaguucgagaaacagcugggccagaucaugcuccuuauucuguguaccagccaaaucuugcugaugcgaacaacuugggcacucugcgaauccauaacccuggcuacaggucccuuaaccacucuuugggaggggucuccaggaaaguuuuggaauacgacaauugccguuucaauggcgaacaucuucagaggcagcuaccuggccggugcaggccucgcuuucucccuaaugaaaagucuagggggaggcaggcgcgggaccggagcccagggcgagacuuugggugaaaaguggaaacggcagcugaaucagcucucuaagagcgaguuuaacaccuauaagagaucagggauuauggaaguggaccguuccgaggcaaaagaaggacuuaagaggggcgagacaacuaaacacgcugucagucgggguaccgccaagcugcgcugguucguggagcgaaauuugguaaaaccugaaggcaaggugaucgaucugggguguggaagaggcggguggagcuacuauugcgccggacucaagaaaguuacagaggugaagggcuacacgaaaggugggcccggacacgaggagccgauaccaauggcgaccuacggcuggaacuuagucaagcugcauucuggcaaagacguguuuuucaucccucccgaaaagugugauacucuucugugcgacauuggggaguccucaccaaaucccacaaucgaggaaggaaggacccuacggguccucaaaaugguggagccuuggcugcgcgguaaccaauuuuguauuaagaucuugaauccguauaugcccagcguuguagaaacucuggagcagaugcagagaaagcacggcgggaugcucgugaggaacccacuuucgcgaaauucuacacaugagauguacugggucaguugcggaaccggcaacauuguguccgcuguuaauaugacgagccggaugcuguuaaaccguuucaccauggcacacagaaaaccuacauaugaacgcgauguggaccugggugccgggacuaggcacgucgcuguggagcccgaaguagccaacuuggauaucauaggacagcggauugagaauaucaagcaugaacacaaaucaaccuggcauuacgacgaggauaacccuuauaagacaugggcauaccacggcuccuaugaggugaaaccaucuggcagcgccaguuccaugguuaauggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuagccgaaacaagaagccgcggaucuguaccagagaagaguucacaaggaaagugcgcucuaaugcugccauuggggcagucuuuguggacgaaaaccaguggaacucagccaaggaggcuguugaggaugaacguuucugggaccuggugcaucgggagagagaacuccacaaacagggaaagugcgccacgugcgucuacaacaugaugggcaaaagggagaagaagcugggugaauuugggaaagcgaagggaagucgcgcaaucugguacaugugguugggcgcccgauuccuggaguucgaggcucucggcuuuaugaaugaagaucacugguucucccgggagaacagccuuucugggguggaaggagagggucugcauaaauuaggcuauauucugagagacaucucgaauauaccugggggaaacauguacgccgaugacaccgcaggcugggauacuaggaucacagaggacgauuugcagaaugaagcucgcauuaccgacaucauggagccagaacacgcccuccuggcuaagucaauuuuuaaacuaacuuaucaaaacaagguaguuagagugcagcggcccgccaaaaaugguacagucauggaugugaucagcaggcgugaccagcgaggguccggacaggugggcaccuacggccuuaacacauucacuaacauggaggcacaacugauacgccagauggaaagugaggggauauuuucuccuagcgagcucgaaaccccaaaucuggcggagagagucuuggauugguuagaaaaguauggaguugagcggcugaagaggauggccaucuccggugacgacugugugguaaaacccaucgaugaccgcuucgcuacggcccucaccgcacuuaacgauaugggcaaggugagaaaagacauuccgcagugggaaccuucaaagggguggaaugauuggcagcaaguccccuuuugcagucaucacuuccaccagcugauaaugaaagacggacgggagaucgugguuccauguaggaaccaggaugagcuagugggccgagcucgugucucucagggugccggguggagccugagagaaacagcaugccucggaaaguccuacgcccaaauguggcaguugauguauuuucaucgccgggaccugaggcuugcggcuaaugccauuuguucagcagugccuguagauuggauccccacuagcagaaccacauggucuauucacgcccaucaccaguggaugacuaccgaggacaugcuguccguuuggaaccgcguguggaucgaagagaauccauggauggaagauaagacgcauauaaguagcuggggcgacguccccuaccucggcaaacgggaggaccaauggugcgggucguuaaucggacugacagcuagggccaccugggcaacuaacauucagguggcuaucaaucagguucgaagauugauugguaacgagaauuaccuggauuauaugacauccaugaagcgguucaaaaacgaaucugacccugagggcgcccucugguga

SEQ ID NO: 14005 - RNA, 9879 nt, Artificial Sequence
  derived and/or modified CDS sequence (opt3) from DENV-1__EU482802__SS-prME
agcgugaccaugcugcucaugcuuaugcccaccgcccuggcuuuccacuugacuacgaggggcggggaaccucauaugaucgucuccaagcaggaaagggggaaaucuuuacuguuuaagaccucagcugguguuaacaugugcacacuaauugccauggaccucggcgaguucugugaagauacuaugaccuacaaaugcccacggauaacagaagcggaaccggacgauguggacuguuggugcaaugcuaccgauacuuggguaacauaugggaccuguagucagacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuucucccccuguguuugucuaccacgucccagaaaacaaccuggcugccgguauuacucggcagccuggggugcaagccucuuacuauguuucugauugccgagaauaaaaucuggggaagaaagucguggccauugaacgaagguauaauggccgugggcaucguuucaauucuccugucuagucuacugaaaaacgaugugccccuugcugggccucucaucgcaggaggcaugcugauugccuguuacgucaucuccgguagcucugcggacuugagcuuagagaaggcugccgagguguccugggaagaggaagcagagcauucaggggccagucacaauauacugguagaagugcaggaugacggaacaaugaaaauuaaggaugaggagagggacgauacccucacuauccugcuuaaggcuacacuguuggcagucagcggcguuuauccccuaucuaucccagccacccuguucgugugguacuucuggcagaaaaagaaacaacgauccggcgugcucugggacacgccuucacccccagaagucgagcgcgcggugcuggaugacgggauuuaucggauaaugcagagaggacuuuuagguaggagucagguuggcguagggguguuucaggaaaacgucuuccauacuauguggcacgugacccguggagcuguucugauguaccaaggcaagcgccucgagccgagcugggccuccgugaaaaaggacuugaucucuuacggugggggauggcggcugcagggcucguggaauacaggcgaggaaguccaggugauugcaguagagccugggaagaaccccaaaaauguccagaccgccccaggaacauuuaagacuagcgaaggugaggugggcgcuaucgcccucgauuucaaacccgggaccucaggauccccuauuguuaacagagaaggcaagaucgugggucuguaugggaauggagucgugacgacaaguggcacuuacguuucugcaauagcucaagccaaagcgagccaggagggcccacuucccgagaucgaagacgagguguuuaggaagcgaaaccugaccauuauggauuugcacccuggguccggaaagacacggcgcuaucuaccggccaucgucagagaagcaauuaaaaggaagcugcggacccucaucuuagcuccaacucgagugguagccucagagauggcugaagcacugaaagguaugcccauaagauaccagaccacagccgugaagucugagcauacgggcaaagagauuguugaccuuaugugccacgccacuuucaccaugcgccugcucagcccugucagggugccaaauuauaacaugaucaucauggaugaagcucauuuuacagaccccaguuccauugcggcacguggguacaucagcacccgggugggaaugggcgaggccgcugccauauucaugacugcaacaccuccggguucugucgaagccuuuccccaaucaaaugcuguaauucaggaugaggaaagagacaucccagagagguccuggaacaguggguaugaguggauuaccgauuucccuggaaagacggugugguuuguucccagcaucaagucgggcaaugacauagcgaacuguuugcgcaaaaauggcaagcgagugauucagcugucuagacggacuuucgauacagaauaccagaaaaccaagaacaacgacugggacuacgucgugaccacugauaucuccgagaugggggccaauuucagggcagaccgcguuaucgauccacguagaugccucaaaccugugauucugaaggacggacccgaacgggucauccuugcugguccaaugccggugacaguagccagcgcagcccaaaggcgcggccgaauugggagaaaccacaauaaggagggagaucaguauauauacaugggccagccucuaaacaaugacgaggaucaugcucacuggaccgaagccaaaaugcuguuggacaacaucaauacacccgaggguauuaucccagcguuauuugaacccgagcgggaaaagucagcagccaucgauggggaguauaggcugcgcggcgaggcuagaaaaacuuucguggaacucaugaggcggggagaccugccuguuuggcuuaguuacaaggucgccucugagggcuuucaguauuccgaucgucgcuggugcuucgacggggaacgaaacaaucaagugcuggaggaaaacauggauguggagauuuggacgaaagagggagaaagaaagaaacucaggccacggugguuggacgcucgcaccuacagcgacccccuggcacuaagagaguuuaaggaguucgccgcugguaggcggucagucaguggcgaucugauacucgagaucgggaaacuuccucagcaccugacacagcgagcccagaaugcauuagacaacuugguuaugcugcauaauagcgaacaaggaggcagagcguaucgccacgccauggaggagcucccggauacuauugaaacccugaugcuucuggcucucaucgccguguugacaggugggguaacccuguuuuucuuauccggcaggggacuaggcaaaacuucuauugggcugcucugugugauggcaagcuccgcacuucuguggauggccucagucgagccacauuggaucgcagccucuauaaucuuggaauuuuuccugauggugcuccugauucccgagccugaccggcagcguacgccccaggauaaccagcuugcuuacguugugaucggacuccuguuuaugauuuugaccgucgcggccaaugagaugggucuguuagaaacaacuaagaaagaccuaggcaucgggcacguagcaguggagaaccaccaucacgcugccaugcuggauguugaccuccauccagccagugcauggacccuuuacgcuguggccacaaccauaauuacuccuaugaugagacacacaaucgaaaacacgaccgcgaauauuucgcugacugcuaucgccaaccaagcagccauauugaugggacuggauaagggcuggcccaucagcaaaauggacauuggugucccacuccuggcucuugggugcuauucccaggugaauccuuuaacacugaccgcagccguccucauguugguggcgcauuacgcuaucauuggcccgggacugcaggccaaggcaaccagggaggcccaaaagcgcacagcugccggcaucaugaaaaaccccacuguugaugggauaguggcaauugaccuagauccaguaguguaugacgcuaaguucgaaaaacagcugggacagaucaugcuccuuauccuguguacgucucagauuuugcugaugcggaccacaugggcccucugcgagucaaucacucuggcgaccggcccuuuaacaacccuuugggaggguagccccgggaaguuuuggaauacuacgauagccgucuccauggcaaacauuuuccgaggaaguuaccuggcuggcgccggucucgcauucucucuaaugaaaagccugggcgggggaagaaggggcacaggggcucaaggagaaaccuugggcgagaaguggaagcgccagcugaaucagcucucaaaauccgaauuuaacacuuauaagcggagugguaucauggagguugacagaagcgaagccaaagaggggcuuaagcguggagagaccacaaaacacgccgugucuaggggcacugcgaagcugcggugguucgucgaacgcaauuuggugaagccagaggguaaaguaauugaucugggcugugggcgaggaggcugguccuacuauugcgcugggcucaagaaagugaccgaaguuaagggauacacaaaaggcgguccugggcacgaggaacccaucccgauggcaacguacggauggaacuuagugaagcugcauucaggcaaagacgucuuuuucauaccaccugagaagugugauacccuucugugcgacaucggcgagagcucgcccaauccaacuauugaagaggggagaacacuaagggugcucaagauggucgaacccuggcugcggggaaaccaguuuuguaucaaaauuuugaauccuuauaugccgucugugguugagacccuggagcaaaugcagcgcaagcacgguggcaugcucguaagaaacccccuuaguagaaauuccacucaugaaauguacugggugagcugcgggacaggaaacaucgucucagccgugaauaugaccucccgaaugcuguuaaaccgguucacgauggcucaccguaaaccaaccuaugagagagauguugaccugggcgccgguacacgccacguggcagucgaaccugagguggccaacuuggauauuaucgggcagaggauagaaaauauuaagcaugagcacaaaucuacuuggcauuacgacgaggauaaccccuauaagaccugggcuuaccacggaagcuaugaaguaaagccuaguggcuccgcgagcucuauggugaauggcguugucaaacuccugacaaagccaugggacgugauccccauggugacucagaucgccaugaccgauacaaccccuuuugggcaacagcgggucuucaaagagaagguugacacuagaacgccaaaaucaaagcgcggaacagcacagauuauggaagugaccgcuaaguggcuaugggguuuucuuaguaggaacaaaaagccccgaauauguacucgggaggaguucaccagaaaaguaagguccaaugccgcaaucggcgccguguuugucgacgagaaccaauggaauagcgcuaaggaggccguggaagaugagcgcuucugggaccugguucaucgugaacgggagcuccacaaacaggggaagugcgcgacaugcguguacaacaugaugggaaagagagagaagaagcugggcgaguuugguaaagcaaaggggucuagggccauuugguacaugugguugggagcucgcuuccuggaguucgaagcccucggcuuuaugaaugaggaucacugguucucgcgagaaaacucacuuagcggcgucgagggggagggacugcauaaauuagguuauauccugcgggacauuuccaagaucccgggcgggaauauguacgcagaugacacggcuggaugggauaccagaauaacugaagacgauuugcagaacgaggccaaaaucacagacauuauggaaccugagcacgcucuccuggccaagaguaucuuuaagcuaaccuaucagaauaaagugguaaggguucaacgcccagcaaagaacggcacugugauggaugucauuucuagacgggaccagagggguagcggacaggugggaacauacggccuuaauaccuucacaaacauggaagcgcagcugauccgucaaauggaguccgagggcauauuuucacccagugaacucgagacuccuaaccuggccgggcgaguguuggauugguuagaaaaacauggagucgagcgccugaagagaauggcuauuucuggugacgacuguguugugaaaccaaucgaugaccgguucgccaccgcacucacggcucuuaaugauaugggcaagguaaggaaggacaucccccagugggaaccgagcaaaggguggaacgauuggcaacaggugccuuuuugcucccaccacuuccaucaacugauuaugaaggacggacgcgagauagucgugcccuguagaaaucaggaugagcuaguuggccgggccagggugucacagggugcaggguggagccugcgagaaaccgccugccucggaaaaucuuaugcgcagauguggcaauugauguacuuucaccguagagaccugcgccuugcugccaacgcaaucuguuccgccgucccaguggauuggguaccuacaagucggacuaccuggagcauucaugcucaccaucaguggaugacaacugaggacaugcugucgguuuggaauaggguguggaucgaagagaaccccuggauggaagauaagacccacauuuccucuuggggcgacgucccauaucucggcaaaagagaggaccaguggugcgggucauuaaucggacugacggcccgcgcaacaugggcuaccaauauacaaguggccaucaaccagguucggagguugauugguaaugagaacuaccuggauuacaugacuagcaugaagcgauucaagaaugaaagugaccccgagggcgcgcucugguga

SEQ ID NO: 14006 - RNA, 9879 nt, Artificial Sequence
  derived and/or modified CDS sequence (opt3) from DENV-1__EU482804__SS-prME
agcgugaccaugcugcuaaugcuuaugcccacugcacuggcuuuccacuugacuacgcgaggcggggaaccucauaugaucgucuccaagcaggaaagggggaaaucuuuacuguuuaagaccucagccgguguuaacaugugcacccuaauugcaauggaccucggcgaguucugugaagauacuaugaccuacaaaugcccacggauaacagaagcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguugacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaaggugguccaguacgaaaaccugaaauauucagugauuguuacagugcacaccggagaccagcaucaagucgguaaugagaguacugaacacggcacgacagccaccaucacuccccaggcgccuagcaccgagauucaguuaacagacuacggggcccugacccucgauuguucuccaaggacuggacuugacuuuaacgaaauggugcuguugacaaugaaggagaaauccuggcuaguacauaagcagugguuccuggaucucccgcugcccuggacgucaggcgcaagcaccagucaagagacuuggaaucggaaagaccuucugguuacauuuaagaccgcucacgccaagaaacaggaaguggucguguuggguucucaggagggggcuaugcacacagcccucacuggcgcaaccgaaauccaaacguccggaaccacaacuaucuucgccggccaucugaagugccguuuaaaaauggauaagcugacccuaaaagggaugagcuaugucauguguacaggaucguucaagcucgagaaggaaguggcugagacucagcacgguaccguucuggugcagauuaaauacgagggcacggacgcgccuugcaagauaccauuuucuacacaggaugaaaaagggguaacccaaaacggacgccuuaucacugcaaaucccauugucacagacaaggagaaaccugugaacaucgaagccgagccacccuucggcgaguccuauauaguuauuggugcuggggaaaaggccuugaagcugucaugguuuaaaaagggcaguagcaucggaaaaauguucgaggcaaccgccagaggcgcuaggcggauggccauccucggggauacugcaugggacuuuggauccauugguggcguguucaccucugucgggaagcuggugcaucagaucuuuggaacagcguacggcguacuuuucagcggugugucauggacgaugaaaauugggauaggcguucuguugaccuggcucggacugaauagucgauccacuagcuuaucuaugacauguaucgcugucggccuggugacccuauaccucggggugaugguccaggccgauucaggaugcguuauuaacuggaagggccgcgaacugaagugugguagugggaucuuugugacaaaugaggugcacacuuggaccgaacaguauaaauuccaagcagacagcccgaagagacuuuccgccgcuaucggaaaagccugggaggagggcguaugcgguauuaggucuacgacacgguuggaaaacauaauguggaagcagaucucgaacgagcugaaucauauucuccuggaaaacgacaugaaauuuaccgucgugguuggcgauguggcagggaucuuagcucagggaaagaaaaugauucgcccucagcccauggaguacaaguauagcuggaaguccuggggcaaagccaagaucauaggggcggacguccaaaauacuaccuucaucauugauggaccaaacacaccugaaugucccgacgaucagagagccuggaauaucugggagguggaggacuacggcuuugguauuuucacuaccaacaucuggcugaaacuuagggauucauauacacagguuugcgaccaccguuugaugagugcugcaauaaaggauucuaaagccgugcacgcugacaugggguacuggauugaaagcgagaagaaugaaacguggaagcucgcccgggcauccuucaucgagguaaaaaccuguauuuggccaaagucacauacucuguggagcaacggaguccuagaaucugagaugaucauacccaaaaucuauggcgguccuauuucccagcacaauuaccgaccaggcuacuuuacacaaaccgcggggccguggcaucugggaaagcucgagcuggauuucgaccuuugcgaaggcacuacagugguggucgaugagcacugcgggaacagaggacccaguuugaggaccacgacuguuaccggcaaaaucauucacgaaugguguugccgcagcuguacacugccuccauuacgguuuaagggugaggacgggugcugguauggaauggagaucagacccgugaaggaaaaagaggaaaaucucguaaagucuaugguguccgccggcucaggugaggucgacaguuucagccugggccuucuguguauaucgauuaugaucgaagaggugaugaggucccgcuggucucgaaaaauguugaugaccgggacucucgcuguauuuuuccugcuaaucacaggacagcugaccuggaacgaucucauucggcugugcaucauggugggcgccaaugcaagcgaccguauggggaugggaacaacuuaccuugcuuugauggccaccuuuaagaugagaccuauguucgcagucggccuguuauuuaggcgccucacgucacgggaggugcugcuucugacaauuggucuaagucucguugccuccguggaacugccaaacucuuuggaggaacugggggauggauuagcuaugggcauaaugauccucaaacugcuuaccgacuuccagagccaucaacugugggcgacuuugcucucccugaccuuuauuaagacaacuuucucacuacacuaugccuggaagaccauggcaaugguccugagcaucguaagucuuuuuccccucugucugucuacgacaucccagaaaaccacuugguugccggugcuguuaggcagccucgggugcaagccucugacaauguuccuuauugcugagaauaaaaucuggggaagaaagucguggccacugaacgaagguauaauggccguuggcaucgugucaauuuugcucucuagucugcucaagaaugaugucccccuggccgggccucuuaucgcuggaggcaugcucauugcauguuacgugaucuccgguagcucugccgaccugagcuuggagaaggcggcugagguauccugggaagaggaagccgagcauucaggggcaagucacaauauauuaguggaaguccaggaugacggaaccaugaaaauuaaggaugaggagagggacgauacucugacaauccuccugaaggccacccuucuggcuguuagcggcguguaucccuugucuaucccagcaacgcuauucgugugguacuuuuggcagaaaaagaaacaacgauccggcguccugugggacacuccuucacccccagaaguggagcgcgccguucucgaugacgggauuuaucggauaaugcagagaggacugcuugguaggagucagguaggcgugggggucuuccaggaaaacguguuucauaccauguggcacguuacacguggagcgguguuaauguaccaaggcaagcgccuggagccgagcugggcuuccgucaaaaaggaccucaucucuuacggugggggauggcgguugcagggcucguggaauaccggcgaggaagugcagguaauugccgucgagccugggaagaaccccaaaaaugugcagacagcaccaggaacuuucaagaccagcgaaggugagguuggcgccaucgcucuggauuuuaaacccgggacgucaggauccccuauugugaacagagaaggcaagaucgucggucucuaugggaauggagugguuacaacaaguggcaccuacgugucugccauagcacaagcuaaagccagccaggagggcccacugcccgagaucgaagacgaggucuucaggaagcgaaaccuuacaauuauggaucugcacccuggguccggaaagacccggcgcuauuugccggcgaucgugagagaagccauuaaaaggaagcuacggacucugauccucgcaccaacccgaguaguggcuucagagauggccgaggcuuuaaaagguaugcccauaagauaccagacaacggcaguuaagucugagcauacuggcaaagagauugucgaccugaugugccacgccaccuuuacaaugcgccuucugagcccugugagggugccaaauuauaacaugaucaucauggaugaagcccauuucaccgaccccaguuccauugcugcgcguggguacaucagcacucgggucggaaugggcgaggcagccgcuauauuuaugacagccaccccuccggguucuguagaagcauucccccaaucaaaugccgugauucaggaugaggaaagagacaucccagagagguccuggaacaguggguaugaguggauuacggauuuuccuggaaagacuguuugguucgugcccagcaucaagucgggcaaugacauagcuaacugucuccgcaaaaauggcaagcgagucauucaguugucuagaaaaacauucgauaccgaauaccagaagaccaaaaacaacgacugggacuacgugguuacuacagauaucuccgagaugggggcgaauuuucgggccgacagggugaucgauccacgccguugccugaagccugucauucucaaggacggacccgaaagagugauccuggcagguccaaugccgguaaccguggcuagcgccgcacaacggaggggccgcauugggcgaaaccacaauaaagagggagaucaguauauauacaugggccagccucuuaacaaugacgaggaucaugcccacuggacagaagcuaagaugcuacuggacaacaucaauacucccgaggguauuaucccagccuuguucgaacccgagagagaaaaaucagcggcaaucgauggggaguaucgguuaaggggcgaggcccgcaagacguuuguugaacugaugagaaggggagaccucccugucuggcugaguuacaaaguggcuucugagggcuuccaguauuccgaucggcguuggugcuuugacggggaacgcaacaaucaagugcuugaggaaaacauggaugucgagauuuggaccaaggagggagaaagaaagaagcugagaccaagguggcucgacgcccggacauacagcgaccccuuggcucugcgcgaguucaaggaauuugcagccgguagaaggucaguuaguggcgaucuaauacuggagaucgggaaacucccucagcaccuuacucagcgggcucagaaugcccuggacaacuuagugauguugcauaauagcgaacaaggaggccgagcauauagacacgcgauggaggagcugccggauaccauugaaacacucaugcugcuugcccugaucgcuguacucaccgguggggugacuuuguucuuucuguccggccgcggauuaggcaagacgucuauugggcuacugugugucauggccagcuccgugcuccuuuggauggcaucaguugagccacauuggaucgcugccucuauaauccuggaguucuuuuugauggugcugcucauucccgagccugacaggcagcggacaccccaggauaaccagcuggcauacgucguaaucggacuucucuucaugauucugacaguggccgcuaaugagauggguuugcuggaaacuaccaaaaaggacuuaggcaucgggcacguugcggccgagaaccaccaucacgcagcuaugcuagauguggaccugcauccagccagugccuggacacucuacgcagucgcuaccacuauaauuacaccuaugaugcgucacacgaucgaaaacaccacugccaauauuucgcuuacagcgaucgcuaaccaagccgcaauacugaugggauuggauaaaggcuggcccaucagcaagauggacauuggugugccacugcucgcccuggggugcuauucccaggucaauccucuuaccuuaaccgcugcagugcugaugcucguugcccauuacgcgaucauuggcccgggauugcaggcuaaggccacaagagaggcacagaaaaggacugccgcuggcaucaugaagaaccccacgguggaugggauaguagccauugaccuggauccaguggucuaugacgcaaaauuugaaaagcagcuaggacagaucaugcugcucauccuuuguaccucucagauucuguugaugcgcacaacuugggcucugugcgagucaaucacccucgccacaggcccucugaccacuuuaugggaggguagccccgggaaauucuggaauacgacaauagcgguuuccauggccaacauuuuccggggaaguuaccuugcaggcgcuggucuggccuuuucucucaugaaaagccuaggcgggggacgaagaggcaccggggcacaaggagaaacucugggcgagaaguggaaaaggcaguugaaucagcugucaaaguccgaguucaacaccuauaaacgcagugguaucauggagguggaccggagcgaagcuaaggaggggcucaaaagaggagagacaacuaagcacgccgucucucguggcaccgccaaacuuaggugguuuguggaacggaaucugguaaaaccagaggguaaggugauugauuugggcugugggcgcggaggcugguccuacuauugcgcggggcugaaaaagguuacagaagugaaaggauacacgaagggcgguccugggcacgaggaacccaucccgauggcuaccuacggauggaaccucgucaaauuacauucaggcaaggacguguucuuuauaccaccugagaagugugauacucugcuuugcgacaucggcgagagcucgcccaauccaacaauugaagaggggcgaacccugagaguccuaaaaaugguggaacccuggcucaggggaaaccaguucuguaucaagauucugaauccuuauaugccgucuguuguagagacuuuggagcaaaugcagcggaaacacgguggcaugcuggugcgcaacccccucaguagaaauuccacacaugaaauguacugggucagcugcgggaccggaaacaucgugucagcaguuaauaugacguccaggaugcuucugaaccgauuuaccauggcccaccggaagccaacauaugagcgugauguggacuuaggcgcugguacuagacacgucgccguggaaccugagguagcaaaccuggauauuaucgggcagcgcauagaaaauauuaaacaugagcacaagucuaccuggcauuacgacgaggauaaccccuauaagacaugggccuaccacggaagcuaugaagugaaaccuaguggcuccgcuagcucuaugguuaauggcgucgugaaguugcucacuaaaccaugggacgugauccccauggucacccagaucgcgaugacagauaccacuccuuucgggcaacagaggguuuuuaaggagaaaguggacacgcggacaccaaaggccaagagaggaaccgcacagauuauggaaguaacugcuaaauggcugugggguuuccuaucacgcaacaagaaacccaggauauguacccgagaggaauuuacacggaaggugagaaguaaugccgcaaucggcgccgucuucguggacgagaaccaauggaacuccgcuaaagaggccguugaagaugagagguuuugggaccuugugcaucgcgaacgugagcugcacaagcaggggaagugcgcgacgugcgucuacaacaugaugggaaaacgggaaaagaaacucggcgaguucgguaaggcaaaagggagcagagccauuugguacauguggcugggagcuagguucuuggaguuugaagcccugggcuucaugaaugaggaucacugguuuucucgcgaaaacucgcucucaggcguggagggggagggacuucauaagcuggguuauaucuuacgagacauuagcaaaaucccgggcgggaauauguacgcagaugacaccgcuggaugggauacucggauaacagaagacgaucugcagaacgaggccaagaucaccgacauuauggaaccugagcacgcuuugcucgccaaguccaucuucaaacugacuuaucagaauaagguaguuagagugcaaaggccagccaaaaacggcacagucauggaugugauuagucgcagagaccagcgggguucuggacaggugggaaccuacggccuaaauacauuuacuaacauggaagcgcagcuuaucaggcaaauggagagcgagggcauauucucccccucagaacuggagaccccuaaccucgccgggcguguccuggauugguuggaaaagcauggaguugagcgauuaaaacgcauggcuauuaguggugacgacugugugguaaagccaaucgaugacagauuugccacggcacugaccgcucucaaugauaugggcaaggugcggaaagacaucccccagugggaaccgucuaagggguggaacgauuggcagcaggucccuuucugcagccaccacuuucaucaacuuauuaugaaagacggaagggagauagugguucccugucgcaaucaggaugagcuggugggcagagcccgggucucccagggugcaggguggucacuaagggaaacagccugccugggaaagagcuaugcgcagauguggcaacucauguacuuccaccgacgugacuugagacuggcugccaacgcaaucuguucugccgugccaguagauuggguuccuacuucccgcaccacauggaguauucaugcucaccaucaguggaugacuaccgaggacaugcuuagcguguggaaucgggucuggaucgaagagaaccccuggauggaagauaaaacgcacauuucguccuggggcgacgugccauaucugggcaagagggaggaccaguggugcgggucucucaucggauuaacagccagagcaaccugggcuacuaauauacaaguugccaucaaccaggugcgccggcugauugguaaugagaacuacuuggauuacaugacaucaaugaagagguuuaaaaaugaaagcgaccccgagggcgcgcugugguga

SEQ ID NO: 14007 - RNA, 9879 nt, Artificial Sequence
  derived and/or modified CDS sequence (opt3) from DENV-1__EU482806__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucuaauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacgacaugaaguucaccgugguagucggcgaugugguugggauucuggcucagggcaaaaagaugauccgcccucaacccauggagcacaaauacucguggaaaagcuggggcaaggccaagauaaucggggcggacgugcagaauacuaccuuuauuaucgauggaccaaacacaccugaaugucccgacgaucagagagccuggaauauuugggaggucgaggacuauggcuucgguaucuuuacuaccaacauauggcuuaaguugagggauuccuacacacaggugugcgaccaccgucucaugucagcugcaauuaaagauaguaaggccguucaugcugacaugggguauuggaucgaaucugagaaaaaugaaacguggaagcuggcccgggcauccuucauugaggugaagaccuguaucuggccaaaaucccacacucuauggucaaacggaguacuggaaagcgagaugauaauccccaagauuuacggcgguccuaucucucaacauaauuaucgaccaggcuacuucacacagaccgcggggccguggcaccucggaaaacuggagcuugauuuugacuugugcgaaggcacuacagucgugguggaugagcacugcgggaacagaggacccucccugaggaccacgacugucaccggcaagauuauccaugaaugguguugccgcaguuguacauuaccuccacuccgguucaaaggugaggacgggugcugguacggaauggagauaagacccguuaaggaaaaggaggaaaaucuggugaaaagcaugguaucugccggcuccggugagguggacucauuuagucuuggccuguuguguauuagcaucaugaucgaagaggucaugaggucgcgcuggucccgaaagaugcucaugaccgggacucuggcuguguuccuacugcucauuaugggacagcugacauggaacgaucuuauccgguugugcauuaugguuggcgccaaugcaucugaccguauggggaugggaaccacauaucuggcuuuaauggccacuuuuaaaaugagaccuauguucgcagugggccuccuguuuaggcgccuuaccagccgggagguccugcuacucacgauaggucugucauugguggccaguguugaacugccaaacuccuuagaggaacucggggauggacuggcuaugggcaucaugauucuuaagcuguugacagacuuccaaucucaccagcucugggcgacccugcuaagccugacuuuuaucaaaaccacacuuucccuccauuacgccuggaagacuauggcaauggugcugucaauugucagcuuguucccccuguguuuaaguaccacgucucagaagacaaccuggcucccgguacugcuuggcucccuggggugcaaaccuuugacuauguuucucaucgcugagaauaagauauggggaagaaaaagcuggccacugaacgaagguaucauggccgugggcguugugucgauucuacugucaucucuucucaagaacgaugucccccuggccgggccuuugaucgcuggaggcauguuaauugcauguuaugugaucagugguuccagcgccgaccugucucucgagaaagcggcugagguaagcugggaagaggaagccgagcacuccggggcaucacauaauauacugguggaaguccaggaugacggaacaaugaagauuaaagaugaggagagggacgauacccuuacuauccuguugaaggccacacuacuggcuguuaguggcguguacccccucagcaucccagcaacccuguucgugugguauuuuuggcaaaagaaaaagcagcgaucuggcguccuuugggacacgccuucacccccagaaguggagcgcgccguuuuagaugacgggauuuaccggauaaugcagagaggacugcucgguaggagccagguaggcgugggggucuuccaagaaaacguguuccacacuauguggcacguuacccguggagcgguguugauguaucagggcaaacgccuggagccgaguugggcuagcgucaagaaagaccucaucuccuacggugggggauggcggcugcagggcucuuggaauacaggcgaggaagugcagguaauugccgucgagccugggaagaaccccaagaaugugcaaaccgcaccaggaacauuuaaaacucccgaaggugagguuggcgccaucgcucuugauuucaagccugggaccucgggaagcccaauugugaacagagaaggcaaaaucgucggucuguacgggaauggagugguuacgacaucaggcacuuauguguccgccauagcacaggcuaaggccagucaggagggccccuugccugagaucgaagacgaggucuuuaggaaacgaaaccuaaccauuauggaucugcauccggggucuggaaagacacggcgcuaccucccagcgaucgugagagaagccauuaagaggaaauuacggacccugauccuugcacccacucgaguaguggcuagcgagauggccgaagcucugaaggguaugccuauaagauaucaaaccacagcaguuaaauccgagcacacgggcaaggagauugucgaccucaugugccaugccacuuucaccaugcgcuugcugucaccagugagggugcccaauuacaacaugaucaucauggaugaagcccacuuuacagacccuucuagcauugcugcgcguggguauaucaguacccgggucggaaugggcgaggcagccgcuauauucaugacugccacaccgcccgguuccguagaagcauuuccacagagcaaugccgugauucaggaugaggaaagagacaucccugagaggucuuggaacucaggguacgaguggauuaccgauuuccccggaaaaacgguuugguuugugccauccaucaagaguggcaaugacauagcuaacugucuccgcaagaauggcaaacgagucauucagcugagcagaaagacuuucgauacagaauaucagaaaaccaagaacaacgacugggacuacgugguuaccacugauaucucggagaugggggcgaauuuucgggccgacagggugaucgauccucgccguugccuuaaacccgucauucuaaaggacggaccagaaagagugauccuggcagguccgaugccuguaacaguggcuucugccgcacagcggaggggccgcauugggcgaaaccauaauaaggagggagaucaguacauauauaugggccagcccuugaacaaugacgaggaucacgcccacuggaccgaagcuaaaauguuacuggacaacaucaauacaccagaggguauuauccccgcccucuucgaaccugagagagaaaaguccgcggcaaucgauggggaguaccggcugaggggcgaggcccgcaaaacuuucguugaacuuaugagaaggggagaccugccagucuggcucagcuauaagguggcuucagagggcuuucaauacagugaucggcguuggugcuucgacggggaacgcaacaaucagguguuggaggaaaacauggaugucgagauuuggacgaaagagggagaacgaaagaaacugagacccagguggcuagacgcccggaccuauucugacccucuggcucuccgcgaguuuaaggaguucgcagccgguagaagguccguuagcggcgaucuuauacuggagaucgggaaguuaccgcagcauuugacacagcgggcucaaaaugcccuggacaaccucgugaugcugcacaauucagaacagggaggccgagcauacagacaugcgauggaggagcuuccagauacuauugaaacccugaugcucuuggcccugaucgcuguauuaacagguggggugacccuauuuuuccugaguggccgcggacucggcaaaacuagcauugggcuucugugugucauggccuccucuguguugcuguggauggcaagcguugagccccacuggaucgcugccuccauaauccucgaauuuuuccugauggugcuucucauuccugagcccgacaggcagcggacgccacaggauaaccaacuggcauaugucguaaucggauugcuguuuaugauuuuaaccguggccgcuaaugagaugggucuacuggaaacaacuaagaaagaccucggcaucgggcacguugcgguggagaaccaucaccaugccaccaugcuugaugucgaccugcacccugcaucagcuuggacauuguacgccguggccaccacuauaauuacacccaugaugcgucauacgaucgaaaacaccacugcaaauauuucucugacagcuaucgccaaccaggcggcuauacucaugggacuggauaagggcuggccaaucaguaaaauggacauuggugucccucuuuuagcccuggggugcuacagccaggugaauccgcucaccuugaccgcagccguucugaugcuaguggcucacuaugcaaucauuggccccggacugcaagccaaggcgacaagagaggcucagaagaggacugccgcaggcaucaugaaaaacccaacgguagaugggauaguggccauugaccucgauccugucguuuacgacgcuaaguucgaaaaacagcuuggacagaucaugcuguugauccuguguaccagccaaauucuccugaugcgcacaacuugggccuuaugcgaguccaucacccuugcaacaggcccccugaccacucucugggaggguucuccagggaaguuuuggaauacgacaauagcugugucaauggccaacauuuuccggggaagcuaucuagcgggcgccggucuggcauuuuccuugaugaaaagucugggcgggggacgaagaggcaccggggcucagggagaaacucucggcgagaaguggaagaggcagcuuaaucagcugucuaaaagcgaguucaacaucuacaagcgcucagguauuauggaggucgaccgguccgaagccaaagagggguugaagagaggagagaccacacgucacgcagugaguaggggcacugcuaaacugcggugguucguagaacgcaaucucgugaagccugaggguaagguuaucgauuuaggcugugggcgaggaggcuggagcuauuacugcgccgggcugaaaaaggugaccgaagucaaaggauauacaaagggcggucccgggcaugaggaaccgauaccaauggccacguacggauggaaccuugugaaacugcacucuggcaaggacgucuuuuucaccccucccgagaaaugugauacucuacucugcgacaucggcgaguccucaccaaaucccacaauugaagaggggagaacccugaggguguugaagaugguugaaccuuggcugcggggaaaccaauuuuguaucaagauucucaauccguacaugcccagcguaguggagacucuugagcagaugcagcgcaaacaugguggcaugcuggucagaaacccauuaucgagaaauucuacacacgaaauguauugggugaguugcgggaccggaaacaucguuuccgcggugaauaugacgagccgaaugcuguugaaccgguucaccauggcucaccguaagccuacauacgagagagaugucgaccucggcgcagguacucgccauguggccguagaacccgagguggcuaaccuggauauuaucgggcagaggauagaaaauauuaaacacgagcauaagucaaccuggcacuaugacgaggauaacccuuacaaaacaugggccuaucauggauccuacgaaguuaagccaucuggcagcgcaaguuccauggucaauggcguggugaagcuacuuacuaaacccugggacgucaucccuaugguuacccaaaucgccaugacagauaccacuccauuugggcagcagcggguguucaaggagaaaguagacacgagaacacccaaggcuaaacgcggaaccgcgcaaauuauggaagugacugccagguggcugugggguuuucucagccgaaacaagaagccgcggauauguaccagagaggaguucacaaggaaaguccgcucuaaugcagcuaucggcgccguguuuguugacgagaaccaguggaacucagcaaaggaggccguggaagaugagcguuucugggaccugguccagaaagaacgggaguugcacaagcaggggaaaugcgcuacgugcguguauaacaugaugggaaagagagaaaagaaacugggcgaguuugguaaggccaaagggaguagggcgauuugguacauguggcucggagcacgcuuccuugaguuugaagcccugggcuucaugaaugaggaucacugguucucccgagaaaacagcuuaucuggcguagagggggagggacugcauaaguuggguuacauccuccgggacauuucgaaaaucccuggcgggaauauguaugcugaugacaccgccggaugggauacuagaauaacagaagacgaucugcaaaacgaggcaaagaucaccgacauuauggaaccagagcacgcucuacuugccacuucaaucuuuaaacugacauaccagaauaagguugugaggguccagcgccccgcuaagaacggcaccgugauggaugugauuagcagacgggaccagagggguuccgggcaagucggaacauauggccucaauacuuucaccaacauggaagcccagcugauccgucagauggagagugagggcauauuuucuccuugugaauuggagauuccaaacuuagcagaacgaguucuggauuggcucgagaaauacgggguggaacgccuuaagagaauggcgaucagcggagacgacugcguagugaaacccaucgaugaccgguucgccacggcucugaccgcccuaaaugauauggguaaggucaggaaagacgugccgcagugggagccuuccaagggcuggaacgauuggcaacagguucccuuuuguucacaucacuuccaccagcugauuaugaaggacgggcgcgagauaguggucccaugcagaaaucaggaugaacucgugggacgggcaaggguaagucaaggcgcugguuggucuuugcgagagacagccugucuggggaaaagcuaugcacagauguggcagcuuauguacuuucaucguagagaccugcgccucgccgcgaacgcuaucugcuccgccguuccuguggauuggguccccacuucacggaccacauggagcauucacgcacaucaccaauggaugacuaccgaagacauguuaucuguguggaauaggguuuggaucgaggaaaacccauggauggaggauaagacgcauguguccaguuggggagacguccccuaucugggcaaaagagaggaccagugguguggcagcuugauugggcugacagcccgcgcuaccugggccucgaauauccagguggcaauaaaccagguacggaggcucaucggaaaugaaaacuaccuugauuacaugacuuccaugaagcgauucaaaaaugagggugacccugaaggcgcucugugguga

SEQ ID NO: 14008 - RNA, 9879 nt, Artificial Sequence
  derived and/or modified CDS sequence (opt3) from DENV-1__EU482807__SS-prME
agcgugaccaugcugcucaugcuuaugcccacagcacuggcuuuccacuugacuacgagaggcggggaaccucauaugaucgucuccaagcaggaaaggggaaaaucuuuacuguuuaagaccucagccgguguuaauaugugcacccuaguggccauggaccucggcgaguucugugaagauacuaugaccuacaaaugcccacggauuacagaagcggaaccggacgauguagacuguuggugcaaugcuaccgauacuugggugacauaugggaccuguagucagacgggagagcaccgccgagacaagcguagcgucgcccuggcaccccaugugggccuuggucuggagacuagaaccgaaacauggauguccucugagggggccuggaaacagauacagaggguugaaacuugggcuuugcggcacccuggauuuaccgugaucgcacucuuccuggcccaugcuauuggcacaucgaucacccagaagggcauuaucuuuauacugcucauguuagucacgccaucaauggccaugcgcugcguggggaucggaagcagagauuucguugagggucugaguggcgcgacuuggguugacgugguccuugagcacggguccugugugacaaccauggcaaaggauaaacccacuuuggacauugaacugcuaaagacagaggugaccaacccugccguccucaggaaacugugcaucgaagcuaagauuucuaauacgaccacagauagccgguguccaacucaaggagaggccacccuuguugaagaacaggacgcaaacuuugugugccgccgaacauucguagauagaggcugggguaauggguguggacuguuuggcaaaggcuccuugaucacuugcgcuaaguucaagugcgugaccaaacucgaggggaagacaguccaguacgaaaaccugaaauauucagugauaguuaccgugcacacuggagaccagcaucaagucgguaaugagaguacggaacacggcacaaccgccacuauuacaccccaggcgccuagcacagagauccaguuaaccgacuacggggcccugacucucgauuguucuccaaggacaggacuugacuuuaacgaaauggugcuguugacgaugaaggagaaauccuggcuaguacauaagcagugguuccuggaucucccgcugcccuggaccucaggcgcaagcacaagucaagagacauggaaucggaaagaccuucugguuaccuuuaagacagcucacgccaagaaacaggaaguggucguguuggguucucaggagggggcuaugcacacugcccucaccggcgcaacggaaauucaaaccuccggaacaacuaccaucuucgccggccaucugaagugccguuuaaaaauggauaagcugacacuaaaagggaugagcuaugucauguguacuggaucguucaagcucgagaaggaaguggcugagacccagcacgguacgguucuggugcagaucaaauacgagggcacagacgcgccuugcaagauuccauuuucuacccaggaugaaaaagggguaacucaaaacggacgccuuauaacagcaaaucccaucgucaccgacaaggagaaaccugugaacauugaagccgagccacccuucggcgaguccuauaucguuauaggugcuggggaaaaggccuugaagcugucaugguuuaaaaagggcaguagcauuggaaaaauguucgaggcaacugccagaggcgcuaggcggauggccauccucggggauaccgcaugggacuuuggauccaucgguggcguguucacaucugucgggaagcuggugcaucagauuuuuggaacggcguacggcguacuuuucagcggugugucauggaccaugaaaaucgggauuggcguucuguugacuuggcucggacugaauagucgauccacuagcuuaucuaugaccuguauagcugucggccuggugacacuauaccucggggugaugguccaggccgauucaggaugcguuaucaacuggaagggccgcgaacugaagugugguagugggauuuuugugacuaaugaggugcacaccuggacggaacaguauaaauuccaagcagacagcccgaagagacuuuccgccgcuaucggaaaagccugggaggagggcguaugcgguaucaggucugcaacacgguuggaaaacauuauguggaagcagauaucgaacgagcugaaucauauccuccuggaaaacgacaugaaauuuaccgucgugguuggcgauguggcugggauuuuagcccagggaaagaaaaugauccgcccucagcccauggaguacaaguauagcuggaaguccuggggcaaagcgaagauuaucggggccgacguccaaaauacuaccuucauaaucgauggaccaaacacaccugaaugucccgacgaucagagagcuuggaauauuugggagguggaggacuacggcuuugguaucuucacuaccaacauuuggcugaaacuuagggauucauauacacagguuugcgaccaccguuugaugagugcagccaucaaggauucuaaagcugugcacgccgacaugggguacuggauagaaagcgagaagaaugaaacguggaagcucgcacgggcguccuucauugagguaaaaaccuguaucuggccaaagucacauacucuguggagcaacggaguccuagaaucugagaugauuauccccaaaauauauggcgguccuaucucccagcacaauuaccgaccaggcuacuuuacacaaaccgccgggccguggcaucugggaaagcucgagcuggauuucgaccuuugcgaaggcacuacagugguggucgaugagcacugcgggaacagaggacccaguuugaggaccacgacuguuaccggcaaaauuauccacgaaugguguugccgcagcuguacacugccuccauuacgguuuaagggugaggacgggugcugguauggaauggagauuagacccgugaaggaaaaagaggaaaaucucguaaagucuaugguguccgcuggcucaggugaggucgacaguuucagccugggccuucuguguaucucgauaaugauugaagaggugaugaggucccgcuggucucgaaaaauguugaugaccgggacucucgccguauuuuuccugcuaaucaucggacagcugacauggaacgaucucauucggcugugcaucauggugggcgcaaaugcuagcgaccguauggggaugggaaccacauaccuugccuugauggcaacuuuuaagaugagaccuauguucgccgucggccuguuauuuaggcgccucaccucacgggaggugcugcuucugacgauuggucuaagucucguugcuuccguggaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuaugguccugagcaucguaagucuuuuuccccucugucugucuaccacgucccagaaaacaaccugguugccggugcuguuaggcagccucgggugcaagccucugacuauguuccuuauugccgagaauaaaaucuggggaagaaggucguggccacugaacgaagguauaauggccguuggcaucgugucaauuuugcucucuagucugcuaaagaacgaugucccccuggcugggccucuuaucgcaggaggcaugcucauugccuguuacgugaucuccgguagcucugcggaccugagcuuggagaaagcugccgagguauccugggaagaggaagcagagcauucaggggccagucacaauauauuaguggaaguccaggaugacggaacaaugaagauuaaagaugaggagcgagacgauacccugacuauccuccugaaggcuacacuucuggcaguuagcggcguguaucccuugucuaucccagccacccuauucgugugguacuuuuggcagaagaaaaagcaacgcuccggcguccugugggacacgccuucacccccagaaguggagcgggcgguucucgaugacgggauuuauagaauaaugcagaggggacugcuuggucguagucagguaggcgugggggucuuccaggaaaacguguuucauacuauguggcacguuacccgcggagcuguguuaauguaccaaggcaaacggcuggagccgagcugggccuccgucaagaaagaccucaucucuuacggugggggauggagauugcagggcucguggaauacaggcgaggaagugcagguaauugcagucgagccugggaagaaccccaagaaugugcagaccgccccaggaacauucaaaacuagcgaaggugagguuggcgcuaucgcccuggauuuuaagcccgggaccucaggauccccuauugugaacagggaaggcaaaaucgucggucucuaugggaauggagugguuacgacaaguggcacuuacgugucugcaauagcucaagccaaggcgagccaggagggcccacugcccgagaucgaagacgaggucuuccgaaaacggaaccuuaccauuauggaucugcacccuggguccggaaagacacgcagauauuugccggccaucgugagggaagcaauuaagcggaaacuacgaacccugauccucgcuccaacuagaguaguggccucagagauggcugaagcauuaaaggguaugcccauacgcuaccagaccacagccguuaaaucugagcauacgggcaaggagauugucgaccugaugugccacgccacuuuuaccaugaggcuucugagcccugugcgugugccaaauuauaacaugaucaucauggaugaagcucauuucacagaccccaguuccauugcggcacggggguacaucagcaccagagucggaaugggcgaggccgcugccauauuuaugacugcaacaccuccggguucuguagaagccuucccccaaucaaaugcugugauucaggaugaggaaagggacaucccagagcgcuccuggaacaguggguaugaguggauuaccgauuuuccuggaaaaacgguuugguucgugcccagcaucaagucgggcaaugacauagcgaacugucuccgaaagaauggcaaaagagucauucaguugucucggaagacuuucgauacagaauaccagaaaaccaagaacaacgacugggacuacgugguuaccacugauaucuccgagaugggggccaauuuuagggcagaccgcgugaucgauccacguagaugccugaaaccugucauucucaaggacggacccgaacgggugauccuggcugguccaaugccgguaacaguggccagcgcagcccaaaggcgcggccgaauugggagaaaccacaauaaggagggagaucaguauauauacaugggccagccucuuaacaaugacgaggaucaugcucacuggaccgaagccaaaaugcuacuggacaacaucaauacacccgaggguauuaucccagcguuguucgaacccgagcgggaaaagucagcagccaucgauggggaguauagguuacgcggcgaggcuagaaaaacuuuuguugaacugaugaggcggggagaccucccugucuggcugaguuacaagguggccucugagggcuuccaguauuccgaucgucgcuggugcuuugacggggaacgaaacaaucaagugcuugaggaaaacauggaugucgagauuuggacgaaagagggagaaagaaagaaacugaggccacgguggcucgacgcucgcaccuacagcgaccccuuggcacugagagaguucaaggaauuugccgcugguaggcggucaguuaguggcgaucuaauacuggagaucgggaagcucccucagcaccuuacacagcgagcccagaaugcacuggacaacuuagugauguugcauaauagcgaacaaggaggcagagcguaucgccacgccauggaggagcugccggauacuauugaaacccucaugcugcuugcucugaucgccguacucacagguggggugaccuuguucuuucuguccggcaggggauuaggcaaaacuucuauugggcuacugugugucauggcaagcuccgugcuccuuuggauggcuucaguugagccacauuggaucgccgcaucuauaauccuggaguucuuuuugauggugcugcucauucccgagccugaccggcagcguacgccccaggauaaccagcuggccuacgucguaaucggacuucucuucaugauucugaccguggcugcgaaugagauggguuugcuggaaacaacuaagaaagacuuaggcaucgggcacguugccguggagaaccaccaucacgcagcuaugcuagaugucgaccugcauccagccagugccuggacccucuacgcaguggcuacaaccauaauuacuccuaugaugagacacacaaucgaaaacacgaccgccaauauuucgcuuacugcgaucgcuaaccaagccgcaauacugaugggauuggauaagggcuggcccaucagcaaaauggacauuggugucccacugcucgcccuggggugcuauucccaggugaauccucuuacauuaaccgcugcaguucugaugcucguggcccauuacgcgaucauuggcccgggauugcaggcuaaggccaccagggaggcacaaaagcgcacagccgcuggcaucaugaaaaaccccacuguagaugggauaguggccauugaccuggauccagucguuuaugacgcaaaguuugaaaaacagcuaggacagaucaugcugcucauccuuuguacgucucagauucuguugaugcggaccacaugggcucugugcgagucaaucacucucgccaccggcccucugacaaccuuaugggaggguagccccgggaaguucuggaauacuacgauagcgguguccauggccaacauuuuccgaggaaguuaccuugcaggcgcuggucuggccuuuucucucaugaaaagccuaggcgggggaagaaggggcacaggggcacaaggagaaacccugggcgagaaguggaagcgccaguugaaucagcugucaaaauccgaguucaacacuuauaagcggagugguaucauggaggucgacagaagcgaagcuaaagaggggcucaagcguggagagaccacaaaacacgccgugucuaggggcacugccaaacuucggugguuuguagaacgcaaucuggugaagccagaggguaaaguuauugauuugggcugugggcgaggaggcugguccuacuauugcgcggggcugaagaaagugaccgaagucaagggauacacaaaaggcgguccugggcacgaggaacccaucccgauggcuacguacggauggaaccucgugaaguuacauucaggcaaagacgucuucuuuauaccaccugagaagugugauacccugcuuugcgacaucggcgagagcucgcccaauccaacuauugaagaggggagaacacugagggugcuaaagaugguugaacccuggcuccggggaaaccaguucuguaucaaaauucugaauccuuauaugccgucuguaguggagaccuuggagcgcaugcaaagaaagcacgguggcaugcuggucaggaacccccucagucgaaauuccacucaugaaauguacugggugagcugcgggacaggaaacaucguuucagcagugaauaugaccucccggaugcuucugaaccguuuuacgauggcccacagaaaaccaaccuaugagcgcgaugucgacuuaggcgcugguacaaggcacguggccguagaaccugagguggcaaaccuggauauuaucgggcagcggauagaaaauauuaagcaugagcacaaaucuacuuggcauuacgacgaggauaaccccuauaagaccugggccuaccacggaagcuaugaaguuaagccuaguggcuccgcuagcucuauggucaauggcguggugaaauugcucacaaagccaugggacgucauccccaugguuacucagaucgcgaugaccgauacaaccccuuucgggcagcaaagaguguuuaaagagaagguagacacucgcacgccaaaagccaagaggggaacagcacagauuauggaagugaccgcuaaguggcugugggguuuccuaucacgaaacaaaaagccccggauauguacuagagaggaauuuaccaggaaaguccgcaguaaugccgcaaucggcgccguguucguugacgagaaccaguggaacuccgcuaaggaggccguggaagaugagcguuuuugggaccuuguccaucgggaaagagagcugcacaaacaagggaagugcgcgacaugcguguacaacaugaugggaaagagggagaagaagcucggcgaguucgguaaagcaaaggggagccgcgccauuugguacauguggcugggagcucgauucuuggaguuugaagcccugggcuucaugaaugaggaucacugguuuucucgggaaaacucgcucucaggcguagagggggagggacuucauaaacuggguuauaucuuaagagacauuagcaagaucccgggcgggaauauguacgcagaugacacggcuggaugggauaccaggauaacugaagacgaucugcagaacgaggccaaaaucacagacauuauggaaccugagcacgcuuugcucgccaaguccaucuucaagcugaccuaucagaauaaaguugugcgcguccagagaccagcaaagaacggcacugugauggaugugauuagucggagggaccaacgugguucugggcaggucggaacauacggccuaaauaccuuuacaaacauggaagcgcagcuuauccgacagauggagagcgagggcauauucucccccucagaacuggagacuccuaaccucgccgggcgcguucuggauugguuggaaaaacauggaguggagagauuaaagcggauggcuauuaguggugacgacuguguagugaaaccaaucgaugacagguuugccaccgcacugacggcucucaaugauaugggcaagguccgcaaggacaucccccaaugggaaccgucuaaaggguggaacgauuggcaacaggugccuuucugcagccaccacuuucaucagcuuauuaugaaggacggaagagagauaguugugcccugucggaaucaagaugagcuggucggcagggcccgagugucccagggugcaggguggucacuacgugaaaccgccugccugggaaaaagcuaugcgcagauguggcagcucauguacuuccacagacgcgacuugcggcuggcugccaacgcaaucuguucugccguaccaguugauugggugccuacauccaggacuaccuggaguauucaugcucaccaucaauggaugacaacugaggacaugcuuagcgucuggaauagaguguggaucgaagagaaccccuggauggaagauaagacccacauuucguccuggggcgacguuccauaucugggcaaacgcgaggaccaguggugcgggucucucaucggauuaacggcccgggcaacaugggcuaccaauauacagguggccaucaaccaagucaggcgacugauugguaaugagaacuacuuggauuacaugacuucaaugaagagauuuaagaaugaaagcgaccccgagggcgcgcugugguga

SEQ ID NO: 14009 - RNA, 9879 nt, Artificial Sequence
  derived and/or modified CDS sequence (opt3) from DENV-1__EU482808__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaacgaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuacuauugcgcggggcugaaaaagguuaccgaagugaaaggauacacaaagggcgguccugggcacgaggaacccaucccgauggcuacguacggauggaaccucgucaaauuacauucaggcaaggacguguucuuuaccccaccugagaagugugauacucugcuuugcgacauaggcgagagcucgcccaauccaacaaucgaagaggggcgaacccugagaguccuaaaaaugguggaacccuggcucaggggaaaccaguucuguauuaagauccugaauccuuauaugccgucuguuguagagacuuuggagcaaaugcagcggaaacacgguggcaugcuggugcgcaacccccucaguagaaauuccacacaugaaauguacugggucagcugcgggaccggaaacauugugucagcaguuaauaugacguccaggaugcuucugaaccgauuuaccauggcccaccggaagccaacauaugagcgugauguggacuuaggcgcugguacuagacacgucgccguggaaccugagguagcaaaccuggauaucauugggcagcgcaucgaaaauauaaaacaugagcacaagucuaccuggcauuacgacgaggauaaccccuauaagacaugggccuaccacggaagcuaugaagugaaaccuaguggcuccgcuagcucuaugguuaauggcgucgugaaguugcucacuaaaccaugggacgugauucccauggucacccagaucgcgaugacagauaccacuccuuucgggcaacagaggguuuuuaaggagaaaguggacacgcggacaccaaaggccaagagaggaaccgcacagaucauggaaguaacugcuaaauggcugugggguuuccuaucacgcgacaagaaacccaggauuuguacccgagaggaauuuacacggaaggugagaaguaacgccgcaauaggcgccgucuucguggaugagaaucaauggaacuccgcuaaagaggccguugaagacgagagguuuugggaucuugugcaucgcgaacgugagcugcacaagcaggggaagugcgcgacgugcgucuacaauaugaugggaaaacgggaaaagaaacucggcgaguucgguaaggcaaaagggagcagagccaucugguacauguggcugggagcuagguucuuggaguuugaagcccugggcuucaugaacgaggaccacugguuuucucgcgaaaauucgcucucaggcguggagggggagggacuucauaagcuggguuauauuuuacgagauaucagcaaaauuccgggcgggaacauguacgcagacgauaccgcuggaugggacacucggaucacagaagaugaccugcagaaugaggccaagauaaccgauaucauggaaccugagcacgcuuugcucgccaaguccauuuucaaacugacuuaucagaacaagguaguuagagugcaaaggccagccaagaauggcacagucauggacgugaucagucgcagagaucagcgggguucuggacaggugggaaccuacggccuaaacacauuuacuaauauggaagcgcagcuuauuaggcaaauggagagcgagggcaucuucucccccucagaacuggagaccccuaaccucgccgggcguguccuggacugguuggaaaagcauggaguugagcgauuaaaacgcauggcuauaaguggugacgauugugugguaaagccaauugacgauagauuugccacggcacugaccgcucucaacgacaugggcaaggugcggaaagauaucccccagugggaaccgucuaagggguggaaugacuggcagcaggucccuuucugcagccaccacuuucaucaacuuaucaugaaagauggaagggagauugugguucccugucgcaaccaggacgagcuggugggcagagcccgggucucccagggugcaggguggucacuaagggaaacagccugccugggaaagagcuaugcgcagauguggcaacucauguacuuccaccgacgugauuugagacuggcugccaaugcaauauguucugccgugccaguagacuggguuccuacuucccgcaccacauggaguauccaugcucaccaucaguggaugacuaccgaggauaugcuuagcguguggaaccgggucuggauugaagagaaucccuggauggaagacaaaacgcacaucucguccuggggcgacgugccauaucugggcaagagggaggaucaguggugcgggucucucauuggauuaacagccagagcaaccugggcuacuaacauccaaguugccauaaaucaggugcgccggcugaucgguaacgagaauuacuuggacuacaugacaucaaugaagagguuuaaaaacgaaagcgaucccgagggcgcgcugugguga

SEQ ID NO: 14010 - RNA, 9879 nt, Artificial Sequence
  derived and/or modified CDS sequence (opt3) from DENV-1__EU482809__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacugucgugguggaugagcacugcgggaacagaggacccagucugaggacaaccacggucacuggcaagauuauccacgaaugguguugccgcagcuguaccuuaccuccacuccgguucaaaggugaggacgggugcugguauggaauggagauaagacccguuaaggaaaaggaggaaaaucuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaacgaucugauccggcuuugcauuaugguuggcgcaaaugcuagcgaccguauggggaugggaacaaccuacuuggcccugauggcaacauucaaaaugagaccuauguuugccgugggcuuacucuucaggcgccugacuucacgggagguccuucugcuaaccauaggucucagucugguggcuuccguugaauugccaaacucucuggaggaauuaggggauggacucgcgaugggcaucaugauucugaagcuucugacggacuuucaaagccaucaguugugggccacacuccugucccuaaccuucaucagaacuaccuuuucacugcacuaugcauggaaaacaauggcuauggugcuuagcauugucagucucuucccccuguguuugucuacuaccucccagaagacgacauggcugccgguauuacucggcagccuggggugcaagccucuuaccauguuucugaucgccgagaauaaaauauggggaaggaagucguggccauugaacgaagguaucauggccgugggcauuguuucaauccuccugucuagucuacugaaaaacgaugugccccuugcugggccucucauugcaggaggcaugcugaucgccuguuacgucauauccgguagcucugcggacuugagcuuagagaaggcugccgagguguccugggaagaggaagcagagcauucaggggccagucacaauauucugguagaagugcaggaugacggaacuaugaaaaucaaggaugaggagcgagacgauacacucaccauccugcuuaaagcuacucuguuggcagucagcggcguuuauccccuaucuauuccagccacacuguucgugugguacuucuggcaaaagaagaaacagcgcuccggcgugcucugggacaccccuucacccccagaagucgagcgggcggugcuggaugacgggauauauagaaucaugcagaggggacuuuuaggucguagucagguuggcguagggguguuucaagaaaacgucuuccauacgauguggcacgugacucgcggagcuguucugauguaccagggcaagcggcucgagccgagcugggccuccgugaaaaaggacuugauuucuuacggugggggauggagacugcagggcucguggaauaccggcgaggaaguccaggugaucgcaguagagccugggaaaaaccccaagaauguccaaacagccccaggaaccuuuaagacaagcgaaggugaggugggcgcuauugcccucgauuucaaacccgggacuucaggauccccuaucguuaacagggaaggcaagauagugggucuguaugggaauggagucgugaccacgaguggcacauacguuucugcaaucgcucaggccaaagcgagccaggagggcccacuucccgagauugaagacgagguguuucgaaagcggaaccugacuaucauggauuugcacccuggguccggaaaaacccgcagauaucuaccggccauugucagggaagcaaucaagcggcgacugagaacacucauauuagcuccaacccgcgugguagccucagagauggcugaagcacugaaggguaugcccauuagguaccaaacuaccgccgugaaaucugagcauacaggcaaggagaucguugaccuuaugugccacgccacguucacuaugcgucugcucagcccuguccgggugccaaauuauaacaugaucauuauggaugaagcucauuuuaccgaccccaguuccaucgcggcaagaggguacauaagcacaagggugggaaugggcgaggccgcugccauuuucaugaccgcaacuccuccggguucugucgaagccuuuccccagucaaaugcuguaauccaggaugaggaacgcgacauuccagagcgauccuggaacaguggguaugaguggaucacagauuucccuggaaaaaccgugugguuuguucccagcauaaagucgggcaaugacauugcgaacuguuugagaaaaaauggcaagcgggugauccagcugucuaggaagacguucgauacugaauaccaaaaaacaaagaacaacgacugggacuacgucgugaccaccgauaucuccgagaugggggccaauuuccgcgcagaccguguuauugauccaagacggugccucaaaccugugauccugaaggacggacccgaaagggucauucuugcugguccaaugccggugacuguagccagcgcagcccagcgccgaggcagaauagggcggaaccacaauaaagagggagaucaguauaucuacaugggccagccucuaaacaaugacgaggaucaugcucacuggacagaagccaagaugcuguuggacaacauuaauacccccgaggguaucaucccagcguuauuugaacccgagagggaaaagucagcagccauugauggggaguaucgccugagaggcgaggcuaggaaaacauucguggaacucaugcggcguggagaccugccuguuuggcuuaguuacaaggucgccucugagggcuuucaauauuccgaucgccgauggugcuucgacggggaaagaaacaaucaggugcuggaggaaaacauggauguggagauauggacuaaagagggagaaaggaagaaacuccggccacgcugguuggacgcuagaacguacagcgacccccuggcacuaagggaguuuaaggaauucgccgcuggucggcgaucagucaguggcgaucugauccucgagauugggaaacuuccucagcaccugacccagagagcccaaaaugcauuagacaacuugguuaugcugcauaauagcgaacagggaggccgcgcguauaggcacgccauggaggagcucccggauacaaucgaaacucugaugcuucuggcucucauugccguguugaccggugggguaacacuguuuuucuuauccggccggggacuaggcaagaccucuaucgggcugcucugugugauggcaagcuccguccuucuguggauggcuucaguggagccacauuggauagccgcaucuaucauuuuggaauuuuuccugaugguucuccugauccccgagccugaccgucagagaacuccccaggauaaccaacuugccuacguggucauuggacuccuguuuaugaucuugacgguagcugcgaaugagaugggucuguuagaaaccacaaagaaagaccuaggcauagggcacguggccguugagaaccaccaucacgcagcuaugcuggauguggaccuccauccagccagugccuggacucuuuacgcagucgcuaccacaauuaucaccccuaugaugaggcacacuauugaaaacacaacggccaauaucucgcugaccgcgauagcuaaccaggccgcaaucuugaugggacuggauaagggcuggcccauuagcaaaauggacaucggugugccacuccuggcccuugggugcuauucccaggucaauccuuuaacucugacagcugcagugcucauguugguugcccauuacgcgauuaucggcccgggacugcaagcuaaggccacccgcgaggcacagaaacggaccgccgcuggcauaaugaagaaccccacaguggaugggauuguagccaucgaccuagauccaguggucuaugacgcaaaguucgaaaaacagcugggacagaucaugcuccuuauucuguguacuucucaaaucuugcugaugcgaacgaccugggcucucugcgagucaauaacacuggccacuggcccuuuaaccacacuuugggaggguagccccgggaaguuuuggaauaccacuauugcgguuuccauggccaacaucuucagaggaaguuaccuggcaggcgcuggucucgccuucucucuaaugaaaagccugggcgggggaaggcgcggcacgggggcacagggagaaacauugggcgagaaguggaaacggcagcugaaucagcucucaaaguccgaauuuaacaccuauaagagaagugguauuauggagguggaccguagcgaagcuaaagaggggcuuaagaggggagagacuaccaaacacgccgucucucggggcacagccaagcugcgcugguucguggaacgaaauuugguaaaaccagaggguaaggugaucgaucugggcugugggagaggaggcugguccuacuauugcgcggggcucaagaaaguuacugaagugaagggauacaccaaaggcgguccugggcacgaggaacccauaccgauggcuacauacggauggaacuuagucaagcugcauucaggcaaagacguguuuuucaucccaccugagaagugugauacgcuucugugcgacauuggcgagagcucgcccaauccaaccaucgaagaggggaggacucuacggguccucaaaaugguggaacccuggcugcgcggaaaccaauuuuguauuaagaucuugaauccuuauaugccgucuguuguagagacacuggagcagaugcagagaaagcacgguggcaugcucgugaggaacccccuuagucgaaauuccacccaugaaauguacugggucagcugcgggacuggaaacauugugucagcaguuaauaugacaucccggaugcuguuaaaccguuucaccauggcccacagaaaaccaacguaugagcgcgauguggaccugggcgcugguaccaggcacgucgccguggaaccugagguagcaaacuuggauaucauagggcagcggauugaaaauaucaagcaugagcacaaaucuacauggcauuacgacgaggauaaccccuauaagacuugggccuaccacggaagcuaugaagugaaaccuaguggcuccgcuagcucuaugguuaauggcgucgugaagcuccugaccaagccaugggacgugauccccauggucacacaaauugcgaugacugauaccacaccuuuugggcagcagagaguuuucaaagagaagguggacacccgcacuccaaaagccaagaggggaacggcacaaauaauggaaguaacagcuaaauggcuaugggguuuucuuucacgaaacaagaagccccggaucuguaccagagaggaauucacuaggaaagugcgcaguaaugccgcaauuggcgccgucuuuguggacgagaaccaguggaauuccgcuaaggaggccguugaagaugagcguuucugggaccuggugcaucgggaaagagagcuccacaaacaggggaagugcgcgaccugcgucuacaacaugaugggaaaaagggaaaagaagcugggcgaguuugguaaagcaaaggggagccgcgccaucugguacaugugguugggagcucgauuccuggaguucgaagcccucggcuuuaugaaugaggaucacugguucucucgggaaaacucgcuuucaggcguggagggggagggacugcauaaauuagguuauauucugagagacaucagcaagauaccgggcgggaauauguacgcagaugacacagcuggaugggauacgaggaucaccgaagacgauuugcagaacgaggccaaaauuacugacaucauggaaccugagcacgcucuccuggccaaguccauuuuuaaacuaacauaucaaaauaagguaguucgcgugcagagaccagcaaagaacggcaccgucauggaugugaucagucggagggaccagcgugguucugggcaggugggaacuuacggccuuaauacauucaccaacauggaagcgcaacugauacgacagauggagagcgagggcauuuuuucccccucagaacucgagacaccuaaccuggccgggcgcgucuuggauugguuagaaaaacauggaguugagagacugaagcggauggcuaucaguggugacgacugugugguaaaaccaaucgaugacagguucgccacugcacucaccgcucuuaaugauaugggcaaggugcgcaaagacauuccccagugggaaccgucuaagggguggaacgauuggcagcaagucccuuuuugcagccaccacuuccaucagcugauaaugaaggacggaagagagaucgugguucccugucggaaucaggaugagcuagugggcagggcccgagucucccagggugcaggguggucacugcgugaaacggccugccucggaaaaagcuaugcgcaaauguggcaguugauguacuuucacagacgcgaccugcggcuugcugccaacgcaauuuguucugccgugccaguagauuggguuccuaccuccaggacaacuuggaguauccaugcucaccaucaguggaugaccacagaggacaugcugagcguguggaauagagucuggauugaagagaaccccuggauggaagauaagacucacgugucguccuggggcgacguuccauaucucggcaaacgcgaggaccaauggugcgggucuuuaaucggacugaccgcccgggcaacgugggcuacaaauauacagguggccaucaaccaggucaggcgauugcuggguaaugagaacuaccucgauuacaugaccucaaugaagagauucaaaaaugaaagcgaccccgagggcgcgcuuugguga

SEQ ID NO: 14011 - RNA, 9879 nt, Artificial Sequence
  derived and/or modified CDS sequence (opt3) from DENV-1__EU482810__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagauugugcaguacgaaaaccugaaauauucagucaucgugacaguucacaccggagaccagcaucaaguggguaaugagaguacugaacacggcacgacagccaccauuacuccccaggcgccuagcaccgagauccaguuaacagacuacggggcccugacccucgauuguucuccaaggacuggacuugacuuuaacgaaaugguccuguugacaaugaaggagaaauccuggcuagugcauaagcagugguuccuggaucucccgcugcccuggacgucaggcgcaagcaccagucaagagacuuggaaucggcaggaccuucugguaacauuuaaaaccgcucacgccaagaagcaggaaguuguggucuuggguucucaagagggggcuaugcacacagcccucacuggcgcaaccgaaauccagacguccggaaccacaacuauuuucgccggccaucugaaaugccguuuaaagauggauaaacugacccuaaaggggaugagcuaugugauguguacaggaucguucaaacucgagaaggaagucgcugagacucagcacgguaccgugcugguucagauaaaguacgagggcacggacgcgccuugcaaaaucccauuuucuacacaagaugaaaagggggugacccagaacggacgccuuauuacugcaaaucccaucguaacagacaaagagaagccugucaacauagaagccgagccacccuucggcgaguccuauauugugaucggugcuggggaaaaagccuugaagcugucaugguuuaagaaaggcaguagcaucggaaagauguucgaggcaaccgccagaggcgcuaggcggauggccauucucggggauacugcaugggacuuuggauccaucgguggcguuuucaccucuguggggaaacugguccaucagauuuuuggaacagcguacggcgugcuuuucagcgguguaucauggacgaugaagauagggaucggcgugcuguugaccuggcucggacugaauagucgauccacuagcuuaucuaugacauguauugcuguuggccuggucacccuauaccucggggugauggugcaggccgauucaggaugcgucaucaacuggaaaggccgcgaacugaagugugguagugggaucuuuguuacaaaugaggugcacacuuggaccgaacaauauaaguuccaggcagacagcccgaaaagacuuuccgccgcuauuggaaaggccugggaggagggcgugugcgguauaaggucugcaacgcgguuggaaaacaucauguggaaacagauuucgaacgagcugaaucauauccuccuggaaaacgacaugaaguuaacaguagucgugggcgauguugcugggauucuggcccagggaaaaaagaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccagaugugcgaccaccgucucaugagugcagccauuaaagauucuaaggcugugcacgccgacaugggguacuggaucgaaagcgagaaaaaugaaacauggaagcuggcacgggcguccuucauugagguuaagacguguaucuggccaaaaucacauacccuauggagcaacggagugcuggaaucugagaugauaauccccaagauuuauggcgguccuaucucccaacacaauuaccgaccaggcuacuucacucagacagccgggccguggcaucucggaaaacuggagcuugauuuugacuugugcgaaggcaccacuguagucguggaugagcacugcgggaacagaggacccagucugaggacaaccacggugacuggcaagauuauccacgaaugguguugccgcagcuguaccuuaccuccacuccgguucaaaggugaggacgggugcugguauggaauggagauaagacccgucaaggaaaaggaggaaaaucugguuaaaucuaugguguccgcuggcucaggugagguagacaguuuuagccuuggccuguuguguauuucgaucaugaucgaagaggugaugaggucccgcuggucucgaaagaugcucaugacagggacccuggccgucuucuuucuacugauuaugggacagcucacuuggaacgaucugauccggcuuugcauuauggugggcgcaaaugcuagcgaccguauggggaugggaacaaccuacuuggcccugauggcaacauucaaaaugagaccuauguuugccguuggcuuacucuucaggcgccugacuucacgggaggugcuucugcuaaccauaggucucagucuggucgcuuccguggaauugccaaacucucuggaggaauuaggggauggacucgcgaugggcaucaugauucugaagcuucugacggacuuucaaagccaucaguugugggccacacuccuguccaugaccuucaucagaacuaccuuuucacuacacuaugcauggaaaacaauggcuaugguucugagcauugugagucuuuucccccucugucugucuacuaccucccagaagacgacaugguugccgguccuguuaggcagccucgggugcaagccucugaccauguuucuuaucgccgagaauaaaauauggggaaggaagucguggccacugaacgaagguaucauggccguaggcauugugucaaucuugcucucuagucugcuaaaaaacgauguuccccuggcugggccucuuauugcaggaggcaugcucaucgccuguuacgugauauccgguagcucugcggaccugagcuuggagaaggcugccgaggucuccugggaagaggaagcagagcauucaggggccagucacaauauuuuaguggaaguacaggaugacggaacuaugaaaaucaaggaugaggagcgagacgauacacugaccauccuccugaaagcuacucuucuggcagugagcggcgucuaucccuugucuauuccagccacacuauucguuugguacuucuggcaaaagaagaaacagcgcuccggcgugcugugggacaccccuucacccccagaagugcagcgggcgguccucgaugacgggauauauagaaucaugcagaggggacugcuuggucguagucaagugggcguugggguauuucaggagaacguguuccauacgauguggcacgucacucgcggagcuguguuaauguaccagggcaagcggcuggaaccgagcugggccuccguuaaaaaggaccucauuucuuacggugggggauggagauugcagggcucguggaauaccggcgaggaggugcaagucaucgcaguggaaccugggaaaaaccccaagaauguacagacagccccaggaaccuuuaagacaagcgagggugaagucggcgcuauugcccuggauuucaaacccgggacuucaggauccccuaucgugaacagggagggcaagauaguuggucucuaugggaauggaguggucaccacgaguggcacauacgugucugcaaucgcucaggccaaagcgagccaagaaggcccacugcccgagauugaggacgaaguuuuucgaaagcggaaccuuacuaucauggaucugcacccuggguccggaaaaacccgcagauauuugccggccauugugagggaggcaaucaagcggaagcuacgaacacugauacucgcuccaaccagagucguggccucagaaauggcugaggcauuaaaagguaugcccauucgcuaccagacuaccgccguaaagucugaacauacaggcaaagagaucguggaccugaugugccacgccacguucacuaugaggcuucugagcccuguucgugucccaaauuauaacaugaucauuauggaugaggcucauuuuaccgaccccaguuccaucgcggcacggggguacauaagcacaagagugggaaugggcgaagccgcugccauuuucaugaccgcaacuccuccggguucuguggaggccuuuccccagucaaaugcugucauccaggaugaagagagggacauuccagaacgcuccuggaacaguggguaugaguggaucacagauuucccuggaaagaccguaugguuugugcccagcauaaaaucgggcaaugacauugcgaacugucuccgaaagaauggcaagagaguuauccaauugucucggaaaacguucgauacugaguaccagaagacaaaaaacaacgacugggacuacguggucaccaccgauaucuccgaaaugggggccaauuucagggcagaccgcgugauugauccacguagaugccugaagccuguuauccucaaagacggacccgagcgggugauucuggcugguccaaugccggucacuguggccagcgcagcccagaggcgcggccgaauagggagaaaccacaauaaggaaggagaucaguauaucuacaugggccaaccucuuaacaaugacgaggaucaugcucacuggacagaggccaagaugcuacuggacaacauuaauacccccgaagguaucaucccagcguuguuugagcccgaacgggagaaaucagcagccauugauggggaauauagguuacgcggcgaggcuagaaagacauucguagagcugaugaggcggggagaccucccuguguggcugagucacaaaguugccucugaaggcuuucaguacuccgaucgucgcuggugcuucgacggggagcgaaacaaucagguccuugaagagaacauggauguggaaauauggacuaaggagggagagagaaaaaagcugaggccacgguggcucgacgcucgcacguauagcgaccccuuggcacugagagaauuuaaagaguucgccgcugguaggcggucagugaguggcgaucuaauccuggaaauugggaagcucccucagcaucuuacccaacgagcccagaaugcacuggacaacuuagucauguugcacaauagcgagcagggaggcagagcguaccgccaugccauggaagagcugccggauacaaucgagacucucaugcugcuugcucugauugccguucucaccgguggggugacauuguuuuuccuguccggcaggggauuaggcaagaccucuaucgggcuacuguguguaauggcaagcuccgugcuccuuuggauggcuucagucgaaccacacuggauagccgcaucuaucauucuggaguuuuucuugauggugcugcucauccccgaaccugaccggcagcguacuccccaagauaaccagcuggccuauguugugauuggacuucucuuuaugauccugacggucgcugcgaaugagauggguuugcuggagaccacaaaaaaggacuuaggcauagggcacguagccguggaaaaccaucaccaugcagcuaugcuagauguugaccugcacccagccagugccuggacucucuacgcaguggcuaccacaauuaucaccccuaugaugagacauacuauugagaacacaacggccaauaucucgcuuaccgcgauagcuaaccaggccgcaauccugaugggauuggauaaaggcuggcccauuagcaagauggacaucggugucccacugcucgcccuggggugcuacucccaagugaauccucuuacuuuaacagcugcaguccugaugcucguggcccacuaugcgauuaucggcccgggauugcaggcuaaagccaccagggaagcacagaagcgcaccgccgcuggcauaaugaagaaccccacaguugaugggauuguggccaucgaccuggauccaguaguguacgacgcaaaauucgagaagcagcuaggacaaaucaugcugcucauucuuuguacuucucagauccuguugaugcggacgaccugggcucugugcgaaucaauaacacucgccacuggcccucugaccacauuaugggaggguagccccgggaaauuuuggaauaccacuauugcggucuccauggccaacaucuuccgaggaaguuaucuugcaggcgcuggucuggccuucucucucaugaagagccuaggcgggucaagaaggggaacgggcgcacagggggagacacugggagaaaaauggaagcgccaguugaaucaacuguccaagagugaguuuaacaccuacaaacggagcggcauuauggaaguugacagaucugaggcuaaggaaggucucaaacguggggagacuaccaagcacgccguguccaggggaacagccaaacuucggugguucgucgagcgcaaucuggugaagccagaaggcaagguaaucgauuuggguuguggccgagggggauggucauauuacugcgcgggccugaaaaaggugacugagguuaaaggguauaccaagggaggcccuggucaugaagagcccauaccgauggcuacauacggguggaaccucgugaaauuacacagcggaaaggacgucuuuuucaucccaccugaaaaaugugauacgcugcuuugcgacauuggcgagucgucucccaauccaaccaucgaggaaggcagaacucugagggugcuaaagauggucgagcccuggcuccgggggaaccaguuuuguauuaagauccugaauccuuacaugccgagugugguugaaacauuggagcagaugcagcgcaaacauggagguaugcugguaagaaacccccucuccaggaauagcacccacgagauguauugggugucaugcggcacugggaacauugucuccgcagugaauaugacaucucgaaugcuucugaaccgguucaccauggcccaccguaagccaacguacgaaagagauguugacuuaggagcuggcacccgccauguggccgucgagccugaaguggcaaaccuggauaucauaggucaaaggauugagaauaucaaacacgaacauaagagcacauggcacuaugacgaggauaaccccuacaaaacuugggccuaucaugggaguuacgagguaaagccuuccggaagcgcuucuucaauggugaauggcguugucaaguugcucaccaaaccaugggacgugauccccauggugacacagauugcgaugacugauaccacaccuuuuggccagcaacgggucuucaaggaaaaaguugacaccagaacuccaaaggccaaacgcgggacggcacagauaauggaggugacagcuaaguggcuguggggauuucuaaguaggaacaagaaaccccgaaucuguacccgggaagaguucacuagaaagguaagguccaaugccgcaauuggugccguguuugucgacgaaaaccaguggaauagcgcuaaagaggccguggaggaugaacgcuucugggaccuuguucaccgugagcgggaacugcacaagcagggcaaaugcgcgaccugcguguauaacaugauggggaagagagagaagaaacucggagaauuuggcaaggcaaaagguucuagggccaucugguacauguggcugggggcucgcuucuuggaguucgaggcccugggauuuaugaaugaagaucauugguucucgcgagagaacucacucagcggcgucgaaggcgaggggcuucacaagcugggauacauuuuacgggacaucuccaaaauaccggguggcaauauguaugcagaugacacagcugggugggauacgagaaucaccgaggacgaucugcaaaacgaagccaagauuacugacaucauggagccugaacaugcuuugcucgccaaaaguauuuuuaagcugacauaccagaauaaggugguaaggguucagcgcccagcaaaaaacggaaccgugauggaugucaucucuagacgggaccagaggggcagcggucaaguggggacuuauggacuaaauacauucaccaacauggaggcgcagcuuauacgucagauggaauccgagggcauuuuuucacccagugagcuggauacaccuaaccucgccggccgagugcuggacugguuggaaaagcacggggucgagcgcuuaaaaagaauggcuaucucuggagacgauuguguugugaagccaaucgacgaucgguucgccacugcacugaccgcucucaaugacauggguaaaguaaggaaggauauuccccagugggaaccgagcaagggcuggaacgacuggcaacaggugccuuuuugcucccaccauuuccaccagcuuauaaugaaagaugggcgcgagaucgucgugcccuguagaaaucaggacgaacugguuggacgggccagggugucacaaggcgcagguuggagccuacgagagacggccugccuggggaagucuuacgcgcagauguggcagcucauguauuuucaucguagagauuugcgccuggcugccaacgcaauuuguuccgccgucccaguggacuggguaccuaccagucggacaacuuggagcauccacgcucaucaccaauggaugaccacagaggauaugcuuucgguuuggaauaggguguggauugaagagaaccccuggauggaagacaaaacucacaucuccucuuggggagacgucccauaccugggcaagagagaggaucaguggugcggcucacucauaggguuaaccgcccgcgcaacgugggcuacaaauauccagguggccauuaaccagguucggaggcuguugggaaaugaaaacuaucuggacuacaugaccagcaugaaacgauucaagaaugagaguggucccgagggcgcgcucugguga

SEQ ID NO: 14012 - RNA, 9879 nt, Artificial Sequence
  derived and/or modified CDS sequence (opt3) from DENV-1__EU482811__SS-prME
agcgugacaaugcugcucaugcuuaugcccacagcacuggcuuuccacuugacuacgagaggaggggagccucauaugaucgucuccaagcaggaaagagggaaaucuuuacuguuuaagaccucagccgguguuaacaugugcacacugauugcaauggaccucggagagcugugugaagauacuaugaccuacaaaugcccacggauaacagaggcggaaccggacgauguggacuguuggugcaaugcuaccgauacuuggguaacauaugggaccuguagucagacgggagagcaccgccgagagaagcguagcguggcccuugcaccccaugucggccuggguuuggaaacuagaaccgagacauggauguccucugaaggggccuggaaacagauccagaggguggagacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagacuuuguggagggucuuaguggcgcgacuuggguagauguuguguuggaacacggguccugugucacaaccauggcaaaggacaaacccacucuggauaucgagcuacucaagacagaagugaccaacccugccgugcugaggaaacuuugcauugaggcuaagaucucuaauacgaccacagacagccgguguccaacucaaggagaagccacccuggucgaggagcaggaugcaaacuucguuugccgccgaacauuuguggacagaggcugggguaauggguguggauuguucggcaaaggcucccuccugacuugcgcuaaguuuaagugcguaaccaaauuagaagggaagauagugcaguacgagaaccugaaauauucagucauugugacaguucacaccggagaucagcaucaaguggguaaugaaaguacugagcacggcacgacagccaccaucacuccccaggcgccuaccacagaaauucagcucaccgacuacggggcccuuacucuggacuguagcccaaggacaggauuggauuucaacgagaugguccuacugacgaugaaggagaaaucuuggcucgugcauaagcagugguuucuggaccuuccgcugcccuggaccuccggcgcaucaacuagccaagaaacauggaaucggcaggauuugcucguaaccuucaaaacagcucacgccaagaagcaggagguugugguccuggguagucaagaaggggcuaugcacacugccuuaaccggcgcaacggagauccagaccucuggaacaacuaccaucuuugccggccaucugaaaugccgucuaaagauggacaaacucacacugaaggggauguccuaugugauguguacuggcagcuucaaacuugaaaaggaggucgcugagacccagcacgguacgguguugguucagauuaaguacgaaggcacagaugcgccuugcaaaauaccauucucgacccaagacgagaagggggugacucagaacggacgccugaucacagcaaaucccauuguaaccgauaaagaaaagccugucaacaucgaggccgagccacccuuuggcgaaucuuauauagugauuggugcuggggagaaagcccucaagcuguccugguucaagaaaggcucaaguaucggaaagauguuugaagcaacugccagaggcgcuaggcggauggccauccuuggggacaccgcaugggauuucggaagcauugguggcguuuuuacauccguggggaaacugguccaucagaucuucggaacggcguacggcguguuguuuucugguguaagcuggaccaugaagauugggauaggcgugcuccugacuugguuaggacuaaauucacgaaguacaucccuaagcaugaccuguaucgcuguuggccucgucacacuguaccuuggggugauggugcaggccgacucuggaugcgucauuaacuggaaaggccgcgaguugaagugugguucagggaucuucguuacuaaugaagugcacaccuggacggagcaauauaaguuucaggcagauaguccgaaaagacugagcgccgcuaucggaaaggccugggaggaaggcgugugcgguauuagguccgcaacacggcucgagaacauaauguggaaacagaucucuaacgaacugaaucauauuuuacuggagaacgacaugaaguucaccguagucgugggcgacguugcugggauccuugugcagggcaagaagaugauucgcccucaacccauggaauacaaauauucguggaaaagcuggggcaaggccaaaaucauaggggcggauguccaaaauuccacuuuuaucauugacggaccaaacaccccugagugucccgaugaccagagagccuggaauaucugggagguggaagauuacggcuucgguauuuuuacaacuaacaucugguugaagcucagggacucauauacccagguuugcgaucaccgucugaugagugcugcaauaaaagacucuaaggccgugcacgcugauaugggguacuggauugagagcgagaagaaugagacauggaagcuagcccgggcauccuucaucgaaguaaagacguguauuuggccaaaaucacauacccuguggagcaacggaguccucgagucugagaugaucauacccaagauccacggcgguccuauuucccaacauaauuaucgaccaggcuacuucacucagacagcggggccguggcaccugggaaaacuugaauuggacuuugaucugugcgagggcaccacugugguggucgacgaacacugcgggaacagaggacccaguuuaaggacaaccacgguuacuggcaagaucauucaugagugguguugccgcagcuguacccucccuccacugcgguucagaggugaggaugggugcugguacggaauggaaaucaggcccgugaaagagaaggaagagaaucuuguaaagucuaugguguccgccggcucaggugaagucgacaguuuuagccugggcuugcucuguauaucgauuaugaucgaggaggugaugcgcucccgauggucucggaaaaugcugaugacagggacccuagcuguuuucuuucugcucaucaugggacagcugacuuggaacgaccuuauucguuugugcaucauggugggcgccaaugcaagcgauagaauggggaugggaacaaccuaucuggcuuuaauggccacauucaagaugaggccuauguuugcagucggccuccuguuccgccggcuuacuucaagagaagugcugcuacucaccauuggucugaguuugguugccuccguggagcugccaaacucuuuagaggaacucggggacggacuggcuaugggcauaaugauccuuaaacuguugacggauuuucaaagcuaccagcucugggcgacacugcuaucccugaccuucauuaagacuaccuuuucacuucacuaugccuggaaaacaauggcaaugguccucagcaucguaagucuguuccccuugugucugucuacuaccucccagaagacgacaugguuaccggugcuccugggcagccuugggugcaagccucugaccauguuuuugauugcugaaaauaaaaucuggggaaggaagucguggccacucaacgaggguauaauggccguuggcaucgugucaauucugcuaucuagucugcuuaaaaacgacgucccccucgccgggccucugaucgcuggaggcauguugauugcauguuacgugaucuccgguagcucugccgauuuaagccuggagaaggcggcugaaguauccugggaggaagaggccgaacauucaggggcaagucacaauauacucguggagguccaggacgauggaacuaugaaaauuaaggacgaggaacgagaugacacacugaccauccuucugaaagccacuuugcuagcuguuagcggcguguauccccugucuaucccagcaacacucuucguguggcauuucuggcaaaagaagaaacagcgcuccggcguccugugggauaccccuucacccccagagguggaacgggccguucuugacgaugggauuuacagaauaaugcagaggggauuacugggucguagucagguaggcgugggggucuuucaagagaacguguuccacacgauguggcacguuacucgcggagcggugcucauguaucagggcaagcgguuggagccgagcugggcuuccgucaaaaaggaccugaucucuuacggugggggauggagacuccagggcucguggaauaccggcgaagaggugcagguaauugccgucgaaccugggaaaaaccccaagaaugugcaaacagcaccaggaaccuuuaagacacccgagggugaaguuggcgccaucgcucuggacuucaaaccugggacuagcggaucaccaauugugaacagggagggcaagaucgucggucuuuacgggaauggagugguuaccacguccggcacauaugugagugccauagcacaggcuaaagccucucaggagggcccccugccugaaaucgaggaugaagucuuucgaaagcggaacuugacuauuauggaccuacauccggggagcggaaaaacccgcagauaccugccagcgaucgugagggaggccauuaagcggaagcuccgaacauuaauccuggcacccaccagaguaguggcuuccgaaauggccgaggcucuuaaagguaugccuauacgcuaucaaacuaccgcaguuaagucagagcacacaggcaaagaaauugucgaucugaugugccaugccacguucacuaugaggcucuugucuccagugcgugugcccaauuacaacaugaucaucauggacgaggcccacuuuaccgauccuagcaguauugcugcgcggggguauaucuccacaagagucggaaugggcgaagcagccgcuauauucaugaccgccacuccgcccgguagcauggaggcauuuccacagucuaaugccguaauucaggacgaagagagggauaucccugagcgcucauggaacuccggguacgaauggauuacagacuuccccggaaagaccgugugguuuguuccaaguaucaaagcuggcaaugauauagcgaacugucugcgaaagaauggcaagagagugauucagcucagccggaaaacguucgacacugaguaucaaaagaccaagaauaacgauugggacuacgucgugaccaccgacaucucggaaaugggggccaauuucagggcagaucgcguuaucgacccucguagaugccugaagcccgugauucuuaaagauggaccagagcgggucauccuagcugguccgaugccugugacuguagccucugcagcccagaggcgcggccgaauugggagaaaccauaauaaggagggagaccaguacauauauaugggccagccccugaacaaugaugaagaccacgcucacuggacagaggccaagauguuguuagauaacaucaauaccccagaagguauuauccccgcgcuguuugagccugaacgggagaaauccgcagccaucgacggggaguacaggcuccgcggcgaagcuagaaagacauucguggagcugaugaggcggggagaucuuccaguuuggcugagcuauaaagucgccucagaaggcuuucaauacagugaccgucgcuggugcuucgauggggagcgaaacaaucaggugcucgaagagaacauggacguggagauuuggacuaaggaaggagagaggaaaaaguugaggccccgguggcuggaugcucgcacguauucugacccucuagcacugagagaauuuaaagaguucgccgcugguaggcgguccgucagcggcgaccucauacuugaaaucgggaagcugccgcagcauuuaacccagcgagcccaaaaugcauuggauaaccugguuaugcuccacaauucagagcagggaggcagagcguaccgccaugccauggaggaacugccagacacaauugagacucuuaugcugcucgcuuugaucgccgugcugaccggugggguaacauuauuuuuccuaaguggcaagggacugggcaaaaccagcauugggcuccuuugugugauggcauccucuguccuguuguggauggcuagcguggaaccccacuggaucgccgcauccauaauccuggaguuuuuccucaugguucugcuuauuccugagcccgauaggcagcggacuccacaggacaaccaacucgccuauguggucaucggacuguuguuuaugauucugacgguagcugcgaaugaaauggguuuacuagagaccacaaagaaagaucugggcaucgggcacguggccguugaaaaccaucaccaugcagcuaugcucgacguggaucuucacccugccucagccuggacucuguacgcagucgcuaccacaauaauuacccccaugaugcgucauacuaucgagaacacaacggccaauauuucuuugaccgcgaucgcuaaccaggccgcaauacugaugggacucgacaagggcuggccaaucaguaaaauggauauuggugugccucugcuugccuuagggugcuacucgcaggucaauccgcugacucucacagcugcaguguugaugcugguugcccacuaugcgaucauuggccccggacuacaagcuaaggccaccagagaagcacagaagaggaccgccgcuggcaucaugaaaaacccaacaauagacgggauuguggccaucgaucuggacccuguaguguacgaugcaaaguucgagaaacagcucggacagaucaugcuucugauuuuguguacuagccaaauccugcucaugcgcacgaccugggcucugugcgaguccauaacauuagccacuggcccccuuaccacacugugggaagguucuccagggaaguuuuggaauaccacuauugcggucucaauggccaacaucuuccggggaagcuaucucgcaggcgcuggucuagccuucucccugaugaaaaguuugggcgggggacgaagaggcacgggggcacagggagagacacugggcgaaaaguggaagaggcagcucaaucagcuuucuaaaagcgaguuuaacaccuacaagcgcucagguauuauggaaguugaccgguccgaggcuaaagaggggcugaagagaggagaaacuaccaaacacgccgugagucguggcacagccaaguugaggugguucgucgagcggaaucuggugaagccugaagguaaaguaaucgaccucggcugugggcgcggaggcuggagcuauuacugcgcgggguuaaagaaagugacugagguuaagggauauaccaaaggcggucccgggcaugaagaaccgauaccaauggcuacauacggauggaaccuggugaaacuucacucuggcaaagaugucuuuuucaucccucccgagaagugugacacgcugcuaugcgauauuggcgaauccucaccaaaucccaccaucgaggaagggcgaacucucagagugcugaagauggucgagccuugguugaggggaaaccaauuuuguauuaaaauccugaauccguacaugcccagcgugguugagacacucgaacagaugcagcggaagcaugguggcaugcuuguacgcaacccacugucgagaaauucuacccacgagauguauugggugaguugcgggacuggaaacauugucuccgcagugaauaugacaagcaggauguuacugaaccgauucaccauggcccaccggaaaccuacguacgaacgugacguugauuugggcgcugguaccagacauguggccgucgagcccgaaguggcaaaccucgacaucauagggcagcgcauugagaauaucaagcacgagcauaaaucaacauggcacuaugaugaagacaacccuuacaagacuugggccuaucauggauccuacgagguaaagccaucuggcagcgcuaguuccauggugaauggcguugucaaacugcuaaccaagcccugggaugugaucccuauggugacacaaauugcgaugacugacaccacaccauuugggcagcagagggucuucaaagaaaagguugauacccggacucccaaagccaagagaggaacggcacaaauaauggaggugacagcucgcuggcuuugggguuuucugagcaggaacaagaaaccgcgaaucuguacccgggaagaguucacuagaaagguaaggucuaaugccgcaauuggcgccguguuugucgacgagaaccaguggaacucagcuaaagaagccguggaggacgaucgcuucugggaccucguucaccgugaacgggagcugcacaagcaggggaaaugcgcgaccugcguguauaacaugaugggaaagagagaaaagaaauugggcgaguuugguaaggcaaaagggaguagggccaucugguacauguggcugggagcucgcuuccucgaguucgaagcccuuggcuuuaugaaugaggaucauugguucucccgagaaaacagccugucuggcgucgagggggagggauuacacaagcuggguuacauuuugcgggacaucucgaaaauaccuggcgggaauauguaugcagaugacacagcuggaugggauacgagaaucaccgaagacgaucuccagaacgaggccaagauuacugacaucauggaaccagagcaugcucugcuagccaaaucaauuuuuaaacuuacauaccaaaauaaggugguaaggguucagcgccccgccaaaaacggcaccgugauggaugucaucagcagacgggaccagagggguuccggacaggugggaacuuauggccugaauacauucaccaacauggaagcgcaacucauacgucagauggagagugagggcauuuuucugccuaacgaauuggagacaccaaauuuagccgggcgagugcuggauuggcucgaaaaguacggagucgagcgccuuaaaagaauggcuaucucuggugacgacuguguugugaagcccaucgaugaccgguucgccacugcacugaccgcucuaaacgauaugggcaaaguaaggaaggacauuccgcagugggaaccuagcaagggguggaaugauuggcagcaagugcccuuuugcucccaccacuuccaucagcugauaaugaaagacggacgcgagaucgucgugccauguagaaaccaggaugagcucguuggccgggccagggugucacagggugcaggguggaguuugcgagaaacggccugccugggaaagucuuaugcgcaaauguggcagcuuauguacuuucaccguagagaccugcgccucgcugccaaugcaauuuguagcgccgucccuguggauuggguacccaccucccggacaacuuggucaauccaugcucaccaucaguggaugaccacagaggacauguuaagcguuuggaacaggguguggauugaagagaauccauggauggaagauaaaacuagaaucucuuccugggaggacguccccuaucugggcaagcgcgaggaccaauggugcggcaguuugauagggcugaccgcccgggcaacgugggcuacaaacauccagguggccauuaaucagguuaggcgacucaucggaaacgaaaauuacagcgauuacaugaccucgaugaaaagauucaagaacgaguccgaaccugagggugcgcuuugguga

SEQ ID NO: 14013 - RNA, 9879 nt, Artificial Sequence
  derived and/or modified CDS sequence (opt3) from DENV-1__EU482812__SS-prME
uccgugaccaugcugcucaugcuuaugcccacagcccuggcuuuccacuugacuacgagaggaggggaaccucauaugaucgucuccaagcaggaaagaggaaaaucuuuacuguuuaagaccucagccgguguuaauaugugcacacuaauugccauggaccucggcgaacugugugaagauacuaugaccuacaaaugcccacggauuacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccgggucguucaaacuggagaaggaagucgccgagacgcagcacgguacagugcuuguucagauaaaguacgagggcaccgacgcuccuugcaaaaucccauucucgacucaagaugaaaagggggcgacacagaacggacgcuugauuaccgcaaaucccaucgugacugacaaagagaagccuguaaacauagaagccgagccacccuuuggcgagucuuauauugucaucggugcuggggaaaaagcccugaagcucuccugguucaagaaaggcucaaguaucggaaagauguuugaggcaaccgccagaggcgcuaggcggauggccauucugggggauacagcaugggacuucggaagcaucgguggcguguuuacguccguugggaaacuugugcaucagauuuucggaaccgcguacggcguccuguuuucuggugugagcuggacuaugaagauagggaucggcguauugcucacauggcugggauuaaauucacgaaguaccucccugagcaugacauguauugcugugggccuaguuacucucuaccugggggucauggugcaggccgauucuggaugcgugaucaacuggaaaggccgcgaacuuaagugugguucagggaucuucgucaccaaugagguucacacguggacagaacaauauaaguuucaggcagacaguccgaaaagauugagcgccgcuauuggaaaggccugggaggagggcgugugcgguauaagguccgcaacccggcuggaaaacaucauguggaaacagauuucuaacgagcucaaucauauccuguuagaaaacgacaugaaguucacugugguagucggcgauguggcugggauucuggcccagggcaaaaagaugauccgcccucaacccauggaguacaaauauucguggaaaagcuggggcaaggcgaagauaaucggggccgacguucagaauaccacauuuauuaucgauggaccaaacacuccugaaugucccgacgaucagagagcuuggaauauuugggagguggaggacuacggcuucgguaucuuuaccacaaacauauggcuuaaguugagggauuccuauacgcaggucugcgaccaccgucucaugucagcagccauuaaagauaguaaggcugugcacgccgacaugggguacuggaucgaaucugagaaaaaugaaaccuggaagcuggcacgggcgagcuucauugagguuaagacuuguaucuggccaaaaucccauacacuauggucaaacggagugcuggaaagcgagaugauaauccccaagauuuauggcgguccuaucucucaacacaauuaccgaccaggcuacuucacccagacugccgggccguggcaucucggaaaacuggagcuugauuuugacuugugcgaaggcacaaccguagucguggaugagcacugcgggaacagaggacccucccugaggacgacuaccgugacaggcaagauuauccacgaaugguguugccgcaguuguaccuuaccuccacuccgguucagaggugaggacgggugcugguauggaauggagauaaggcccgucaaagaaaaggaggaaaaucugguuaagagcauggugucugcuggcuccggugagguagacucauuuagucuuggccuguuguguauuagcaucaugaucgaagaggugaugcgcucgcgauggucccggaaaaugcucaugacugggacacuggccgucuucuuucuacugauuaugggacagcucaccuggaacgaucugauccgucuuugcauuauggugggcgcaaaugcuucugacagaauggggaugggaacaacuuacuuggcccugauggcaaccuucaagaugaggccuauguuugccguuggcuuacucuuccgccggcugacgagcagagaggugcuucugcuaacaauaggucucucacuggucgcuaguguggaauugccaaacucccuggaggaauuaggggauggacucgcgaugggcaucaugauucugaaacuucugaccgacuuucaaucucaucaguugugggccacucuccugagccuaaccuucaucaagacaacuuuuucccugcacuaugcauggaaaaccauggcuaugguucuuucaauugugagccucuucccccuguguuugaguacgacaucucagaagaccacuuggcugccggucuuacucggcucccuggggugcaagccucuuacaauguuucugaucgccgagaauaaaauauggggaaggcgaagcuggccauugaacgaagguaucauggccguaggcauugugucgauccuccugucaucucuacugaagaacgauguuccccuugcugggccucucauugcaggaggcaugcugaucgccuguuacgugauaagugguuccagcgcggacuugucuuuagagaaagcugccgaggucagcugggaagaggaagcagagcauuccggggccucacacaauauucugguggaaguacaggaugacggaaccaugaagaucaaagaugaggagcgcgacgauacucucacaauccugcuuaaggcuacccuguuggcagugaguggcgucuauccccuaagcauuccagccacgcuguucguuugguacuucuggcagaaaaagaagcagcggucuggcgugcucugggacacuccuucacccccagaaguggagagagcgguccuggaugacgggauauauaggaucaugcagcguggacuuuuaggucgcagccaggugggcguugggguauuucaagaaaacguguuccauaccauguggcacgucacacggggagcugugcugauguaccagggcaaaagacucgagccgaguugggccagcguuaagaaagacuugauuuccuacggugggggauggaggcugcagggcucuuggaauaccggcgaggaagugcaggucaucgcaguggagccugggaagaaccccaaaaauguacaaacagccccaggaacuuuuaagacccccgaaggugaggucggcgcuauugcccucgauuucaagccugggacgucgggaagcccaaucgugaaccgagaaggcaaaauaguuggucuguaugggaauggaguggucacaacuucaggcaccuacguguccgcaaucgcucaggccaaggcgagucaggagggcccccuuccugagauugaagacgagguuuuucggaaacgcaaccugacaaucauggauuugcacccggggucuggaaagaccagaagguaucuaccagccauugugcgggaagcaaucaaacgaaagcugagaacucucauauuagcucccacccgcgucguggccagcgagauggcugaagcacugaaggguaugccuauuagguaccaaacaacggccguaaaauccgagcauacuggcaaggagaucguggaccuuaugugccacgccaccuucacaaugcgucugcucucaccaguucggguccccaauuauaacaugaucauuauggaugaagcucauuuuaccgacccuucuagcaucgcggcaagaggguacauaaguacuagggugggaaugggcgaggccgcugccauuuucaugacagcaaccccgcccgguuccguggaagccuuuccacagagcaaugcugucauccaggaugaggaacgcgacauuccugagcgaucuuggaacucaggguaugaguggaucacggauuuccccggaaaaacuguaugguuugugccauccauaaagaguggcaaugacauugcgaacuguuugaggaaaaauggcaagcggguuauccagcugagcaggaagacauucgauaccgaauaccagaaaaccaagaacaacgacugggacuacguggucacuacagauaucucggagaugggggccaauuuccgcgcagaccgugugauugauccuagacggugccucaaacccguuauccugaaggacggaccagaaagggugauucuugcugguccgaugccugucaccguggccucugcagcccagcgccgaggcagaauagggcggaaccacaauaaagagggagaucaguauaucuacaugggccagccccuaaacaaugacgaggaucaugcucacuggacagaagccaagaugcuguuggacaacauuaauacuccagaggguaucauccccgcguuauuugaaccugagagggaaaaguccgcagccauugauggggaguaucgccugagaggcgaggcuaggaaaacguucguagaacucaugcggcguggagaccugccaguguggcuuagcuacaagguugccucagagggcuuucaauauagugaucgccgauggugcuucgacggggaaagaaacaaucagguccuggaggaaaacauggauguggagauauggaccaaagagggagaaaggaagaaacuccggccccgcugguuggacgcuagaacauacucugacccucuggcacuaagggaguuuaaggaguucgccgcuggucggcgauccgugagcggcgaucugauccucgagauugggaaacuuccgcagcaccugacucagagagcccaaaaugcauuagacaacuuggucaugcugcauaauucagaacagggaggccgcgcguauaggcacgccauggaggagcucccagauaccaucgaaacacugaugcuucuggcucucauugccguuuugaccgguggggugacucuguuuuucuuaaguggccggggacuaggcaagacgagcaucgggcugcucuguguaauggcauccucugugcuucuguggauggcuagcgucgagccccauuggauagccgcauccaucauuuuggaauuuuuccugauggugcuccugaucccugagcccgaccgucagagaaccccacaggauaaccaacuugccuacguugugauuggacuccuguuuaugaucuugacagucgcugcgaaugagaugggucuguuagaaacuaccaagaaagaccuaggcauagggcacguagccguggagaaccaccaucacgcagcuaugcuggauguugaccuccauccugccucagccuggacacuuuacgcaguggcuaccacuauuaucacacccaugaugaggcacacgauugaaaacaccacugccaauaucucucugacagcgauagcuaaccaggccgcaaucuugaugggacuggauaagggcuggccaauuaguaaaauggacaucggugucccucuccuggcccuugggugcuauagccaggugaauccguuaacccugaccgcugcaguccucauguugguggcccauuacgcgauuaucggccccggacugcaagcuaaggccacacgcgaggcacagaaacggacugccgcuggcauaaugaagaacccaacgguugaugggauuguggccaucgaccuagauccuguaguguaugacgcaaaguucgaaaaacagcugggacagaucaugcuccuuauucuguguaccagccaaaucuugcugaugcgaacaacuugggcucucugcgaguccauaacccuggccacaggccccuuaaccacucuuugggaggguucuccagggaaguuuuggaauacgacaauugcggucucaauggccaacaucuucagaggaagcuaccuggcaggcgcuggucucgccuucucccuaaugaaaagucugggcgggggaaggcgcggcaccggggcacagggagaaacuuugggcgagaaguggaaacggcagcugaaucagcucucuaagagcgaauuuaacaccuauaagagaucagguauuauggagguugaccguuccgaagcuaaagaggggcuuaagaggggagagacaacuaaacacgccgugagucggggcaccgccaagcugcgcugguucgucgaacgaaauuuggugaaaccugaggguaagguaaucgaucugggcugugggagaggaggcuggagcuacuauugcgcggggcucaagaaagugacagaaguuaagggauacacgaaaggcggucccgggcacgaggaaccgauaccaauggcuaccuacggauggaacuuagugaagcugcauucuggcaaagacgucuuuuucaucccucccgagaagugugauacucuucugugcgacauuggcgaguccucaccaaaucccacaaucgaagaggggaggacccuacgggugcucaaaauggucgaaccuuggcugcgcggaaaccaauuuuguauuaagaucuugaauccguauaugcccagcgugguugagacucuggagcagaugcagagaaagcacgguggcaugcucguaaggaacccacuuucgcgaaauucuacacaugaaauguacugggugaguugcgggaccggaaacauugucuccgcagugaauaugacgagccggaugcuguuaaaccguuucaccauggcccacagaaaaccuacauaugagcgcgauguugaccugggcgcugguacuaggcacguggccgucgaacccgagguggcaaacuuggauaucauagggcagcggauugaaaauaucaagcaugagcacaaaucaaccuggcauuacgacgaggauaacccuuauaagacaugggccuaccacggauccuaugaaguaaaaccaucuggcagcgcuaguuccauggugaauggcguugucaagcuccugacuaagcccugggacgugaucccuauggugacccaaauugcgaugacagauaccacuccauuugggcagcagagagucuucaaagagaagguugacacgcgcacacccaaagccaagaggggaaccgcacaaauaauggaagugacugcuaaauggcuaugggguuuucuuagccgaaacaagaagccgcggaucuguaccagagaggaguucacaaggaaaguacgcucuaaugccgcaauuggcgccguguuugucgacgagaaccaguggaacucagcuaaggaggccguggaagaugagcguuucugggaccugguucaucgggaaagagagcuccacaaacaggggaagugcgcgacgugcguguacaacaugaugggaaaaagggaaaagaagcugggcgaguuugguaaagcaaaggggagucgcgccaucugguacaugugguugggagcucgauuccuggaguucgaagcccucggcuuuaugaaugaggaucacugguucucccgggaaaacagccuuucuggcgucgagggggagggacugcauaaauuagguuauauucugagagacaucucgaagauaccuggcgggaauauguacgcagaugacaccgcuggaugggauacuaggaucacagaagacgauuugcagaacgaggcccgcauuaccgacaucauggaaccagagcacgcucuccuggccaaaucaauuuuuaagcuaacuuaucaaaauaaagugguaagaguucagcggcccgcaaagaacggcacagugauggaugucaucagcaggcgugaccagcgagguuccggacaggugggaaccuacggccuuaauacauucacuaacauggaagcgcaacugauacgccagauggagagugagggcauauuuucuccuagcgaacucgagaccccaaaccuggccgaaagaguguuggauugguuagagaaguauggggucgaacggcugaaaaggauggcuaucuccggagacgacuguguugugaagcccaucgaugaccgcuucgccacggcacucaccgcucuuaaugauauggguaaaguaagaaaggacauuccgcagugggagccuucaaaaggcuggaacgauuggcagcaagugcccuuuugcagucaucacuuccaccagcugauaaugaaggacgggcgggagaucgucgugccauguaggaaucaggaugagcuaguuggacgagcccgugugucucagggcgcagguuggagccugagagagacagccugccucgggaaguccuacgcgcaaauguggcaguugauguauuuucaucgccgggaccugaggcuugcugccaacgcaauuuguucagccgucccuguggauuggauccccacuagcagaaccacauggucuauucacgcucaucaccaguggaugacuaccgaagacaugcuguccguauggaaucgcguuuggaucgaggaaaacccauggauggaggauaaaacgcauauaaguagcuggggagacgugcccuaccucggcaagcgggaggaccaauggugcggcucguuaaucgggcugacagccagggcaaccugggcuacuaauauucaggucgccaucaaccaggugcgaagauugauuggaaaugaaaacuaccuggauuauaugacauccaugaaacgguucaagaaugagucugacccugaaggugcgcucugguga

SEQ ID NO: 14014 - RNA, 9879 nt, Artificial Sequence
  derived and/or modified CDS sequence (opt3) from DENV-1__EU482813__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagagcaggacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucaccccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacuagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaagaggccuugaagcugucaugguuuaagaaaggcaguagcaucggaaagauguucgaagcaacugccagaggcgcuaggcggauggccauccucggggauaccgcaugggacuuuggauccauugguggcguuuucacaucuguggggaaacugguccaucagaucuuuggaacggcguacggcgugcuuuucagcgguguaucauggaccaugaagauugggauaggcgugcuguugacuuggcucggacugaauagucgauccacaagcuuaucuaugaccuguaucgcuguuggccuggucacacuauaccucggggugauggugcaggccgauucaggaugcgucauuaacuggaaaggccgcgagcugaagugugguagugggaucuuuguuacuaaugaagugcacaccuggacggagcaguauaaguuccaagcagacagcccgaaaagacuuuccgccgcuaucggaaaggccugggaggaaggcgugugcgguauuaggucugcaacacgguuggagaacauaauguggaaacagaucucgaacgaacugaaucauauucuccuggagaacgacaugaaguuuaccguagucgugggcgauguugcugggaucuuagcccagggaaaaaagaugauucgcccucagcccauggaauacaaauauagcuggaaguccuggggcaaggcgaaaaucauaggggccgacgugcaaaauacuaccuucaucauugauggaccaaacacaccugagugucccgacgaucagagagcuuggaauaucugggaggucgaagacuacggcuuugguauuuucacuaccaacaucuggcugaagcuuagggauucauauacacaggugugcgaccaccguuugaugagugcagccauaaaagauucuaaggcuguucacgccgacaugggguacuggauugagagcgaaaaaaaugagacguggaagcucgcacgggcguccuucaucgaagugaagaccuguauuuggccaaaaucacauacucuguggagcaacggaguacuagagucugagaugaucauacccaagaucuauggcgguccuauuucccagcacaauuaccgaccaggcuacuuuacacaaaccgccgggccguggcaucugggaaaacucgaacuggauuucgaccuuugcgagggcacuacagucgugguggaugaacacugcgggaacagaggacccaguuugaggaccacgacugucaccggcaagaucauucacgagugguguugccgcagcuguacacugccuccauuacgguuuaaaggugaggacgggugcugguauggaauggaaaucagacccguuaaggagaaggaagagaaucucgugaaaucuaugguauccgcuggcucaggugaaguggacaguuucagccugggccuucuguguauaucgauuaugaucgaggaggucaugaggucccgcuggucucgaaagauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaaaaugagaccuauguucgccgugggccuguuauuuaggcgccucaccucacgggaaguccugcuucugacgauuggucuaagucucguggcuuccguugagcugccaaacucuuuggaagagcugggggauggauuagcgaugggcauaaugauccucaagcugcuuacagacuuccagagccaucaacugugggccaccuugcucucccugacuuuuauuaaaaccacauucucacuacacuaugcauggaagacuauggcuauggugcugagcaucgucagucuuuuuccccucugucugucuaccacgucccagaagacaaccugguugccgguacuguuaggcagccucgggugcaaaccucugacuauguuccuuauugccgaaaauaagaucuggggaagaaaaucguggccacugaacgaggguauaauggccgugggcaucguuucaauuuugcucucuagucugcuaaagaacgaugugccccuggcugggccucuuaucgcaggaggcaugcucauugccuguuacgucaucuccgguagcucugcggaccugagcuuggagaaagcugccgaaguguccugggaggaagaggcagaacauucaggggccagucacaauauauuaguagaggugcaggaugacggaacaaugaagauuaaagaugaggaaagggacgauacccugacuauccuccugaaggcuacacuucuggcagucagcggcguuuaucccuugucuaucccagccacccuauucgugugguacuuuuggcagaagaaaaagcaacgauccggcgugcugugggacacgccuucacccccagaggucgaacgcgcggugcucgaugacgggauuuaucggauaaugcagagaggacugcuugguaggagucagguuggcguagggguguuccaggagaacgucuuucauacuauguggcacgugacccguggagcuguuuuaauguaccaaggcaaacgccuggagccgagcugggccuccgugaagaaagaccucaucucuuacggugggggauggcgguugcagggcucguggaauacaggcgaagagguccaggugauugcaguagaaccugggaagaaccccaagaauguccagaccgccccaggaacauucaaaacuagcgagggugaagugggcgcuaucgcccuggauuuuaagcccgggaccucaggauccccuauuguuaacagagagggcaaaaucgugggucucuaugggaauggagucgugacgacaaguggcacuuacguuucugcaauagcucaagccaaggcgagccaggagggcccacugcccgaaaucgaggacgaaguguucaggaaacgaaaccuuaccauuauggaucugcacccuggguccggaaagacacggcgcuauuugccggccaucgucagagaggcaauuaagaggaaacuacggacccugauccucgcuccaacucgagugguagccucagaaauggcugaggcauuaaaggguaugcccauaagauaccagaccacagccgugaaaucugagcauacgggcaaggaaauuguugaccugaugugccacgccacuuuuaccaugcgccuucugagcccugucagggugccaaauuauaacaugaucaucauggaugaggcucauuucacagaccccaguuccauugcggcacguggguacaucagcacccgggugggaaugggcgaagccgcugccauauuuaugacugcaacaccuccggguucugucgaggccuucccccaaucaaaugcuguaauucaggaugaagagagagacaucccagagagguccuggaacaguggguaugaauggauuaccgauuuuccuggaaaaacggugugguucguucccagcaucaagucgggcaaugacauagcgaacugucuccgcaagaauggcaaacgagugauucaguugucuagaaagacuuucgauacagaguaccagaaaaccaagaacaacgacugggacuacgucgugaccacugauaucuccgaaaugggggccaauuuucgggcagacaggguuaucgauccacgccguugccugaaaccugugauucucaaggacggacccgagagagucauccuggcugguccaaugccggugacaguagccagcgcagcccaacggaggggccgcauugggcgaaaccacaauaaggagggagaucaguauauauacaugggccagccucuuaacaaugacgaagaucaugcucacuggaccgaggccaaaaugcuacuggacaacaucaauacacccgaagguauuaucccagcguuguucgagcccgaaagagagaagucagcagccaucgauggggaguaucgguuaaggggcgaagcucgcaaaacuuuuguggagcugaugagaaggggagaccucccuguuuggcugaguuacaaggucgccucugaaggcuuccaguauuccgaucggcguuggugcuuugacggggagcgcaacaaucaagugcuugaagagaacauggauguggagauuuggacgaaagaaggagagcgaaagaaacugagaccaagguggcucgacgcucggaccuacagcgaccccuuggcacugcgcgaauucaaggaguuugccgcugguagaaggucagucaguggcgaucuaauacuggaaaucgggaagcucccucagcaccuuacacagcgggcccagaaugcacuggacaacuuaguuauguugcauaauagcgagcaaggaggccgagcguauagacacgccauggaggaacugccggauacuauugagacccucaugcugcuugcucugaucgccgugcucacaggugggguaaccuuguucuuucuguccggccgcggauuaggcaaaacuucuauugggcuacugugugugauggcaagcuccguccuccuuuggauggcuucaguggaaccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugaaauggguuugcuggagacaacuaagaaagacuuaggcaucgggcacguggccguugaaaaccaccaucacgcagcuaugcuagauguggaccugcauccagccagugccuggacccucuacgcagucgcuacaaccauaauuacuccuaugaugcgucacacaaucgagaacacgaccgccaauauuucgcuuacugcgaucgcuaaccaagccgcaauacugaugggauuggauaagggcuggcccaucagcaaaauggacauuggugugccacugcucgcccuggggugcuauucccaggucaauccucuuacauuaaccgcugcagugcugaugcucguugcccauuacgcgaucauuggcccgggauugcaggcuaaggccaccagagaagcacaaaagaggacagccgcuggcaucaugaaaaaccccacuguggaugggauaguagccauugaccuggauccaguggucuaugacacgaaguuugagaaacagcuaggacagaucaugcugcucauccuuuguaccucucagauucuguugaugcgcacaacuugggcacugugcgagucaaucacccucgcuacaggcccucugaccacuuuaugggaagguagccccgggaaguucuggaauacgacaauagccguuuccauggcgaacauuuuccggggaaguuaccuugccggcgcaggucuggcuuuuucucucaugaaaagccuaggcgggggacgaagaggcaccggggcccaaggagagacucugggcgaaaaguggaagaggcaguugaaucagcugucaaaauccgaguucaacaccuauaagcgcagugguaucauggaaguggaccggagcgaggcaaaagaggggcucaagagaggagaaacaacuaaacacgcugucucucguggcaccgccaagcuuaggugguuuguggagcggaaucugguaaagccagaagguaaagugauugauuugggcugugggcgcggaggcugguccuacuauugcgccgggcugaagaaaguuacagaggugaagggauacacgaaaggcgguccugggcacgaagagcccaucccgauggcgaccuacggauggaaccucgucaaguuacauucaggcaaagacguguucuuuauaccaccugagaagugugauacucugcuuugcgacaucggcgaaagcucgcccaauccaacaauugaggaagggcgaacccugagaguccuaaagaugguggagcccuggcucaggggaaaccaguucuguaucaaaauucugaauccuuauaugccgucuguuguagagacuuuggaacaaaugcagcggaagcacgguggcaugcuggugcgcaacccccucaguagaaauuccacacaugagauguacugggucagcugcgggaccggaaacaucgugucagcuguuaauaugacguccaggaugcuucugaaccgauuuaccauggcacaccggaaaccaacauaugaacgugauguggacuuaggcgccgguacuagacacgucgcuguggagccugaaguagccaaccuggauauuaucgggcagcgcauagagaauauuaagcaugagcacaaaucuaccuggcauuacgacgaagauaaccccuauaagacaugggcauaccacggaagcuaugaggugaagccuaguggcuccgccagcucuaugguuaauggcgucgugaaauugcucacuaagccaugggacgugauccccauggucacccagaucgcuaugacagauaccacuccuuucgggcaacagaggguuuuuaaagaaaagguggacacgcggacaccaaaagcgaagagaggaaccgcccagauuauggagguaacugcaaaguggcugugggguuuccuaucacgcaacaaaaagcccaggauauguacccgagaagaguuuacacggaaagugagaaguaaugcugccaucggcgcagucuucguggacgagaaccaauggaauuccgccaaggaagcuguugaggaugaaagguuuugggaccuugugcaucgcgagcgugaacugcacaaacaggggaagugcgccacgugcgucuacaacaugaugggaaagcgggagaaaaagcucggcgaguucgguaaagcgaaggggagcagagcaauuugguacauguggcugggagccagguucuuggaauuugaggcucugggcuucaugaaugaagaucacugguuuucucgcgagaacucgcucucaggcguggagggggaaggacuucauaaacuggguuauaucuuacgagacauuagcaagaucccgggcgggaauauguacgccgaugacaccgcaggaugggauacucggauaacagaggacgaucugcagaacgaagcuaaaaucaccgacauuauggagccugaacacgccuugcucgcuaaguccaucuucaagcugacuuaucagaauaaaguaguuagagugcaaaggccagccaagaacggcacagucauggaugugauuagucgcagagaccagcgggguucugggcaggugggaaccuacggccuaaauacauuuacuaacauggaggcacagcuuaucaggcaaauggagagcgaaggcauauucucccccucagagcuggaaaccccuaaccucgcggggcguguccuggauugguuggagaaacauggaguugaacgauuaaagcgcauggccauuaguggugacgacugugugguaaaaccaaucgaugacagauuugcuacggcccugaccgcacucaaugauaugggcaaggugcggaaggacaucccccagugggagccgucuaaaggguggaacgauuggcagcaggucccuuucugcagccaccacuuucaucaacuuauuaugaaggacggaagggagauagugguucccugucgcaaucaggaugaacuggugggcagagcucgggucucccagggugccggguggucacuaagggagacagcaugccugggaaaaagcuaugcccagauguggcaacucauguacuuccaccgacgugacuugagacuggcggcuaacgccaucuguucugcagugccaguagauuggguuccuacuucccgcaccacauggaguauucaugcccaccaucaguggaugacuaccgaagacaugcuuagcguguggaaucgggucuggaucgaggaaaaccccuggauggaggauaagacgcacauuucguccuggggcgacgugccauaucugggcaaaagggaggaccaguggugcgggucucucaucggauuaacagcuagagccaccugggcaacuaauauacaaguugcuaucaaccaggugcgccggcugauugguaaugaaaacuacuuggauuacaugacaucaaugaagagguuuaagaaugagagcgaccccgaaggcgcccugugguga

SEQ ID NO: 14015 - RNA, 9879 nt, Artificial Sequence
  derived and/or modified CDS sequence (opt3) from DENV-1__EU482814__SS-prME
agcgugaccaugcugcucaugcuuaugcccacagcccuggcuuuccacuugacuacgagaggcggggagccucauaugaucgucuccaagcaggaaaggggaaaaucuuuacuguuuaagaccucagcagguguuaacaugugcacacuaauugccauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggcuuuggucuugagacuagaaccgaaacauggauguccucugagggggccuggaaacagauccagaggguggaaacuugggcucugcggcacccuggauucaccguuauugcauuguuucucgcccaugcuaucggcacaucgauuacccagaagggcaucauauucauccugcugaugcucgugacgccaucaauggccaugcgcugcgucgggauuggaagcagagauuuuguggaggguuuaaguggcgcgacuuggguagacguugugcuggagcacggguccugugucacaaccauggcaaaggauaaacccacucuugacaucgaauugcugaagacagaggugaccaacccugccgugcuaaggaaacucugcauugaagcuaagaucucuaauacgaccacagauagccgguguccaacucaaggagaggccacccuggucgaagagcaggacgcaaacuucguuugccgccgaacauuuguggauagaggcugggguaauggguguggacuuuucggcaaaggcucccugauaacuugcgcuaaguuuaagugcguaaccaaauuggaggggaagacagugcaguacgaaaaccucaaauauucagucauugugaccguucacacuggagaccagcaucaaguggguaaugagaguacggaacacggcacaaccgccacuaucaccccccaggcgccuagcacagagauucagcugaccgacuacggggccuuaacucuggauuguucuccaaggacaggacucgacuucaacgaaaugguccuucugacgaugaaggagaaauccugguuggugcauaagcagugguuucuagaucugccgcuccccuggaccucaggcgcaagcacuagucaagagacauggaaucggaaagaccugcuuguaaccuucaagacagcucacgccaagaaacaggaaguugugguccuggguucucaggagggggcuaugcacacugccuugaccggcgcaacggaaauccaaaccuccggaacaacuaccaucuucgccggccaucucaagugccgucugaaaauggauaaguuaacacugaaagggaugagcuaugugauguguacuggaucguuuaagcuagagaaggaagucgcugagacccagcacgguacggugcucguucagauuaaauacgagggcacagacgcgccuugcaagauaccauucucuacccaggaugaaaaaggggugacucaaaacggacgccugaucacagcaaaucccauuguaaccgacaaggagaaaccugucaacaucgaagccgagccacccuuuggcgaguccuauauagugauuggugcuggggaaaaggcccuuaaguugucaugguucaaaaagggcaguagcaucggaaaaauguuugaggcaacugccagaggcgcuaggcggauggccauccugggggauaccgcaugggacuucggauccauugguggcguuuuuacaucuguggggaagcucguccaucagaucuucggaacggcguacggcgugcuguuuagcgguguaucauggaccaugaaaauugggauaggcgugcuucugacuugguugggacucaauagucgauccacaagccugucuaugaccuguaucgcuguuggcuuagucacacuguaccuaggggugauggugcaggccgauucaggaugcgucauuaacuggaagggccgcgaacucaagugugguagugggaucuucguuacuaaugaggugcacaccuggacggaacaguauaaauuucaagcagacagcccgaagagacuguccgccgcuaucggaaaagccugggaggagggcgugugcgguauuaggucugcaacacggcuugaaaacauaauguggaagcagaucucgaacgaguugaaucauauucugcucgaaaacgacaugaaauucaccguagucgugggcgauguugcugggauccuggcccagggaaagaaaaugauucgcccucagcccauggaguacaaguauagcuggaaguccuggggcaaagcgaagaucauaggggccgacgugcaaaauacuaccuuuaucauugauggaccaaacacaccugaaugucccgacgaucagagagcuuggaauaucugggaggucgaggacuacggcuucgguauuuucacuaccaacaucugguuaaaacugagggauucauauacacaggugugcgaccaccgucuuaugagugcagccauaaaggauucuaaagcuguucacgccgacaugggguacuggauugaaagcgagaagaaugaaacguggaaguuggcacgggcguccuuuaucgaggugaaaaccuguauuuggccaaagucacauacucucuggagcaacggaguacuggaaucugagaugaucauacccaaaaucuauggcgguccuauuucccagcacaauuaccgaccaggcuacuucacacaaaccgccgggccguggcaucuaggaaagcuggagcucgauuuugaccugugcgaaggcacuacagucgugguggaugagcacugcgggaacagaggacccagucuuaggaccacgacugucaccggcaaaaucauucacgaaugguguugccgcagcuguacauugccuccacugcgguucaagggugaggacgggugcugguauggaauggagaucagacccguuaaggaaaaagaggaaaauuuagugaagucuaugguauccgcuggcucaggugagguggacaguuuuagccucggccugcuuuguauaucgauuaugaucgaagaggucaugaggucccgcuggucucgaaaaaugcugaugaccgggacuuuggccguguucuuucuccugaucaugggacagcuaacauggaacgaucugauucggcucugcaucaugguuggcgcaaaugcuagcgaccguauggggaugggaaccacauaccuggcccuuauggcaacuuucaagaugagaccuauguuugccgugggcuugcuguucaggcgcuuaaccucacgggagguccuccugcuuacgauuggucugagucuaguggcuuccguugaacucccaaacucucuggaggaauugggggauggacuggcgaugggcauaaugaucuuaaaacuccugacagacuuucagagccaucaacuuugggccacccuguugucccucacuuucauuaagaccacauuuucacugcacuaugcauggaagacuauggcuauggugcuaagcaucgucagucuguucccccuuugucucucuaccacgucccagaaaacaaccuggcugccgguauugcugggcagcuuagggugcaagccucucacuauguuccugauugccgagaauaaaaucuggggaagaaagucguggccacuuaacgaagguauaauggccgugggcaucguuucaauucuguugucuagucuccugaaaaacgaugugccccuagcugggccucugaucgcaggaggcaugcuuauugccuguuacgucaucuccgguagcucugcggaccucagccuggagaaggcugccgagguguccugggaagaggaagcagagcauucaggggccagucacaauauauugguagaagugcaggaugacggaacaaugaaaauuaaggaugaggagagggacgauaccuuaacuauccugcucaaggcuacacugcuugcagucagcggcguuuauccccugucuaucccagccaccuuguuugugugguacuucuggcagaaaaagaaacaacgauccggcgugcuaugggacacgccuucacccccagaagucgagcgcgcggugcuggaugacgggauuuaucggauaaugcagagaggacuccuggguaggagucagguuggcguagggguguuucaggaaaacgucuuccauacuauguggcacgugacccguggagcuguucuuauguaccaaggcaagcgcuuagagccgagcugggccuccgugaaaaaggaccugaucucuuacggugggggauggcggcuccagggcucguggaauacaggcgaggaaguccaggugauugcaguagagccugggaagaaccccaaaaauguccagaccgccccaggaacauuuaagacuagcgaaggugaggugggcgcuaucgccuuggauuucaaacccgggaccucaggauccccuauuguuaacagagaaggcaagaucgugggucuguaugggaauggagucgugacgacaaguggcacuuacguuucugcaauagcucaagccaaagcgagccaggagggcccacuccccgagaucgaagacgagguguuuaggaagcgaaaccugaccauuauggaucuucacccuggguccggaaagacacggcgcuaucugccggccaucgucagagaagcaauuaaaaggaaguugcggacccuaauccuggcuccaacucgagugguagccucagagauggcugaagcacucaaagguaugcccauaagauaccagaccacagccgugaagucugagcauacgggcaaagagauuguugacuuaaugugccacgccacuuucaccaugcgccugcuuagcccugucagggugccaaauuauaacaugaucaucauggaugaagcucauuuuacagaccccaguuccauugcggcacguggguacaucagcacccgggugggaaugggcgaggccgcugccauauucaugacugcaacaccuccggguucugucgaagccuuuccccaaucaaaugcuguaauucaggaugaggaaagagacaucccagagagguccuggaacaguggguaugaguggauuaccgauuucccuggaaagacggugugguucguucccagcaucaagucgggcaaugacauagcgaacugucugcgcaaaaauggcaagcgagugauucagcucucuagaaaaacuuuugauacagaauaccagaagaccaaaaacaacgacugggacuacgucgugaccacugauaucuccgagaugggggccaauuuccgggcagacaggguuaucgauccacgccguugcuugaagccugugauucugaaggacggacccgaaagagucauccucgcugguccaaugccggugacaguagccagcgcagcccaacggaggggccgcauugggcgaaaccacaauaaagagggagaucaguauauauacaugggccagccucugaacaaugacgaggaucaugcucacuggaccgaagccaagaugcuucuagacaacaucaauacacccgaggguauuaucccagcgcuguuugaacccgagagagaaaaaucagcagccaucgauggggaguaucgguugaggggcgaggcucgcaagacuuucguggaauuaaugagaaggggagaccugccuguuuggcucaguuacaaagucgccucugagggcuuucaguauuccgaucggcguuggugcuucgacggggaacgcaacaaucaagugcuggaggaaaacauggauguggagauuuggacgaaggagggagaacgaaaaaagcuuagaccaagguggcuggacgcucggaccuacagcgacccccucgcauugcgcgaguuuaaggaauucgccgcugguagaaggucagucaguggcgaucugauacuagagaucgggaaacugccucagcaccucacacagcgggcccagaaugcacuugacaaccugguuauguuacauaauagcgaacaaggaggccgagcguauagacacgccauggaggaguugccggauacuauugaaacccugaugcuccuggcucuuaucgccgugcugacaggugggguaacccucuuuuucuuguccggccgcggacugggcaagacuucuauuggguuacuaugugugauggcaagcuccguccugcucuggauggcuucaguggagccacauuggaucgccgcaucuauaauccuugaauuuuuccugaugguuuugcugauucccgagccugacaggcagcggacgccccaggauaaccagcucgccuacguggucaucggacugcuuuuuaugauucucaccguagcugcgaaugagaugggucuguuggaaacaacuaaaaaggaccugggcaucgggcacguggccguugagaaccaccaucacgcagcuauguuagauguggaccuacauccagccagugccuggacccuguacgcagucgcuacaaccauaauuacuccuaugaugcgucacacaaucgaaaacacgaccgccaauauuucgcucacugcgaucgcuaaccaagccgcaauacuuaugggacuggauaaaggcuggcccaucagcaagauggacauuggugugccauugcuggcccucgggugcuauucccaggucaauccucugacacuuaccgcugcaguguuaaugcugguugcccauuacgcgaucauuggcccgggacuccaggcuaaggccaccagagaggcacaaaaaaggacagccgcuggcaucaugaagaaccccacuguggaugggauaguagccauugacuuggauccaguggucuaugacgcaaaauucgaaaagcagcugggacagaucaugcuacugauccucuguacgucucagauucuucugaugcgcaccacaugggcuuugugcgagucaaucacucuggccaccggcccucucacaacccugugggaggguagccccgggaaauucuggaauacuacgauagcgguuuccauggccaacauuuuucggggaaguuacuuagcaggcgcuggucuugccuucucucugaugaagagccucggcgggggacgaagaggcacaggggcacaaggagaaacccuaggcgagaaguggaaaaggcagcugaaucaguugucaaaguccgaauuuaacacuuauaaacgcagugguaucauggagguggaccggagcgaagcuaaggaggggcugaaaagaggagagaccacaaagcacgccgucucucguggcacugccaagcucaggugguucguggaacggaaucuuguaaaaccagaggguaaggugauugaucugggcugugggcgcggaggcugguccuacuauugcgcgggguugaaaaagguuaccgaagugaaaggauacacaaagggcgguccugggcacgaggaacccaucccgauggcuacguacggauggaaccuggucaaacuccauucaggcaaggacguguuuuucauaccaccugagaagugugauaccuuacugugcgacaucggcgagagcucgcccaauccaacuauugaagaggggcgaacacuuagaguccugaaaaugguggaacccuggcuaaggggaaaccaguuuuguaucaagauucucaauccuuauaugccgucuguuguagagacccuggagcaaaugcagcggaaacacgguggcauguuggugcgcaacccccugaguagaaauuccacucaugaaauguacugggucagcugcgggacaggaaacaucgugucagcaguuaauaugaccuccaggaugcuccuuaaccgauucacgauggcccaccggaagccaaccuaugagcgugauguggaccugggcgcugguacaagacacgucgccguggaaccugagguagcaaacuuagauauuaucgggcagcgcauagaaaauauuaaacaugagcacaagucuacuuggcauuacgacgaggauaaccccuauaagaccugggccuaccacggaagcuaugaagugaaaccuaguggcuccgcuagcucuaugguuaauggcgucgugaagcuguugacaaaaccaugggacgugauccccauggucacucagaucgcgaugaccgauacaaccccuuuugggcaacagaggguuuucaaggagaaaguggacacucggacgccaaaggccaagagaggaacagcacagauuauggaaguaaccgcuaaauggcucugggguuuucugucacgcaacaagaaacccaggauauguacucgagaggaauucacccggaaggugagaaguaaugccgcaaucggcgccgucuuuguggacgagaaccaauggaauuccgcuaaagaggccguugaagaugagagguucugggaccuagugcaucgcgaacgugagcuucacaagcaggggaagugcgcgacaugcgucuacaacaugaugggaaaacgggaaaagaaacugggcgaguucgguaaggcaaaagggagcagagccauuugguacauguggcucggagcuagguuucuggaguucgaagccuugggcuuuaugaaugaggaucacugguucucucgcgaaaacucgcugucaggcguggagggggagggacuccauaagcuugguuauauccugcgagacauuagcaaaaucccgggcgggaauauguacgcagaugacacggcuggaugggauacccggauaacugaagacgauuuacagaacgaggccaagaucacagacauuauggaaccugagcacgcucuguuggccaaguccaucuuuaaacucaccuaucagaauaagguaguuagagugcaaaggccagcaaaaaacggcacugucauggaugugauuagucgcagagaccagcgggguucugggcaggugggaacauacggccugaauaccuucacaaacauggaagcgcagcuaaucaggcaaauggagagcgagggcauauuuucccccucagaacuugagacuccuaaccuggccgggcguguccucgauuggcuggaaaagcauggaguugagcgauugaaacgcauggcuauuaguggugacgacugugugguaaagccaaucgaugacagauucgccaccgcauuaacggcucugaaugauaugggcaaggugcggaaagacaucccccagugggaaccgucuaagggguggaacgauuggcagcaggucccuuuuugcagccaccacuuccaucaacucauuaugaaagacggaagggagauagugguucccugucgcaaucaggaugagcuugugggcagagcccgggucucccagggugcaggguggucacugagggaaaccgccugccuaggaaagagcuaugcgcagauguggcaacugauguacuuucaccgacgugaccucagauuggcugccaacgcaaucuguucugccgugccaguagauuggguuccuacaucccgcacuaccuggaguauucaugcucaccaucaguggaugacaacugaggacaugcugagcguguggaaucgggucuggaucgaagagaaccccuggauggaagauaaaacccacauuucguccuggggcgacgugccauaucuuggcaagagggaggaccaguggugcgggucucugaucggacucacggccagagcaacaugggcuaccaauauacaaguugccaucaaccaggugcgccgguuaauugguaaugagaacuaccuggauuacaugacuucaaugaagagguucaaaaaugaaagcgaccccgagggcgcguugugguga

SEQ ID NO: 14016 - RNA, 9879 nt, Artificial Sequence
  derived and/or modified CDS sequence (opt3) from DENV-1__EU482815__SS-prME
agcgugaccaugcugcucaugcuuaugcccgccgcucuggccuuccacuugaccacuagaggcggggaaccucauaugaucgucuccaagcaggaaagggggaagucuuuacuguuuaagacgucagccgguguuaauaugugcacccuaauugcgauggaccucggcgaguucugugaagauacaaugacuuacaagugcccacggauaaccgaagcugaaccggacgauguggacuguuggugcaaugccacagauaccuggguaacuuaugggacauguagucaaaccggagaacaccgccgagacaagcguagcguggcacuggcaccccaugucggccuuggucuggagacgagaacugaaaccuggauguccucugagggggcuuggaaacagauccagaggguggaaacaugggcauugcggcacccuggauuuacuguuauugcccucuuccuggcucaugccaucggcaccucgauuacacagaagggcaucauauuuauccugcucauguuagugaccccaucaauggcgaugcgcugcgucgggauuggaagcagagauuucguggagggucugaguggcgcaacguggguagacguugugcuugagcacggguccugugucacuacaauggccaaggauaaacccaccuuggacaucgaacugcuaaagacugaggugacaaacccugcugugcucaggaaacugugcauugaagccaagaucucuaauaccacgaccgauagccgguguccaacacaaggagaggcaacucuugucgaagaacaggacgcuaacuuuguuugccgccgaaccuucguggauagaggcugggguaauggguguggacuguuuggcaaaggcuccuugauaacaugcgccaaguucaagugcguaacuaaacucgaggggaagaccgugcaguacgaaaaccugaaauauucagucacagugaccguucacacuggagaccagcaucaaguggguaaugagaguacggaacacggcacaaccgcgacuauuacaccccaggccccuagcacagagauccaguuaaccgacuacggggcacugacucucgauuguucuccaaggacaggacuugacuuuaacgaaaugguccuguugacgaugaaggagaaauccuggcuagugcauaagcagugguuccuggaucucccgcugcccuggaccucaggcgcuagcacaagucaagagacauggaaucggaaagaccuucugguaaccuuuaagacagcccacgcuaagaaacaggaaguuguggucuuggguucucaggagggggccaugcacacugcacucaccggcgccacggaaauucaaaccuccggaacaacuaccaucuucgcuggccaucugaagugccguuuaaaaauggauaagcugacacuaaaagggaugagcuaugugauguguacuggaucguucaagcucgagaaggaagucgcggagacccagcacgguacggugcugguucagaucaaauacgagggcacagacgcaccuugcaagauuccauuuucuacccaggaugaaaaaggggugacucaaaacggacgccuuauaacagccaaucccaucguaaccgacaaggagaaaccugucaacauugaagcugagccacccuucggcgaguccuauaucgugauaggugccggggaaaaggcauugaagcugucaugguuuaaaaagggcaguagcauuggaaaaauguucgaggccacugcuagaggcgccaggcggauggcaauccucggggauaccgcgugggacuuuggauccaucgguggcguuuucacaucuguggggaagcugguccaucagauuuuuggaacggcuuacggcgugcuuuucagcgguguaucauggaccaugaaaaucgggauuggcgugcuguugacuuggcucggacugaauagucgauccacuagcuuaucuaugaccuguauagccguuggccuggucacacuauaccucggggugauggugcaggcagauucaggaugcgucaucaacuggaagggccgcgaacugaagugugguagugggauuuuuguuacuaaugaggugcacaccuggacggaacaguauaaauuccaagccgacagcccgaagagacuuuccgcugccaucggaaaagcaugggaggagggcgugugcgguaucaggucugcuacacgguuggaaaacauuauguggaagcagauaucgaacgagcugaaucauauccuccuggaaaacgacaugaaauuuaccguagucgugggcgauguugccgggauuuuagcgcagggaaagaaaaugauccgcccucagcccauggaguacaaguauagcuggaaguccuggggcaaagccaagauuaucggggcugacgugcaaaauacuaccuucauaaucgauggaccaaacacaccugaaugucccgacgaucagagagcauggaauauuugggaggucgaggacuacggcuuugguaucuucacuaccaacauuuggcugaaacuuagggauucauauacacaggugugcgaccaccguuugaugagugccgcuaucaaggauucuaaagccguucacgcagacaugggguacuggauagaaagcgagaagaaugaaacguggaagcucgcgcgggccuccuucauugaggugaaaaccuguaucuggccaaagucacauacucuguggagcaacggaguacuagaaucugagaugauuauccccaaaauauauggcgguccuaucucccagcacaauuaccgaccaggcuacuuuacacaaaccgcugggccguggcaucugggaaagcucgagcuggauuucgaccuuugcgaaggcacuacagucgugguggaugagcacugcgggaacagaggacccaguuugaggaccacgacugucaccggcaaaauuauccacgaaugguguugccgcagcuguacacugccuccauuacgguuuaagggugaggacgggugcugguauggaauggagauuagacccguuaaggaaaaagaggaaaaucucgugaagucuaugguauccgccggcucaggugagguggacaguuucagccugggccuucuguguaucucgauaaugauugaagaggucaugaggucccgcuggucucgaaaaauguugaugaccgggacucucgcaguguuuuuccugcuaaucaugggacagcugacauggaacgaucucauccggcugugcauuaugguuggcgcuaaugccagcgaccguauggggaugggaaccacauaccuugcauugauggccacuuuuaagaugagaccuauguucgcugugggccuguuauuuaggcgccucaccucacgggagguccugcuucugacgaucggucuaagucucguggcguccguugaacugccaaacucuuuggaggaacugggggauggauuagccaugggcauuaugauacucaaacugcuuacagacuuccagagccaucaacugugggcaaccuugcucucccugacuuuuaucaagaccacauucucacuacacuaugcuuggaagacuauggccauggugcugagcauugucagucuuuuuccccucugucugucuaccacgucccagaaaacaaccugguugccgguacuguuaggcagccucgggugcaagccucugacuauguucuucaucgccgagaauaaaauuuggggaagaaagucguggccacuuaacgaagguaucauggcugugggcauaguuucaauccuguugucuagucuccugaaaaacgaugugccccuagcagggccucugauugccggaggcaugcuuaucgcguguuacgucauuuccgguagcucugcugaccucagccuggagaaggccgcagagguguccugggaagaggaagccgagcauucaggggcuagucacaauaucuugguagaagugcaggaugacggaacaaugaaaauaaaggaugaggagagggacgauaccuuaacuauucugcucaaggcaacacugcuugccgucagcggcguuuauccccugucuaucccagcgaccuuguuugugugguacuucuggcagaaaaagaaacaacgauccggcgugcuaugggacacgccuucacccccagaagucgagcgcgcugugcuggaugacgggaucuaucggauuaugcagagaggacuccuggguaggagucagguuggcguagggguguuucaggaaaacgucuuccauacuauguggcacgugacccguggagccguucuuauguaccaaggcaagcgcuuagagccgagcugggcauccgugaaaaaggaccugauaucuuacggugggggauggcggcuccagggcucguggaauacaggcgaggaaguccaggugaucgccguagagccugggaagaaccccaaaaauguccagaccgcuccaggaacauuuaagacuagcgaaggugaggugggcgccauugcauuggauuucaaacccgggaccucaggauccccuaucguuaacagagaaggcaagauugugggucuguaugggaauggagucgugacgacaaguggcacuuacguuucugcuaucgcccaagcgaaagccagccaggagggcccacuccccgagauagaagacgagguguuuaggaagcgaaaccugaccaucauggaucuucacccuggguccggaaagacacggcgcuaucugccggcaauugucagagaagcuaucaaaaggaaguugcggacccuaauucuggccccaacucgagugguagcuucagagauggcagaagcccucaaagguaugcccaucagauaccagaccacagccgugaagucugagcauacgggcaaagagauaguugacuuaaugugccacgcuacuuucaccaugcgccugcuuagcccugucagggugccaaauuauaacaugauuaucauggaugaagcgcauuuuacagaccccaguuccaucgcagcccguggguacauuagcacccgggugggaaugggcgaggcugccgcaaucuucaugacugccacaccuccggguucugucgaggcuuuuccccaaucaaaugcgguaauacaggaugaggaaagagacauuccagagagguccuggaacaguggguaugaguggaucaccgauuucccuggaaagacggugugguucguucccagcauuaagucgggcaaugacaucgccaacugucugcgcaaaaauggcaagcgagugauacagcucucuagaaaaacuuuugauacagaauaccagaagaccaaaaacaacgacugggacuacgucgugaccacugauauuuccgagaugggggcaaauuuccgggcugacaggguuaucgauccacgccguugcuugaagccugugauccugaaggacggacccgaaagagucauucucgccgguccaaugccggugacaguagcaagcgccgcucaacggaggggccgcaucgggcgaaaccacaauaaagagggagaucaguauauuuacaugggccagccucugaacaaugacgaggaucaugcccacuggaccgaagcgaagaugcuucuagacaacauaaauacacccgaggguaucauuccagcacuguuugaacccgagagagaaaaaucagccgcuaucgauggggaguaucgguugaggggcgaggcccgcaagacuuucguggaauuaaugagaaggggagaccugccuguuuggcucaguuacaaagucgcuucugagggcuuucaguauuccgaucggcguuggugcuucgacggggaacgcaacaaucaagugcuggaggaaaacauggauguggagaucuggacgaaggagggagaacgaaagaaacuuagaccaagguggcuggacgcacggaccuacagcgacccccucgccuugcgcgaguuuaaagaguucgcugccgguagaaggucagucaguggcgaucugauucuagagauagggaaacugccucagcaccucacacagcgggcacagaaugcgcuugacaaccugguuauguuacauaauagcgaacaaggaggccgagccuauagacacgcuauggaggaguugccggauacuaucgaaacccugaugcuccuggcccuuauugcagugcugacaggugggguaacccucuuuuucuuguccggccgcggacugggcaagacuucuaucggguuacuaugugugauggcuagcuccgcccugcucuggauggcaucagucgagccacauuggauugccgcuucuaucauacuugaauuuuuccugaugguguugcugauccccgagccugacaggcagcggacgccccaggauaaccagcucgcguacguugugauuggacugcuuuuuaugauccucaccgucgccgcaaaugagaugggucuguuggaaacaacuaaaaaggaccugggcauugggcacguagcuguggagaaccaccaucacgccgccauguuagauguugaccuacauccagcaagugcuuggacccuguacgccguggcgacaaccaucauaacuccuaugaugcgucacacaauugaaaacacgaccgcuaauaucucgcucacugccauugcaaaccaagccgcuauccuuaugggacuggauaaaggcuggcccauaagcaagauggacaucggugucccauugcuggcacucgggugcuauucccaggugaauccucugacacuuaccgccgcggucuuaaugcugguggcucauuacgccauuaucggcccgggacuccaggcaaaggccaccagagaggcucagaagaggacagccgcaggcauuaugaagaaccccacuguugaugggaucguggcuauagacuuggauccaguaguguaugacgccaaauucgaaaagcagcugggacagauuaugcuacugauccucuguacgucucagauccuucugaugcgcaccacaugggcguugugcgagucaauuacucuggccaccggcccucucacaacccugugggaggguagccccgggaaauucuggaauacuacgaucgcagucuccauggcuaacauauuucggggaaguuacuuagccggcgcaggucuugcuuucucucugaugaaaagccucggcgggggacgaagaggcacaggggcccaaggagaaacccuaggcgagaaguggaaaaggcagcugaaucaguugucaaaguccgaauuuaacacuuauaaacgcagugguauuauggagguugaccggagcgaagccaaggaggggcugaaaagaggagagaccacaaagcacgcggugucucguggcacugcuaagcucaggugguucgucgaacggaaucuugugaaaccagaggguaagguaaucgaucugggcugugggcgcggaggcugguccuacuauugcgcaggguugaaaaaggugaccgaaguuaaaggauacacaaagggcgguccugggcacgaggaacccauuccgauggccacguacggauggaaccuggugaaacuccauucaggcaaggacgucuuuuucaucccaccugagaagugugauaccuuacugugcgacauaggcgagagcucgcccaauccaacuaucgaagaggggcgaacacuuagagugcugaaaauggucgaacccuggcuaaggggaaaccaguuuuguauuaagauccucaauccuuauaugccgucugugguugagacccuggagcaaaugcagcggaaacacgguggcauguugguacgcaacccccugaguagaaauuccacucaugaaauguacugggugagcugcgggacaggaaacauugucucagcugugaauaugaccuccaggaugcuccuuaaccgauucacgauggcccaccggaagccaaccuaugagcgugauguugaccugggcgcagguacaagacacguggccgucgaaccugagguggcuaacuuagauaucauugggcagcgcaucgaaaauauaaaacaugagcacaagucuacuuggcauuacgacgaggauaaccccuauaagaccugggcguaccacggaagcuaugaaguaaaaccuaguggcuccgccagcucuauggugaauggcguugucaagcuguugacaaaaccaugggacgugauucccauggugacucagaucgcaaugaccgauacaaccccuuuugggcaacagagggucuucaaggagaaaguugacacucggacgccaaaggcuaagagaggaacagcccagaucauggaagugaccgcaaaauggcucugggguuuucugucacgcaacaagaaacccaggauuuguacucgagaggaguucacccggaagguaagaaguaaugccgcuauaggcgccguguuugucgacgagaaccaauggaacuccgcgaaagaggcaguggaagaugagagguucugggaccuaguucaucgcgaacgugagcuucacaagcaggggaagugcgccacaugcguguacaacaugaugggaaaacgggaaaagaaacugggcgaguucgguaaggcuaaagggagcagagccaucugguacauguggcucggagcaagguuucuggaguucgaggcuuugggcuuuaugaaugaggaucacugguucucucgcgaaaacucgcugucaggcgucgagggggagggacuccauaaacuugguuauauucugcgagacaucagcaaaauuccgggcgggaauauguacgccgaugacacggcuggaugggauacccggaucacugaagacgauuuacagaacgaggccaagauaacagacaucauggaaccugagcacgcacuguuggcgaaguccauuuuuaaacucaccuaucagaauaaggugguaagaguucaaaggccagccaaaaacggcacugugauggaugucaucagucgcagagaccagcgggguucuggacaggugggaacauacggccugaauaccuucacaaacauggaagcucagcuaauuaggcaaauggagagcgagggcaucuuuucccccucagaacuugagacuccuaaccuggccgggcgugugcucgauuggcuggaaaagcauggagucgagcgauugaaacgcauggcaauaaguggugacgacuguguugugaagccaauugaugacagauucgcuaccgccuuaacggcacugaaugauaugggcaagguacggaaagacaucccccagugggaaccgucuaagggguggaacgauuggcaacaggugccuuuuugcagccaccacuuccaucaacucaucaugaaagacggaagggagauugucgugcccugucgcaaucaggaugagcuuguuggcagagcccgggugucccagggugcgggguggucacugagggaaaccgcuugccuaggaaagagcuaugcccagauguggcaacugauguacuuucaccgacgugaccucagauuggcagccaacgcuauauguucugccgucccaguggauuggguaccuacaucccgcacuaccuggaguauccaugcacaccaucaguggaugacaacugaggacaugcugagcguuuggaaucggguguggauugaagagaaccccuggauggaagauaaaacccacaucucguccuggggcgacgucccauaucuuggcaagagggaggaccaguggugcgggucucugauuggacucacggcuagagccacaugggcgaccaauauccaaguggcuauaaaccagguucgccgguuaaucgguaaugagaacuaccuggauuacaugacuucaaugaagagguucaaaaaugaaagcgaccccgagggcgccuugugguga

SEQ ID NO: 14017 - RNA, 9879 nt, Artificial Sequence
  derived and/or modified CDS sequence (opt3) from DENV-1__EU482816__SS-prME
agcgugaccaugcugcuaaugcuuaugcccaccgcacuggcuuuccacuugacuacgagaggcggggaaccucauaugaucgucuccaagcaggaaagggggaaaucuuuacuguuuaagaccucagccgguguuaacaugugcacacuaauugcaauggaccucggcgaguucugugaagauacuaugaccuacaaaugcccacggauaacagaggcggaaccggacgauguggacuguuggugcaaugcuaccgauacuuggguaacauaugggaccuguagucaaacgggagagcaccgccgagacaagcguagcguggcccuggcaccccaugucggccuuggucuggagacuagaaccgaaacauggauguccucugagggggccuggaaacagauccagaggguggaaacuugggcuuugcggcacccuggauuuaccguuauugcacucuuccuggcccaugcuaucggcacaucgauuacccagaagggcaucauauuuauccugcucauguuagugacgccaucaauggccaugcgcugcgucgggauuggaagcagagauuucguggagggucugaguggcgcgacuuggguagacguugugcuugagcacggguccugugucacaaccauggcaaaggauaaacccacuuuggacaucgaacugcuaaagacagaggugaccaacccugccgugcucaggaaacugugcauugaagcuaagaucucuaauacgaccacagauagccgguguccaacucaaggagaggccacccuugucgaagaacaagacgcaaacuuuguuugccgccgaacauucguggauagaggcugggguaauggguguggacuguuuggcaaaggcuccuugauaacuugcgcuaaguucaagugcguaaccaaacucgaggggaagacagugcaguacgaaaaccugaaauauucagucauugugaccguucacacuggagaccagcaucaaguggguaaugagaguacggaacacggcacaaccgccacuaucacaccccaggcgccuagcacagagauucaguuaaccgacuacggggcccugacucucgauuguucuccaaggacaggacuugacuuuaacgaaaugguccuguugacgaugaaggagaaauccuggcuagugcauaagcagugguuccuggaucucccgcugcccuggaccucaggcgcaagcacaagucaagagacauggaaucggaaagaccuucugguaaccuuuaagacagcucacgccaagaaacaggaaguuguggucuuggguucucaggagggggcuaugcacacugcccucaccggcgcaacggaaauccaaaccuccggaacaacuaccaucuucgccggccaucugaagugccguuuaaaaauggauaagcugacacuaaaagggaugagcuaugugauguguacuggaucguucaagcucgagaaggaagucgcugagacccagcacgguacggugcugguucagauuaaauacgagggcacagacgcgccuugcaagauaccauuuucuacccaggaugaaaaaggggugacucaaaacggacgccuuaucacagcaaaucccauuguaaccgacaaggagaaaccugucaacaucgaagccgagccacccuucggcgaguccuauauagugauuggugcuggggaaaaggccuugaagcugucaugguuuaaaaagggcaguagcaucggaaaaauguucgaggcaacugccagaggcgcuaggcggauggccauccucggggauaccgcaugggacuuuggauccauugguggcguuuucacaucuguggggaagcugguccaucagaucuuuggaacggcguacggcgugcuuuucagcgguguaucauggaccaugaaaauugggauaggcgugcuguugacuuggcucggacugaauagucgauccacuagcuuaucuaugaccuguaucgcuguuggccuggucacacuauaccucggggugauggugcaggccgauucaggaugcgucauuaacuggaagggccgcgaacugaagugugguagugggaucuuuguuacuaaugaggugcacaccuggacggaacaguauaaauuccaagcagacagcccgaagagacuuuccgccgcuaucggaaaagccugggaggagggcgugugcgguauuaggucugcaacacgguuggaaaacauaauguggaagcagaucucgaacgagcugaaucauauucuccuggaaaacgacaugaaauuuaccguagucgugggcgauguugcugggaucuuagcccagggaaagaaaaugauucgcccucagcccauggaguacaaguauagcuggaaguccuggggcaaagcgaagaucauaggggccgacgugcaaaauacuaccuucaucauugauggaccaaacacaccugaaugucccgacgaucagagagcuuggaauaucugggaggucgaggacuacggcuuugguauuuucacuaccaacaucuggcugaaacuuagggauucauauacacaggugugcgaccaccguuugaugagugcagccauaaaggauucuaaagcuguucacgccgacaugggguacuggauugaaagcgagaagaaugaaacguggaagcucgcacgggcguccuucaucgaggugaaaaccuguauuuggccaaagucacauacucuguggagcaacggaguacuagaaucugagaugaucauacccaaaaucuauggcgguccuauuucccagcacaauuaccgaccaggcuacuuuacacaaaccgccgggccguggcaucugggaaagcucgagcuggauuucgaccuuugcgaaggcacuacagucgugguggaugagcacugcgggaacagaggacccaguuugaggaccacgacugucaccggcaaaaucauucacgaaugguguugccgcagcuguacacugccuccauuacgguuuaagggugaggacgggugcugguauggaauggagaucagacccguuaaggaaaaagaggaaaaucucgugaagucuaugguauccgcuggcucaggugagguggacaguuucagccugggccuucuguguauaucgauuaugaucgaagaggucaugaggucccgcuggucucgaaaaauguugaugaccgggacucucgccguguuuuuccugcuaaucaugggacagcugacauggaacgaucucauucggcugugcaucaugguuggcgcaaaugcuagcgaccguauggggaugggaaccacauaccuugccuugauggcaacuuuuaagaugagaccuauguucgccgugggccuguuauuuaggcgccucaccucacgggagguccugcuucugacgauuggucuaagucucguggcuuccguugaacugccaaacucuuuggaggaacugggggauggauuagcgaugggcauaaugauccucaaacugcuuacagacuuccagagccaucaacugugggccaccuugcucucccugacuuuuauuaagaccacauucucacuacacuaugcauggaagacuauggcuauggugcugagcaucgucagucuuuuuccccucugucugucuaccacgucccagaaaacaaccugguugccgguacuguuaggcagccucgggugcaagccucugacuauguuccuuauugccgagaauaaaaucuggggaagaaagucguggccacugaacgaagguauaauggccgugggcaucguuucaauuuugcucucuagucugcucaagaaugaugugccccuggcugggccucuuaucgcaggaggcaugcucauugccuguuacgucaucuccgguagcucugcggaccugagcuuggagaaggcugccgagguguccugggaagaggaagcagagcauucaggggccagucacaauauauuaguagaagugcaggaugacggaacaaugaaaauuaaggaugaggagagggacgauacccugacuauccuccugaaggcuacacuucuggcagucagcggcguuuaucccuugucuaucccagccacccuauucgugugguacuuuuggcagaaaaagaaacaacgauccggcgugcugugggacacgccuucacccccagaagucgagcgcgcggugcucgaugacgggauuuaucggauaaugcagagaggacugcuugguaggagucagguuggcguagggguguuccaggaaaacgucuuucauacuauguggcacgugacccguggagcuguuuuaauguaccaaggcaagcgccuggagccgagcugggccuccgugaaaaaggaccucaucucuuacggugggggauggcgguugcagggcucguggaauacaggcgaggaaguccaggugauugcaguagagccugggaagaaccccaaaaauguccagaccgccccaggaacauucaagacuagcgaaggugaggugggcgcuaucgcccuggauuuuaaacccgggaccucaggauccccuauuguuaacagagaaggcaagaucgugggucucuaugggaauggagucgugacgacaaguggcacuuacguuucugcaauagcucaagccaaagcgagccaggagggcccacugcccgagaucgaagacgagguguucaggaagcgaaaccuuaccauuauggaucugcacccuggguccggaaagacacggcgcuauuugccggccaucgucagagaagcaauuaaaaggaagcuacggacccugauccucgcuccaacucgagugguagccucagagauggcugaagcauuaaaagguaugcccauaagauaccagaccacagccgugaagucugagcauacgggcaaagagauuguugaccugaugugccacgccacuuuuaccaugcgccuucugagcccugucagggugccaaauuauaacaugaucaucauggaugaagcucauuucacagaccccaguuccauugcggcacguggguacaucagcacccgggugggaaugggcgaggccgcugccauauuuaugacugcaacaccuccggguucugucgaagccuucccccaaucaaaugcuguaauucaggaugaggaaagagacaucccagagagguccuggaacaguggguaugaguggauuaccgauuuuccuggaaagacggugugguucguucccagcaucaagucgggcaaugacauagcgaacugucuccgcaaaaauggcaagcgagugauucaguugucuagaaaaacuuucgauacagaauaccagaagaccaaaaacaacgacugggacuacgucgugaccacugauaucuccgagaugggggccaauuuucgggcagacaggguuaucgauccacgccguugccugaagccugugauucucaaggacggacccgaaagagucauccuggcugguccaaugccggugacaguagccagcgcagcccaacggaggggccgcauugggcgaaaccacaauaaagagggagaucaguauauauacaugggccagccucuuaacaaugacgaggaucaugcucacuggaccgaagccaagaugcuacuggacaacaucaauacacccgaggguauuaucccagcguuguucgaacccgagagagaaaaaucagcagccaucgauggggaguaucgguuaaggggcgaggcucgcaagacuuuuguggaacugaugagaaggggagaccucccuguuuggcugaguuacaaagucgccucugagggcuuccaguauuccgaucggcguuggugcuuugacggggaacgcaacaaucaagugcuugaggaaaacauggauguggagauuuggacgaaggagggagaacgaaagaaacugagaccaagguggcucgacgcucggaccuacagcgaccccuuggcacugcgcgaguucaaagaauuugccgcugguagaaggucagucaguggcgaucuaauacuggagaucgggaaacucccucagcaccuuacacagcgggcccagaaugcacuggacaacuuaguuauguugcauaauagcgaacaaggaggccgagcguauagacacgccauggaggagcugccggauacuauugaaacccucaugcugcuugcucugaucgccgugcucacaggugggguaaccuuguucuuucuguccggccgcggauuaggcaagacuucuauugggcuacugugugugauggcaagcuccguccuccuuuggauggcuucaguggagccacauuggaucgccgcaucuauaauccuggaguucuuuuugaugguucugcucauucccgagccugacaggcagcggacgccccaggauaaccagcuggccuacguggucaucggacuucucuucaugauucugaccguagcugcgaaugagauggguuugcuggaaacaacuaaaaaggacuuaggcaucgggcacguggccguugagaaccaccaucacgcagcuaugcuagauguggaccugcauccagccagugccuggacccucuacgcagucgcuacaaccauaauuacuccuaugaugcgucacacaaucgaaaacacgaccgccaauauuucgcuuacugcgaucgcuaaccaagccgcaauacugaugggauuggauaaaggcuggcccaucagcaagauggacauuggugugccacugcucgcccuggggugcuauucccaggucaauccucuuacauuaaccgcugcagugcugaugcucguugcccauuacgcgaucauuggcccgggauugcaggcuaaggccaccagagaggcacagaagaggacagccgcuggcaucaugaagaaccccacuguggaugggauaguagccauugaccuggauccaguggucuaugacgcaaaauuugaaaagcagcuaggacagaucaugcugcucauccuuuguacgucucagauucuguugaugcgcaccacaugggcucugugcgagucaaucacucucgccaccggcccucugacaaccuuaugggaggguagccccgggaaauucuggaauacuacgauagcgguuuccauggccaacauuuuccggggaaguuaccuugcaggcgcuggucuggccuuuucucucaugaaaagccuaggcgggggacgaagaggcacaggggcacaaggagaaacccugggcgagaaguggaaaaggcaguugaaucagcugucaaaguccgaguucaacacuuauaaacgcagugguaucauggagguggaccggagcgaagcuaaggaggggcucaaaagaggagagaccacaaagcacgccgucucucguggcacugccaaacuuaggugguuuguggaacggaaucugguaaaaccagaggguaaggugauugauuugggcugugggcgcggaggcugguccuacuauugcgcggggcugaaaaagguuaccgaagugaaaggauacacaaagggcgguccugggcacgaggaacccaucccgauggcuacguacggauggaaccucgucaaauuacauucaggcaaggacguguucuuuaccccaccugagaagugugauacucugcuuugcgacauaggcgagagcucgcccaauccaacaaucgaagaggggcgaacccugagaguccuaaaaaugguggaacccuggcucaggggaaaccaguucuguauuaagauccugaauccuuauaugccgucuguuguagagacuuuggagcaaaugcagcggaaacacgguggcaugcuggugcgcaacccccucaguagaaauuccacacaugaaauguacugggucagcugcgggaccggaaacauugugucagcaguuaauaugacguccaggaugcuucugaaccgauuuaccauggcccaccggaagccaacauaugagcgugauguggacuuaggcgcugguacuagacacgucgccguggaaccugagguagcaaaccuggauaucauugggcagcgcaucgaaaauauaaaacaugagcacaagucuaccuggcauuacgacgaggauaaccccuauaagacaugggccuaccacggaagcuaugaagugaaaccuaguggcuccgcuagcucuaugguuaauggcgucgugaaguugcucacuaaaccaugggacgugauucccauggucacccagaucgcgaugacagauaccacuccuuucgggcaacagaggguuuuuaaggagaaaguggacacgcggacaccaaaggccaagagaggaaccgcacagaucauggaaguaacugcuaaauggcugugggguuuccuaucacgcaacaagaaacccaggauuuguacccgagaggaauuuacacggaaggugagaaguaaugccgcaauaggcgccgucuucguggacgagaaccaauggaacuccgcuaaagaggccguugaagaugagagguuuugggaccuugugcaucgcgaacgugagcugcacaagcaggggaagugcgcgacgugcgucuacaacaugaugggaaaacgggaaaagaaacucggcgaguucgguaaggcaaaagggagcagagccaucugguacauguggcugggagcuagguucuuggaguuugaagcccugggcuucaugaaugaggaucacugguuuucucgcgaaaacucgcucucaggcguggagggggagggacuucauaagcuggguuauauuuuacgagacaucagcaaaauuccgggcgggaauauguacgcagaugacaccgcuggaugggauacucggaucacagaagacgaucugcagaacgaggccaagauaaccgacaucauggaaccugagcacgcuuugcucgccaaguccauuuucaaacugacuuaucagaauaagguaguuagagugcaaaggccagccaagaacggcacagucauggaugugaucagucgcagagaccagcgggguucuggacaggugggaaccuacggccuaaauacauuuacuaacauggaagcgcagcuuauuaggcaaauggagagcgagggcaucuucucccccucagaacuggagaccccuaaccucgccgggcguguccuggauugguuggaaaagcauggaguugagcgauuaaaacgcauggcuauaaguggugacgacugugugguaaagccaauugaugacagauuugccacggcacugaccgcucucaaugauaugggcaaggugcggaaagacaucccccagugggaaccgucuaagggguggaacgauuggcagcaggucccuuucugcagccaccacuuucaucaacuuaucaugaaagacggaagggagauugugguucccugucgcaaucaggaugagcuggugggcagagcccgggucucccagggugcaggguggucacuaagggaaacagccugccugggaaagagcuaugcgcagauguggcaacucauguacuuccaccgacgugacuugagacuggcugccaacgcaauauguucugccgugccaguagauuggguuccuacuucccgcaccacauggaguauccaugcucaccaucaguggaugacuaccgaggacaugcuuagcguguggaaucgggucuggauugaagagaaccccuggauggaagauaaaacgcacaucucguccuggggcgacgugccauaucugggcaagagggaggaccaguggugcgggucucucauuggauuaacagccagagcaaccugggcuacuaauauccaaguugccauaaaccaggugcgccggcugaucgguaaugagaacuacuuggauuacaugacaucaaugaagagguuuaaaaaugaaagcgaccccgagggcgcgcugugguga

SEQ ID NO: 14018 - RNA, 9879 nt, Artificial Sequence
  derived and/or modified CDS sequence (opt3) from DENV-1__EU482821__SS-prME
agcgugaccaugcugcucaugcuuaugcccacggcccuggcuuuccacuugacuacgagaggaggggagccucauaugaucgucuccaagcaggaaagaggaaaaucuuuacuguuuaagaccucagccgguguuaacaugugcacacugauugccauggaccucggcgagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaaacagagauuuuguggagggucuuagcggcgccacauggguagacguuguguuggagcacgggaguugugucaccacuauggcgaaggauaaacccacacuggacaucgaacuacucaagaccgaggugacgaauccugcagugcugaggaaacuuugcauugaagccaagaucuccaacaccacaacugauucucgguguccaacccaaggagaggcuacacuggucgaggaacaagacgccaauuucguuugccgccgaacuuuuguggauagaggcugggguaacggguguggauuguucggcaaaggcagccucauaaccugcgcaaaguuuaagugcguaacaaaacuggaggggaagauugugcaguacgaaaauuuaaaauauuccgucaucgugaccguucacacuggagaccagcaucaaguggguaacgagucaacggaacacggcacaaccgcuacuauuacaccccaagccccuaccaccgagauccagcugacugacuacggggcgcucacacuugauuguaguccaaggacgggacuggacuucaaugaaauggucuugcuaaccaugaaggagaaaagcuggcuggugcauaagcagugguuucucgaucugccgcuucccuggacuucuggcgccuccacaucacaagagaccuggaaccggcaggaccuguugguaacauucaaaacugcacacgcuaagaagcaggaaguugugguccucgguagccaagagggggccaugcacaccgcucugacgggcgccaccgaaauccagacaaguggaacuaccacaauuuuugcaggccauuuaaaaugccgucugaagauggauaaacuaacucucaaggggaugucuuaugugauguguaccggauccuucaaacuggagaaggaagucgccgagacgcagcacgguacagugcuuguucagauaaaguacgagggcaccgacgcuccuugcaaaaucccauucagcacucaagaugaaaagggggugacacagaauggacgcuugauuaccgcgaaccccaucguaacugacaaagagaagccugucaauauagaagcagagccacccuuuggcgagucguauauugugaucggugccggggaaaaagcucugaagcucucuugguucaagaaaggcuccucaaucggaaagauguuugaggccaccgcaagaggcgccaggcggauggcuauucugggggauacagccugggacuucggaaguaucgguggcguuuuuacgagcguggggaaacuuguccaucagauuuucggaaccgcauacggcgugcuguuuuccgguguaucuuggacuaugaagauagggaucggcguguugcucacauggcugggauuaaacagccgaucaaccagucuguccaugacauguauugcgguuggccuagucacucucuaccugggggugauggugcaggcugauagcggaugcgucaucaauuggaaaggccgcgaacuuaagugugguucugggaucuucguuaccaacgaggugcacacguggacagaacaauauaaguuucaggccgacucaccgaaaagauugagugcagccauuggaaaggcuugggaggagggcgugugcgguauaaggagcgccacccggcuggaaaacaucauguggaaacagauuuccaaugagcucaaccauauccuguuagaaaaugacaugaaguucacuguagucgugggcgauguugcagggauucuggcucagggcaaaaagaugauccgcccucaacccauggaguacaaauauucuuggaagucguggggcaaggccaaaauaaucggggcggacgugcagaacaccacauuuauuaucgauggaccaaauacuccugaaugucccgacgaucagagagccuggaacauuugggaggucgaggacuacggcuucgguaucuuuaccacaaauauauggcuuaaguugagggauagcuauacacaggugugcgaccaccgucucauguccgcugcaauuaaagauucaaaggccguucacgcugacaugggguacuggaucgaaagugagaaaaacgaaaccuggaagcuggcccgggcaucuuucauugaggugaagacuuguaucuggccaaaaagccauacacuaugguccaauggaguacuggaaucagagaugauaauccccaagauuuauggcgguccuaucagccaacacaacuaccgaccaggcuacuucacccagacugcggggccguggcaucucggaaaacuggagcuugauuuugacuugugcgaaggcacaaccgucgugguggaugagcacugcgggaauagaggacccucucugaggacgacuaccgucacaggcaagauuauccacgaaugguguugccgcuccuguaccuuaccuccacuccgguucagaggugaggacgggugcugguauggaauggagauaaggcccguuaaagaaaaggaggaaaaccuggugaagaguaugguaagcgccggcucuggugagguggacuccuuuucacuuggccuguuguguauuaguaucaugaucgaagaggucaugcgcagccgauggucgcggaaaaugcucaugacugggacacuggcuguguucuuucuacugauuaugggacagcucaccuggaaugaucugauccgucuuugcauuaugguuggcgccaacgcauccgacagaauggggaugggaacaacuuacuuggcucugauggccaccuucaagaugaggccuauguuugcagugggcuuacucuuccgccggcugacgucuagagagguccuucugcuaacaauaggucucagccugguggccucaguugaauugccaaauagucuggaggaauuaggggauggacucgcuaugggcaucaugauucugaaacuucugaccgacuuucaaucccaucaguugugggcgacucuccugucucuaaccuucaucaagacaacuuuuagccugcacuaugccuggaaaaccauggcaauggugcuuuccauugucucacucuucccccuguguuugagcacgacaagucagaagaccacuuggcugccgguauuacucggcucucuggggugcaagccucuuacaauguuucugaucgcugagaacaaaauauggggaaggcgauccuggccauugaacgaagguaucauggccgugggcauuguuagcauccuccugucgucacuacugaagaaugaugugccccuugccgggccucucauugcuggaggcaugcugaucgcauguuacgucauaucugguaguuccgccgacuugagcuuagagaaagcggcugaggugucuugggaagaggaagccgagcauagcggggcaucccacaacauucugguagaagugcaggaugacggaaccaugaagaucaaagaugaggagcgcgacgauacucucacaauccugcuuaaggccacccuguuggcugucucaggcguuuauccccuaaguauuccagcaacgcuguucgugugguacuucuggcagaaaaagaagcagcggagcggcgugcucugggacacuccuucucccccagaagucgggagagccgugcuggaugacggaauauauaggaucaugcagcguggucuuuuaggccgcucccagguugggguaggaguguuucaagagaaugucuuccauaccauguggcacgugacacggggcgcgguucugauguaccaggguaaaagacucgaaccgucaugggcuagugugaagaaagacuugauuagcuacgggggaggcuggaggcugcagggcuccuggaacaccggggaggagguccaggugaucgccguagaaccuggaaagaaucccaaaaacguccaaacagcaccagguacuuuuaagacccccgagggcgaagugggggccauugcucucgauuucaagccuggaacgucuggcucgccaaucguuaaucgagaggguaaaauaguggggcuguauggaaacggcgucgugacaacuagcggcaccuacguuucagccaucgcacaggcuaaggccucccaggaagggccccuuccugagauugaggacgaaguguuucggaaacgcaaucugacaaucauggauuugcacccgggaagugguaagaccagaagguaucuaccagcgauuguccgggaggccaucaaacgaaagcugagaacucucauauuagcacccacccgcgugguagcuucugaaauggccgaggcucugaagggcaugccuauuagguaccaaacaacggcagugaaaagcgaacauacugggaaggagaucguugaccuuaugugccacgccaccuucacaaugcgucugcucuccccaguccgggugcccaacuauaauaugaucauuauggaugaggcccauuuuaccgacccuucaucuaucgcugcgagaggauacauaagcacuagggugggcaugggugaagcagccgcuauuuucaugacagccaccccgcccgggagugucgaggcauuuccacaguccaacgccguaauccaggaugaggaacgcgacauuccugaacgaagcuggaacucuggauaugaguggaucacggauuuccccggcaaaacugugugguuuguuccaucaauaaaguccggcaacgacauugcuaauuguuugaggaaaaaugggaagcgggugauccagcugaguaggaagacauucgauaccgaguaccagaaaaccaagaacaaugacugggacuacgucgugacuacagauaucagcgaaaugggagcgaacuuccgcgccgaccguguuauugauccuagacggugccucaaacccgugauccugaaggacgguccagagagggucauucuugcaggcccgaugccugugaccguagcuucggccgcacagcgccgagggagaauaggacggaaucacaacaaagaaggcgaucaguauaucuacaugggucagccccuaaauaacgacgaggaucaugcccacuggacagaggcuaagaugcuguuggacaauauuaacacuccagaagggaucauccccgccuuauuugagccugaaagggagaagucugcggcaauugauggcgaauaucgccugagaggagaggccaggaaaacguucguggagcucaugcggcguggcgaccugccaguuuggcuuuccuacaaggucgcuagcgaaggguuucaauauucagaucgccgauggugcuucgacggagagagaaauaaccaggugcuggaagagaauauggauguggaaauauggaccaaagagggugagaggaagaaacuccggccccgcugguuggacgccagaacauacagugacccucuggcucuaagggaauuuaaggaguucgcagccggccggcgaucugucuccggggaucugauccucgaaauuggaaaacuuccgcagcaccugacucagagagcucaaaacgccuuagacaauuugguuaugcugcauaacagcgagcagggcggucgcgcauauaggcacgcgauggaggaacucccagauaccaucgagacacugaugcuucuggcccucauugcuguguugaccgggggcguaacucuguuuuucuuaucaggacggggccuagggaagacgaguaucggacugcucugugugauggccagcuccguccuucuguggauggcaucuguggaaccccauuggauagcugccagcaucauuuuggaguuuuuccugaugguucuccugaucccugaacccgaccgucagagaaccccacaggauaaucaacuugcauacguggucauuggucuccuguuuaugaucuugacaguagccgcuaacgagaugggccuguuagagacuaccaagaaagaccuagggauaggacacguggcgguugaaaaccaccaucacgccgcaaugcuggauguggaccuccauccugcuuccgccuggacacuuuacgccgucgcaaccacuauuaucacacccaugaugaggcacacgauugagaauaccacugcuaacaucucacugacagccauagcgaaucaggcugccaucuugaugggccuggauaaggguuggccaauuucuaaaauggacaucggggugccucuccuggcacuuggcugcuauagucaggucaacccguuaacccugaccgccgcugugcucauguugguugcacauuacgccauuaucggacccggccugcaagcgaaggcuacacgcgaagcccagaaacggacugcagccgggauaaugaagaauccaacgguggauggaauuguagcuaucgaccuagauccuguggucuaugacgccaaguucgagaaacagcugggccagaucaugcuccuuauucuguguaccucgcaaaucuugcugaugcgaacaacuugggcacucugcgaaagcauaacccuggcuacaggucccuuaaccacucuuugggagggguccccaggaaaguuuuggaacacgacaauugccguuucuauggcgaauaucuucagaggcucauaccuggccggugcaggccucgcuuucagccuaaugaaaucccuagggggaggcaggcgcgggaccggagcccagggcgagacuuugggugaaaaguggaaacggcagcugaaccagcucaguaagucugaguuuaauaccuauaagagaagcgggauuauggaaguggaccguucagaggcaaaagaaggacuuaagaggggcgagacaacuaaacacgcugucucccgggguaccgccaagcugcgcugguucguggagcgaaacuugguaaaaccugaaggcaaggugaucgaucugggguguggaagaggcggguggaguuacuauugcgccggacucaagaaaguuacagaggugaagggcuacacgaaaggugggcccggacacgaggagccgauaccaauggcgaccuacggcuggaauuuagucaagcugcauagcggcaaagacguguuuuucaucccucccgaaaagugugauacucuucugugcgacauuggggagucuuccccaaaccccacaaucgaggaaggaaggacccuacggguccucaaaaugguggagccuuggcugcgcgguaaucaauuuuguauuaagaucuugaacccguauaugcccucaguuguagaaacucuggagcagaugcagagaaagcacggcgggaugcucgugaggaauccacuuagccgaaacucgacacaugagauguacugggucucuugcggaaccggcaauauugugagugcuguuaacaugacgucccggaugcuguuaaaccguuucaccauggcacacagaaaaccuacauaugaacgcgauguggaccugggugccgggacuaggcacgucgcuguggagcccgaaguagccaauuuggauaucauaggacagcggauugagaacaucaagcaugaacacaaaagcaccuggcauuacgacgaggauaauccuuauaagacaugggcauaccacggcucauaugaggugaaaccauccggcucugccagcaguaugguuaacggggucgugaagcuccugacuaagcccugggacgugaucccuauggucacccaaauugcuaugacagauaccacuccauuuggacagcagagaguuuucaaagaaaagguggacacgcgcacacccaaagcgaagagggguaccgcccaaauaauggagguaacugcaaaauggcuauggggcuuucuuucccgaaauaagaagccgcggaucuguaccagagaagaguucacaaggaaagugcgcagcaacgcugccauuggggcagucuuuguggacgaaaaucaguggaacucugccaaggaggcuguugaggaugaacguuucugggaccuggugcaucgggagagagaacuccacaaacagggaaagugcgccacgugcgucuacaauaugaugggcaaaagggagaagaagcugggugaauuugggaaagcgaagggaucacgcgcaaucugguacaugugguugggcgcccgauuccuggaguucgaggcucucggcuuuaugaacgaagaucacugguucagucgggaaaauucccuuagcgggguggaaggagagggucugcauaaauuaggcuauauucugagagacaucucuaacauaccugggggaaauauguacgccgaugacaccgcaggcugggauacuaggaucacagaggacgauuugcagaacgaagcucgcauuaccgacaucauggagccagaacacgcccuccuggcuaagucgauuuuuaaacuaacuuaucaaaauaagguaguuagagugcagcggcccgccaaaaacgguacagucauggaugugaucucaaggcgugaccagcgagggagcggacaggugggcaccuacggccuuaacacauucacuaauauggaggcacaacugauacgccagauggaauccgaggggauuuuuaguccuucugagcucgaaaccccaaaccuggcggagagagucuuggauugguuagaaaaguauggaguugagcggcugaagaggauggccaucagcggugacgacugugugguaaaacccaucgaugaccgcuucgcuacggcccucaccgcacuuaaugauaugggcaaggugagaaaagacauuccgcagugggaaccuuccaagggguggaacgauuggcagcaaguccccuuuugcucacaucacuuccaccagcugauaaugaaagacggacgggagaucgugguuccauguaggaaucaggaugagcuagugggccgagcucgugucagucagggugccggguggucucugagagaaacagcaugccucggaaagagcuacgcccaaauguggcaguugauguauuuucaucgccgggaccugaggcuugcggcuaacgccauuuguuccgcagugccuguagauuggauccccacuucaagaaccacauggagcauucacgcccaucaccaguggaugacuaccgaggacaugcugucuguuuggaaucgcguguggaucgaagagaacccauggauggaagauaagacgcauauauccaguuggggcgacguccccuaccucggcaaacgggaggaccaauggugcgggagcuuaaucggacugacagcuagggccaccugggcaacuaauauucagguggcuaucaaccagguucgaagauugauugguaaugagaacuaccuggauuauaugacaucgaugaagcgguucaaaaaugaauccgacccugagggcgcccucugguga

SEQ ID NO: 14019 - RNA, 9879 nt, Artificial Sequence
  derived and/or modified CDS sequence (opt3) from DENV-1__EU482822__SS-prME
agcgugaccaugcugcucaugcuuaugcccaccgcacuggcuuuccacuugacuacgagaggaggggagccucauaugaucgucaccaagcaggaaaggggaaaauccuuacuguuuaagacaucugccgguguuaauaugugcacuuuaauugccauggaccucggagagcugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccauucugaggaaacuuugcaucgaagcuaagauauccaauaccacaacugauucucgguguccaacccaaggagaggccacacugauggaagaacaagacgcaaacuucgugugccgccgaacuuuugucgauagaggcugggguaauggguguggauuguucggcaaaggcagccucauuaccugcgcuaaguuuaagugcguuacaaaacuggaggggaagaucgugcaguacgaaaacuuaaaauauuccguaauugugaccguccacacuggagaccagcaucaaguggguaaugagucaacggaacacggcacaaccgccacuaucacaccccaggcgccuacaagugagauccagcugaccgacuacggggcccucacucuugauuguagcccaaggacaggacuggacuucaacgaaaugguuuugcuaacgaugaaggagaaaucuuggcuggugcauaagcagugguuucucgaucugccgcuucccuggaccuccggcgcaucaacuagccaagagacauggaaucggcaggaccuguuggucaccuucaaaacagcucacgccaagaagcaggaagugguaguucucgguagucaagagggggcuaugcacacugcccugaccggcgcaacggaaauucagaccucuggaacaacuaccauauuugccggccauuuaaaaugccgucugaagauggauaaacuaacacucaaggggauguccuaugugauguguacuggcagcuucaaacuggagaaggaagucgcugagacccagcacgguacggugcuuguccagaucaaguacgagggcacagacgcgccuugcaaaauuccauucucgacccaagaugaaaagggggugacucagaacggacgcuugaucacagcaaaucccauaguuaccgacaaagagaagccugugaacauugaagccgagccacccuuuggcgagucuuauaucguaaucggugcuggggaaaaagcccugaagcucuccugguucaagaaaggcucaaguauuggaaagauguuugaggcaacugccagaggcgcuaggcggauggccauccugggggauaccgcaugggacuucggaagcauugguggcgucuuuacauccauagggaaacuugugcaucagaucuucggaacggcguacggcguucuguuuucuggugugagcuggaccaugaagauugggaucggcgucuugcucacuuggcugggauuaaauucacgaaguacaucccugagcaugaccuguaucgcugugggccuaguaacacucuaccugggggugaugguucaggccgauucuggaugcgucauuaacuggaaaggccgcgaacuuaagugugguucagggauauucgugacuaaugaggugcacaccuggacggaacaauauaaguuucaggcagacaguccgaaaagauugagcgccgcuaucggaaaggccugggaggagggcgucugcgguauuagguccgcaacacggcuggaaaacaucauguggaaacagauuucuaacgagcucaaucauauccuguuagaaaacgacaugaaguucaccguuguggugggcgauguagucgggauacuggcucagggcaagaagaugauccgcccucaacccauggagcacaaauacucguggaaaagcuggggcaaggccaaaauuaucggggcggacgugcagaauacuaccuuuauuaucgauggaccaaacacaccugaaugucccgacgaucagagagccuggaauauaugggagguugaggacuauggcuucgguauuuuuacuaccaacaucuggcuuaagaugagggauuccuacacacaggugugcgaccaccguuugaugucagcugcaauuaaagauaguaaggccguccaugcugacaugggguauuggaucgaaucugagaaaaaugaaacguggaagcucgcccgggccagcuucauagaggugaagaccuguaucuggccaaaaucccacacucuguggucaaacggaguucuagaaagcgagaugauuauccccaagauuuacggcgguccuaucucucaacauaauuaucgaccaggcuacuucacacagaccgcggggccguggcaccugggaaaacucgagcuggauuuugaccuuugcgaaggcacuacagugguagucgaugagcacugcgggaacagaggacccuccuugaggaccacgacugugaccggcaagauaauucaugaaugguguugccgcaguuguacacugccuccauuacgguucaaaggugaggacgggugcugguacggaauggagaucagacccgugaaggaaaaggaggaaaaucucgucaaaagcaugguuucugccggcuccggugagguggacucauuuagucugggccuucuguguaucagcauuaugaucgaagagguaaugaggucgcgcuggucccgaaagauguugaugaccgggacucucgcuguguuccugcuacugauuaugggacagcucacauggaacgaucugauacggcuuugcaucauggucggcgccaaugcaucugaccguauggggaugggaaccacauauuuggcucugauggccacuuuuaaaaugagaccuauguucgcagugggcuuacucuuuaggcgccugaccagccgggagguucuucugcuaacgauuggucucucacugguggccagugucgaauugccaaacucccuggaggaauuaggggauggacucgcuaugggcaucaugauucugaaacuucugacagacuuccaaucucaccaguugugggcgacccuccugagccuaacuuuuaucaaaaccacacugucccuucauuacgccuggaagacuauggcaauggugcucucaauaguuagccugauccccuugugucugaguaccacgucucagaagacaaccugguuaccggugcuccugggcucccuugggugcaaaccucugacuauguucuugauugcugagaauaagaucuggggaagaaaaagcuggccacucaacgaagguauuauggccgucggcguagugucgauccugcuaucaucucugcuuaagaacgauguuccccucgccgggccucugauagcuggaggcauguugauugcauguuaugugaucagugguuccagcgccgacuuaucucuggagaaagcggcugaggucagcugggaagaggaagccgagcacuccggggcaucacauaguauccucguggaaguacaggaugacggaacaaugaagauuaaagaugaggagagggacgauacccugacuauacuucugaaggccacauugcuagcugugagcggcgucuacccccugucuaucccagcaacccucuuuguuugguauuucuggcaaaagaaaaagcagcgauccggcgugcugugggacacgccuucacccccagaaguggagcgcgccguccuugaugacgggauuuaccggaucaugcagagaggauuacuggguaggagucaggugggcguugggguauuucaagaaaauguguuccacacuauguggcacgucacccguggagcggugcucauguaucagggcaaacgcuuggagccgagcugggcuuccguuaagaaagaccugauuucuuacggugggggauggcggcuccagggcucguggaacacaggcgaggaagugcaggucaucgccguggagccugggaagaaucccaagaacguacaaaccgcaccaggaacauucaaaacucccgaaggugaggucggcgccauagcucuggauuuuaagccugggaccagcggaucaccaaucgugaauagagaaggcaaaauuguuggucuuuacgggaacggaguggucacgacauccggcacuuaugugagugccaucgcacaggcuaaggccucucaggagggcccccugccugagauugaagacgagguuuucaggaaacgaaauuugaccaucauggaucuacauccggggagcggaaagacacggcgcuaccugccagcgauagugagagaagccauuaagaggaaacuccggaccuuaauccuggcacccacucgagucguggcuuccgagauggccgaagcucuuaaggguaugccuaucagauaucaaaccacagcaguaaaaucagagcacacgggcaaggagauuguggaccugaugugccaugccacuuuuaccaugcgccucuugucuccaguuaggguccccaacuacaauaugaucauaauggaugaagcccacuucacagacccuagcaguauugcugcgcguggguauaucuccacccgggugggaaugggcgaggcagccgcuauuuuuaugacugccacaccgcccgguagcguggaagcauucccacagucuaacgccgucauccaggaugaggaaagagacauaccugagaggucauggaacuccggguacgaguggauuaccgauuuucccggaaaaacgguaugguucgugccaaguaucaagagcggcaacgacaucgcuaauugucugcgcaagaacggcaaacgaguuauucagcucucgagaaagacuuuugauacagaauaucagaagaccaagaauaacgacugggacuacguggucaccacugauaucucugagaugggggcgaacuuccgggccgacagggugauugauccucgccguugccugaaacccguuauacuuaaggacggaccagaaagagugauccuagcagguccgaugccugucacaguggcuuccgccgcacagcggaggggccgcauugggcgaaaucauaacaaggagggagaucaguacaucuauaugggccagccccugaauaacgacgaggaucacgcccacuggaccgaagcuaaaauguuguuagacaauaucaacacaccagaggguauuauacccgcccuguuugaaccugagagagaaaagagcgcggcaaucgauggggaguaccggcucaggggcgaggcccgcaaaacuuucguagaacugaugagaaggggagaccuuccaguguggcugucauauaagguugcuagugagggcuuccaauacucugaucggcguuggugcuuugacggggaacgcaauaaccagguccucgaggaaaauauggauguggagauuuggacgaaagagggagaacgaaagaaauugagacccagguggcuggacgcccggaccuauuccgacccucuagcucugcgcgaguucaaggaauuugcagccgguagaaggagcgugucaggcgaucucauccuugagauugggaagcugccgcagcauuuaacacagcgggcucaaaacgccuuggacaaucuggucaugcuccacaacagugaacagggaggccgagcauacagacaugcgauggaggagcugccagauacuaucgaaacccuuaugcugcucgccuugauagcuguucugacagguggggugaccuuauucuuucuaagcggccgcggacugggcaaaacuuccaucgggcuccuuuguguaauggccucuagcgugcuguuguggauggcauccgucgagccccacuggauugcugccucaaucauucuggaguucuuucucauggugcugcuuaucccugagcccgacaggcagcggacgccacaggauaaucaacucgcauauguugugauaggacuguuguucaugauucugaccgucgccgcuaacgagauggguuuacuagaaacaacuaagaaagaccugggcaucgggcacguagcgguggagaaucaucaccaugccaccaugcucgauguugaccuucacccugcaucugcuuggacacuguacgccguggccaccacuauuaucacacccaugaugcgucauacgauagaaaacaccacugcaaacaucaguuugacagcuauugccaaucaggcggcuauccugaugggacucgauaagggcuggccaauuucgaaaauggacaucggugucccucugcuugccuuagggugcuacagccaggugaacccgcugacccucaccgcagccgucuugaugcugguggcucacuaugcaauaauuggccccggacuacaagccaaggcgacaagagaggcucagaagaggacugccgcaggcaucaugaaaaauccaacgguugaugggaucguggccauugaccuggauccuguaguguacgacgcuaaguuugaaaaacagcucggacagaucaugcuucugauauuguguaccucccaaauucugcucaugcgcacaacuugggcccugugcgagucuaucaccuuagcaacaggcccccuuaccacucugugggaggguucaccagggaaguucuggaacacgacaauugcugucagcauggccaauaucuuucggggauccuaucucgcgggcgccggucuagcauucagucugaugaaaucuuugggcgggggacgaagaggcaccggggcucagggagaaacucugggcgagaaguggaagaggcagcucaaccagcuuagcaaaucagaauuuaauauauacaagcgcuccgguaucauggagguugaccggagugaagccaaagaggggcugaagagaggagagaccacacgucacgcagugagcaggggcacugcuaaauugcggugguucgucgaacgcaaccuggugaagccugaggguaagguaauugaucucggcugugggcgaggaggcuggucuuauuacugcgccgggcuaaagaaggugaccgaaguuaaaggauauacaaagggcggucccgggcaugaggaaccgaucccaauggccacguacggauggaaucuggugaaacuucacuccggcaaggacgucuucuuuaccccucccgagaaaugugauacucugcuaugcgacauuggcgagucaagcccaaaccccacaaucgaagaggggagaacccucagggugcugaagauggucgaaccuugguugcggggaaaucaauucuguauuaagauccugaacccguacaugcccucggugguugagacucucgagcagaugcagcgcaaacaugguggcaugcuuguaagaaauccacugucuaggaacaguacacacgaaauguauuggguguccugcgggaccggaaauauagucagcgcggugaacaugacgucacgaauguuacugaaucgguuuaccauggcucaccguaagccuacauacgagaaagauguugacuugggcgcagguacuagacauguggccgucgaacccgagguggcuaaccucgauauuaucgggcagcgcaucgaaaacauuaagcacgagcauaaauccaccuggcacuaugacgaggauaauccuuacaagacaugggccuaucauggaucuuacgaaguaaagccaagcggcagugcauccagcauggugaacggcguugucaaacugcuaacuaagcccugggacgugauaccuauggugacccaaaucgccaugacagauaccacuccauucgggcagcagagggucuuuaaagagaagguugacacgcggacacccaaagcuaagagaggaaccgugcaaauuauggaaguaacugcgcgcuggcuuugggguuuccugucuaggaauaagaaaccgcgaaucuguacccgggaggaauuuacaagaaaggugaggucaaacgccgcaauuggcgcugucuucguggacgagaaucaguggaacagugccaaagaggcaguugaagaugagcgcuuuugggaccucgugaagaaagaacgugagcugcacaagcaggggaagugcgccacgugcgucuauaauaugaugggaaaacgggaaaagaaauugggcgaguucgguaaggcuaaaggguccagagccaucugguacauguggcugggagcgagguuucucgaguucgaagcacuuggcuuuaugaacgaggaucacugguucagccgcgaaaauucucugucgggcguggagggggagggauuacauaagcuggguuacauauugcgagacaucucaaaaauuccuggcgggaacauguaugccgaugacaccgcuggaugggauacucggaucacagaagacgaucuccagaaugaggccaagauuaccgacaucauggaaccagagcacgcacugcuagcuacuagcauauucaaacuuacauaccaaaacaaaguaguuagagugcagaggcccgccaagaauggcaccgucauggaugugauuucccgcagagaccagcgggguaguggacaggugggaacauauggccugaacacuuuuaccaauauggaagcucaacucaucaggcagauggagucugagggcaucuuccugccuagcgaauuggagacgccaaacuuagccgaacguguccuggauuggcucgagaaauacgggguugaacgacuuaagcgcauggcaauuuccggagacgacugugugguaaaacccauagaugacagauuugcgaccgcccugacagcucuaaacgauauggguaaggugcggaaggacaucccgcagugggagccuucaaaaggcuggaaugauuggcagcaaguccccuucugcagucaucacuuucaccagcugauuaugaaggacgggagggagaucgugguuccaugucgcaaccaggaugaacucguggggagagcacgggucucucagggcgcagguuggagcuugagggagacugcuugccuggggaaauccuaugcccaaauguggcagcuuauguacuuccaucgacgugaccugagacucgcagccaaugcgauuuguucagcugugccuguagauuggguucccaccagccgcacaacuuggucuauccacgcccaucaccaguggaugaccacggaagacauguuauccguguggaaccgggucuggauagaggaaaauccauggauggaggauaagacacaugugaguagcuggggagacguucccuaucugggcaaaagggaggaccaauggugcggcucguugaucgggcugaccgcaagagccacuugggcuuccaacauucagguggccaucaaucagguccgccggcucauuggaaacgaaaauuaccuugauuacaugacaucuaugaagagguuuaagaacgagggugacccugaaggcgcacugugguga

SEQ ID NO: 14020 - RNA, 9879 nt, Artificial Sequence
  derived and/or modified CDS sequence (opt3) from DENV-1__EU482476__SS-prME
agcgugaccaugcugcucaugcuuaugcccaccgcacuggcuuuccacuugacuacgaggggaggggaaccucauaugaucgucaccaagcaggaaaggggaaaauccuuacuguuuaagacaucugccgguguuaauaugugcacucugauugccauggaccucggcgaacugugugaagauaccaugacauacaaaugcccacggauaaccgaggcggaaccggacgauguggacuguuggugcaaugcuacugauacauggguaaccuaugggacguguucacaaacuggagagcaccgccgagacaagcguaguguggcccuugcaccccaugucggccuggguuuggagaccagaacagaaacuuggaugagcuccgagggggccuggaaacagauccagaggguggaaaccugggcucuccggcacccuggauucacaguuauugcacuguuucuggcccaugcuaucggcaccucuauuacgcagaagggcaucauauucauccucuuaaugcuggugacuccaucgauggccaugcgcugcgucgggauuggaucaagagauuuuguggagggucuuagcggcgcgacauggguagacguuguguuggagcacgggaguugugucaccacuauggcaaaggauaaacccacacuggacaucgaacuacucaagaccgaggugacgaacccugccgugcugaggaaacuuugcauugaagcuaagaucuccaauaccacaacugauucucgguguccaacccaaggagaggccacacugauggaagaacaagacgcaaacuucgucugccgccgaacuuuuguugauagaggcugggguaauggguguggauuguucggcaaaggcagccucauaaccugcgcuaaguuuaagugcgugacaaaacuggaggggaagauuguacaguacgaaaacuuaaaauauuccgugaucgucaccgugcacacuggagaccagcaucaaguugguaaugagucaacggaacacggcacaaccgccacuauuacaccccaggcgccuacaagugagauccagcugaccgacuacggggcccucacucuugauuguagcccaaggacaggacuggacuucaacgaaaugguguugcuaacgaugaaggagaaaucuuggcugguccauaagcagugguuucucgaucugccgcuucccuggaccuccggcgcaucaacuagccaagagacauggaaucggcaggaccuguuggugaccuucaaaacagcucacgccaagaagcaggaaguaguugugcucgguagucaagagggggcuaugcacacugcccugaccggcgcaacggaaauccagaccucuggaacaacuaccauuuuugccggccauuuaaaaugccgucugaagauggauaaacuaacacucaaggggauguccuaugucauguguacuggaucguucaaacuggagaaggaaguggcugagacccagcacgguacgguccuugugcagauaaaguacgagggcacagacgcgccuugcaaaaucccauucucgacccaagaugaaaaggggguuacucagaacggacgcuugauuacagcaaaucccaucgugaccgacaaagagaagccuguaaacauagaagccgagccacccuuuggcgagucuuauauugucaucggugcuggggaaaaagcccugaagcucuccugguucaagaaaggcucaaguaucggaaagauguuugaggcaacugccagaggcgcuaggcggauggccauucugggggauaccgcaugggacuucggaagcaucgguggcguguuuacauccguugggaaacuugugcaucagauuuucggaacggcguacggcguccuguuuucuggugugagcuggaccaugaagauagggaucggcguauugcucacuuggcugggauuaaauucacgaaguacaucccugagcaugaccuguauugcugugggccuaguuacacucuaccugggggucauggugcaggccgauucuggaugcgugaucaacuggaaaggccgcgaacuuaagugugguucagggaucuucgucacuaaugagguucacaccuggacggaacaauauaaguuucaggcagacaguccgaaaagauugagcgccgcuauuggaaaggccugggaggagggcgugugcgguauaagguccgcaacacggcuggaaaacaucauguggaaacagauuucuaacgagcucaaucauauccuguuagaaaacggcaugaaguucaccgugguagucggggacgugguuggcauucuggcucagggcaaaaagaugauccgcccucaacccauggagcacaaauacucguggaaaagcugggggaaggccaagauaaucggagcggaugugcagaauacuaccuuuauuaucgacggcccaaacacaccugaaugucccgaugaccagagagccuggaauauuugggaggucgaggauuaugguuucgggaucuuuacuaccaacauauggcuuaaguugagggacuccuacacacaggugugcgaucaccgucucaugucagcugcaauuaaagacaguaaggccguucaugcugauaugggauauuggaucgaaucugagaaaaaugaaacguggaagcuggcccgggcauccuucauugaggugaagaccuguaucuggccaaaaucccacacucuauggucaaacggcguacuggaaagcgagaugauaauccccaagauuuacgguggcccuaucucucaacauaauuaucgaccaggguacuucacacagaccgcgggaccguggcaccucggcaaacuggagcuugacuuugauuugugcgaagggacuacagucgugguggacgagcacugcggaaacagaggccccucccugaggaccacgacugucaccgguaagauuauccaugaaugguguugccgcaguuguacauuaccuccacuccgguucaaaggggaggauggaugcugguacggcauggagauaagacccguuaaggaaaaggaggaaaaucuggugaaaagcaugguaucugccgguuccggcgagguggacucauuuagucuugggcuguuguguaccagcauuaugaucgaagaggucaugaggucgcgcuggucccgaaagaugcucaugacuggaacacuggcuguguuccuacugcucaucaugggccagcugaccuggaacgaccuuauucgguugugcaucaugguuggggccaaugcaucugaucguaugggaaugggcacaacuuaucuggcuuuaauggccaccuuuaaaaugagaccuauguucgcagugggucuccuguuuaggcgccuuacgagccgggagguccugcuacucacaauugggcugucauugguggccaguguugaacugccaaacuccuuagaggaacucggagacggccuggcuaugggcauaaugauccuuaagcuguugaccgauuuccaaucucaccagcucugggcgacucugcuaagccugaccuuuauuaaaacaacucuuucccuccauuacgccuggaagaccauggcaauggugcugucaaucgucagcuuguucccccuguguuuaaguacgacaucucagaagaccacuuggcucccgguacugcuugggucccugggaugcaaaccuuugacaauguuucucauugcugagaauaagaucugggguagaaaaagcuggccacugaacgaaggcauaauggccguggggguugugucgauccuacugucaucucuucucaagaacgacgucccccuggccggaccuuugauugcuggcgguauguuaaucgcauguuaugugauuaguggguccagcgccgaucugucucucgagaaagcggcugagguaagcugggaagaggaagccgagcacuccggagcaucacauaauauccugguggaaguccaggacgauggcaccaugaagauaaaagacgaggagagggaugacacucuuacaauucuguugaaggccacccuacuggcuguuaguggcguguacccccucagcaucccagcaacgcuguucgugugguauuuuuggcaaaagaaaaagcagcgaucugggguccuuugggauacuccuucacccccagaaguggagcgcgccguuuuagacgauggaaucuaccggauuaugcagagaggucugcucggcaggagccagguaggggugggagucuuccaagaaaacguguuccacaccauguggcacguuacacguggcgcgguguugauguaucaggguaaacgccuggagccgaguugggcuagcgucaagaaagaccucauauccuacgggggaggcuggcggcugcagggcucuuggaauaccggggaggaagugcagguaaucgccgucgagccuggaaagaaccccaagaaugugcaaacagcaccagguacuuuuaaaacccccgaaggcgagguuggggccauugcucuugacuucaagccuggaacgucgggcagcccaaucgugaacagagaagguaaaauugucgggcuguacggaaauggcgugguuacaacuucaggcaccuauguguccgccaucgcacaggcuaaggccagucaggaggggcccuugccugagauagaagaugaggucuuuaggaaacgaaaccuaacaaucauggaccugcauccgggaucugguaagacccggcgcuaccucccagcgauugugagagaagccaucaagaggaaauuacggacucugauucuugcacccacccgaguaguggcuagcgagauggccgaagcucugaagggcaugccuaucagauaucaaacaacggcaguuaaauccgagcacacugggaaggagauagucgaucucaugugccaugccaccuucacaaugcgcuugcugucaccagugagggugcccaauuacaacaugauuaucauggacgaagcccacuuuaccgauccuucuagcaucgcugcgcguggauauauuaguacucgggucggcaugggugaggcagccgcuaucuucaugacagccaccccgcccggguccguagaagcauuuccacagagcaaugccgugauacaggacgaggaaagagauauuccugagaggucuuggaacucaggauacgaguggaucacggacuuccccggcaaaacuguuugguuugugccauccauuaagaguggcaaugauaucgcuaacugucuccgcaagaaugggaaacgagucauacagcugagcagaaagacauucgacaccgaauaucagaaaaccaagaacaacgauugggacuacgugguuacuacagacauuucggagaugggagcgaauuuucgggccgauagggugaucgacccucgccguugccuuaaacccgucauccuaaaggaugguccagaaagagugauucuggcaggcccgaugccuguaaccguggcuucugccgcacagcggagggggcgcaucggacgaaaccauaauaaggagggcgaccaguacauuuauaugggucagcccuugaacaaugaugaggaccacgcccacuggacagaagcuaaaauguuacuggauaacauaaauacuccagaggggaucauucccgcccucuucgaaccugagagagaaaaguccgcggcaaucgacggcgaguaccggcugaggggagaggcccgcaaaacguucguugaacuuaugagaaggggcgaucugccagucuggcucagcuauaagguggcuucagagggguuucaauacagugaccggcguuggugcuucgauggagaacgcaacaaucagguguuggaggaaaacauggacgucgagaucuggaccaaagagggugaacgaaagaaacugagacccagguggcuagaugcccggacauauucugacccucuggcucuccgcgaguuuaaggaguucgcagccggcagaagguccguuagcggggaccuuauucuggagauaggaaaguuaccgcagcauuugacucagcgggcucaaaaugcccuggauaaccucgugaugcugcacaauucagaacagggcggucgagcauacagacaugcgauggaggagcuuccagacaccaucgaaacacugaugcucuuggcccugauugcuguauuaaccgggggcgugacucuauuuuuccugaguggacgcggccucgggaaaacgagcaucggacuucugugugucauggccuccucuguguugcuguggauggcaagcguugagccccacuggauugcugccuccaucauacucgaauuuuuccugauggugcuucucaucccugagcccgauaggcagcggaccccacaggacaaccaacuggcauaugucguaauugguuugcuguuuaugaucuuaacaguggccgcuaaugagaugggccuacuggaaacuaccaagaaagaucucgggauuggacacguugcgguggagaaccaucaccaugccacaaugcuugacgucgaucugcacccugcaucagcuuggaccuuguacgccguggccacuacaaucauaacgcccaugaugcgucauaccauugaaaacacuacagcaaauaucucucugaccgcuauugccaaccaggcggcuauccucaugggccuggacaaggguuggccaauaaguaaaauggauaucggggucccucuuuuagcccugggcugcuacagccaggugaauccgcucaccuugacagcagccguucugaugcuaguggcucacuaugcaauuaucggacccggccugcaagccaaggcgacuagagaggcucagaagaggacggccgcagggauuaugaaaaacccaaccguagacggaaucguggccauagaucucgacccugucguuuacgaugcuaaguucgaaaaacagcuuggccagauuaugcuguugauccuguguacaagccaaauccuccugaugcgcacuaccugggccuuaugcgaguccauuacacuugcaaccgguccccugacuacgcucugggaggggucuccaggaaaguuuuggaauacaaccaucgcugugucaauggccaacauauuccggggcagcuaucuagcgggugccggccuggcauuuuccuugaugaaaagucuagggggaggccgaagagggacuggagcucagggcgaaacccucggugagaaguggaagaggcagcuuaaucagcugucuaaaagcgaguucaacauuuacaagcgcucagggaucauggaggucgaccgguccgaagccaaagagggauugaagagaggcgagacaacucgucacgcagugaguagggguaccgcuaaacugcggugguucguagaacgcaaucucgugaagccugagggcaagguuauugacuuaggguguggacgaggcggguggagcuauuacugcgccggacugaaaaaggugacagaagucaaaggcuauacgaagggugggcccggacaugaggaaccgaucccaauggccaccuacggcuggaaccuugugaaacugcacucuggcaaggaugucuuuuucacuccucccgagaaaugugacacacuacucugcgauauaggggaguccucaccaaaucccaccaucgaagagggaagaacucugaggguguugaagaugguugaaccuuggcugcgggguaaccaauuuuguauuaagauccucaauccguacaugcccagcguaguggagacacuugagcagaugcagcgcaaacauggcgggaugcuggucagaaacccauuaucgagaaauucuacccacgaaauguauugggugaguugcggaacgggcaacauuguuuccgcggugaauaugaccagccgaaugcuguugaaccgguucacaauggcucaccguaagccuacuuacgagagagacgucgaucucggugcagggacccgccauguggccguagaacccgagguggcuaaccuggacaucauuggacagaggaucgaaaauauaaaacacgagcauaagucaacauggcacuaugaugaggacaacccuuacaaaacuugggccuaucauggcuccuacgaaguuaagccaucuggcagcgcaaguuccauggucaaugggguggugaagcuacuuaccaaacccugggaugucauuccuaugguuacacaaaucgccaugaccgacacuacgccauuuggacagcagcggguguucaaggagaaaguagauacaagaacccccaaggcuaaacgcgguacugcgcaaaucauggaagugaccgccagguggcuguggggcuuucucagccgaaacaagaagccgcggauuuguacaagagaggaguucacgaggaaaguccgcucuaaugcagcuauaggggccguguuuguugacgagaaccaguggaacucagcaaaggaggccguggaagacgagcguuucugggaucugguccagaaagaacgggaguugcacaagcagggaaaaugcgcuaccugcguguauaacaugaugggcaagagagaaaagaaacugggugaguuugggaaggccaaaggaaguagggcgaucugguacauguggcucggcgcacgcuuccuugaguuugaagcccugggcuucaugaaugaggaccacugguucucccgagaaaacagcuuaucugggguagagggagagggucugcauaaguugggcuacauucuccgggauaucucgaaaauuccugggggaaauauguaugcugacgauacugccggcugggacacaagaaucaccgaagaugaccugcaaaacgaggcaaagauaacugauaucauggaaccagagcacgcucuacuugccacaucaauuuuuaaacugaccuaccagaauaagguugugaggguccagcgccccgcuaagaacgguacagugauggacgugaucagcagacgggaucagaggggguccggacaagucggcacuuauggccucaauaccuucacgaacauggaagcccagcugauucgucagauggagagugaggggaucuuuuugccuucugaauuagagaccccaaaccuggcagaacgaguucucgacuggcuugagaaauacggaguggaacgccugaagagaauggcgauaagcggugaugacuguguagugaaacccauugacgaucgguucgccacagcucuagccgcacugaaugacaugggcaaggucaggaaagauaucccgcagugggagccuuccaagggguggaacgacuggcaacaggugcccuuuugcucacaucacuuccaccagcucaucaugaaggauggacgcgagauuguugugccauguagaaaucaggacgaauuggucggccgggcuagggugagucaaggugccggguggucucugcgagagacugcaugccuuggaaaaagcuaugcccagauguggcagcugauguacuuucaucguagagaucuccgcuuagcggcuaacgccauauguuccgcaguaccuguugacugggugcccaccucacggacaacuuggagcauccacgcccaucaccaauggaugaccacggaagauaugcugucugucuggaauaggguguggauugaggaaaacccauggauggaggacaagacacauguuuccaguuggggcgaugugcccuauuugggcaaaagagaggaccaguggugcgggagccugaucggacucaccgcucgcgccacuugggcaucgaauauucaggucgcuaucaaccaggugcggaggcuuauagguaaugaaaacuaccuggacuacaugacauccaugaagcgauucaaaaaugagggcgauccugaaggggcccuaugguga

SEQ ID NO: 14021 - RNA, 9879 nt, Artificial Sequence
  derived and/or modified CDS sequence (opt3) from DENV-1__EU482477__SS-prME
agcgugaccaugcugcucaugcuuaugcccacagcacuggcuuuccacuugacuacgagaggaggggaaccucauaugaucgucuccaagcaggaaagggggaaaucuuuacuguuuaagaccucagccgguguuaauaugugcacacuaauugccauggaccucggcgaacugugugaagauacuaugaccuacaaaugcccacggauuacagaagcggaaccggacgauguggacuguuggugcaaugcuaccgauacuuggguaacauaugggaccuguagucaaacgggagagcaccgccgagacaagcguagcguggcccuugcaccccaugucggccuggguuuggagacuagaaccgaaacauggauguccucugagggggccuggaaacagauccagaggguggaaacuugggcucuccggcacccuggauucaccguuauugcacuguuucuggcccaugcuaucggcacaucgauuacccagaagggcaucauauucauccucuuaaugcuggugacgccaucaauggccaugcgcugcgucgggauuggaagcagagauuuuguggagggucuuaguggcgcgacuuggguagacguuguguuggagcacggguccugugucacaaccauggcaaaggauaaacccacucuggacaucgaacuacucaagacagaggugaccaacccugccgugcugaggaaacuuugcauugaagcuaagaucucuaauacgaccacagauagccgguguccaacucaaggagaggccacccuggucgaagaacaagacgcaaacuucguuugccgccgaacauuuguggauagaggcugggguaauggguguggauuguucggcaaaggcucccucauaacuugcgcuaaguuuaagugcguaaccaaacuggaggggaagauugugcaguacgaaaacuuaaaauauucagucaucgugacaguucacaccggagaccagcaucaaguggguaaugagaguacugaacacggcacgacagccaccauuacuccccaggcgccuagcaccgagauccagcugacagacuacggggcccucacccuugauuguucuccaaggacuggacuggacuucaacgaaauggucuugcuaacaaugaaggagaaauccuggcuggugcauaagcagugguuucucgaucugccgcuucccuggacgucaggcgcaagcaccagucaagagacuuggaaucggcaggaccuguugguaacauucaaaaccgcucacgccaagaagcaggaaguugugguccucgguucucaagagggggcuaugcacacagcccugacuggcgcaaccgaaauccagacguccggaaccacaacuauuuuugccggccauuuaaaaugccgucugaagauggauaaacuaacccucaaggggaugagcuaugugauguguacaggaucguucaaacuggagaaggaagucgcugagacucagcacgguaccgugcuuguucagauaaaguacgagggcacggacgcgccuugcaaaaucccauucucuacacaagaugaaaagggggugacccagaacggacgcuugauuacugcaaaucccaucguaacagacaaagagaagccugucaacauagaagccgagccacccuuuggcgaguccuauauugugaucggugcuggggaaaaagcccugaagcucucaugguucaagaaaggcaguagcaucggaaagauguuugaggcaaccgccagaggcgcuaggcggauggccauucugggggauacugcaugggacuucggauccaucgguggcguuuuuaccucuguggggaaacuuguccaucagauuuucggaacagcguacggcgugcuguuuagcgguguaucauggacgaugaagauagggaucggcguguugcucaccuggcugggauuaaauagucgauccacuagccugucuaugacauguauugcuguuggccuagucacccucuaccugggggugauggugcaggccgauucaggaugcgucaucaacuggaaaggccgcgaacuuaagugugguagugggaucuucguuacaaaugaggugcacacuuggaccgaacaauauaaguuucaggcagacagcccgaaaagauuguccgccgcuauuggaaaggccugggaggagggcgugugcgguauaaggucugcaacgcggcuggaaaacaucauguggaaacagauuucgaacgagcucaaucauauccuguuagaaaacgacaugaaguucacaguagucgugggcgauguugcugggauucuggcccagggcaagaaaaugauccgcccucaacccauggaguacaaauauagcuggaaguccuggggcaaggcgaaaauaaucggggccgacgugcagaauaccacuuuuauuaucgauggaccaaacaccccugaaugucccgacgaucagagagcuuggaauauuugggaggucgaggacuacggcuucgguaucuuuacaacuaacauauggcuuaaguugagggauucauauacccaggugugcgaccaccgucucaugagugcagccauuaaagauucuaaggcuguucacgccgacaugggguacuggaucgaaagcgagaaaaaugaaacauggaagcuggcacgggcguccuucauugaggugaagacguguaucuggccaaaaucacauacccuauggagcaacggaguacuggaaucugagaugauaauccccaagauuuauggcgguccuaucucccaacacaauuaccgaccaggcuacuucacucagacagccgggccguggcaucucggaaaacuggagcuugauuuuaacuugugcgaaggcaccacugucgugguggacgagcacugcgggaauagaggacccagucugaggacaaccacggucacuggcaagauuauccacgaaugguguugccgcagcuguaccuuaccuccacuccgguucaaaggugaggaugggugcugguauggaauggagauaagacccguuaaggaaaaggaggaaaaccuggugaaaucuaugguauccgcuggcucaggugagguggacaguuuuagccuuggccuguuguguauuucgaucaugaucgaagaggucaugaggucccgcuggucucgaaagaugcucaugacagggacccuggccguguucuuucuacugauuaugggacagcucacuuggaaugaccugauccggcuuugcauuaugguuggcgcaaacgcuagcgaucguauggggaugggaacaaccuacuuggcccugauggcaacauucaaaaugagaccuauguuagccgugggccuccuguuuaggcgccuuacuucacgggagguccugcuacucaccauaggucugaguuugguggcuuccguugaacugccaaauucuuuagaggaacucggggacggacuggcgaugggcaucaugauucuuaagcuguugacggauuuccaaagccaucagcucugggccacacugcuaucccugaccuuuaucaaaacuaccuauucacuucacuacgcauggaagacaauggcuauggugcucagcauugucagucuguuccccuugugucugucuacuaccucccagaagacgacaugguuaccgguacuccugggcagccuugggugcaaaccucugaccauguuuuugaucgccgagaacaagauauggggaagaaaaucguggccacucaacgaagguaucauggccgugggcauuguuucaauccugcuaucuagucugcuuaagaaugacgugccccucgcugggccucugauugcaggaggcauguugaucgccuguuaugucauauccgguagcucugcggauuuaagccuggagaaagcugccgagguguccugggaagaggaagcagagcauucaggggccagucacaacauucucguagaagugcaggacgauggaacuaugaagaucaaagacgaggagagggaugacacacugaccauccuucugaaggcuacuuugcuagcagucagcggcguuuacccccugucuauuccagccacacucuucgugugguauuuuuggcaaaagaaaaagcagcgauccggcgugcugugggauaccccuucacccccagaagucgagcgcgcggugcuugacgaugggauauaccggaucaugcagagaggauuacuggguaggagucagguuggcguagggguguuccaagaaaaugucuuccauacgauguggcacgugacucguggagcuguucucauguaccagggcaaacgcuuggagccgagcugggccuccgugaagaaagaccugauuucuuauggugggggauggcggcuccagggcucguggaacaccggcgaggaaguccaggugaucgcaguagagccugggaagaaucccaagaacguccaaacagccccaggaaccuuuaaaacaagcgaaggugaggugggcgcuauugcccuggacuucaagcccgggacuucaggauccccuaucguuaauagagaaggcaaaauagugggucuuuacgggaacggagucgugaccacgaguggcacauauguuucugcaaucgcucaggccaaggcgagccaggagggcccacugcccgagauugaaaaugagguguuuaggaaacgaaacuugacuaucauggaucuacacccuggguccggaaagacccggcgcuaccugccggccauugucagagaagcaaucaagaggaaacuccggacauuaauacuggcuccaacccgagugguagccucagagauggcugaagcacuuaaggguaugcccauuagauaucaaacuaccgccgugaaaucugagcauacaggcaaggagaucguugaccugaugugccacgccacguucacuaugcgccucuugagcccugucagggugccaaauuacaacaugaucauuauggaugaagcucauuuuaccgaccccaguuccaucgcggcacguggguauauaagcacacgggugggaaugggcgaggccgcugccauuuucaugaccgcaacuccuccggguucugucgaagccuuuccccagucaaaugcuguaauccaggaugaggaaagagacauuccagagagguccuggaacaguggguacgaguggaucacagauuucccuggaaaaaccgugugguuuguucccagcauaaagucgggcaaugacauugcgaacugucugcgcaagaacggcaaacgagugauccagcucucuagaaagacguucgauacugaauaccagaagacaaagaauaacgacugggauuaugucgugaccaccgacaucuccgagaugggggccaauuuucgggcagacaggguuauugauccacgccguugccugaaaccugugauccuuaaggacggacccgaaagagucauucuagcugguccaaugccggugacuguagccagcgcagcccagcggaggggccgcauagggcgaaaccacaauaaggagggagaucaguacaucuauaugggccagccucugaacaaugacgaggaucaugcucacuggacagaagccaaaauguuguuagacaacauuaauacccccgaggguaucaucccagcgcuguucgaacccgagagagaaaagucagcagccauugauggggaguaccggcucaggggcgaggcucgcaaaacauucguggaacugaugagaaggggagaccuuccuguuuggcugaguuauaaggucgccucugagggcuuucaauacuccgaucggcguuggugcuucgacggggaacgcaacaaucaggugcucgaggaaaacauggauguggagauauggacuaaagagggagaacgaaagaaauugagaccaagguggcuggacgcucggacguauagcgauccccuagcacugcgcgaguuuaaggaguucgccgcugguagaaggucagucaguggcgaccucauccuugagauugggaagcugccucagcacuuaacccagcgggcccaaaaugcauuggacaaccugguuaugcuccauaauagcgaacagggaggccgagcguacagacacgccauggaggagcugccggauacaaucgaaacucuuaugcugcucgcuuugauugccgugcugaccggugggguaacauuauuuuuccuauccggccgcggacugggcaaaaccucuaucgggcuccuuugugugauggcaagcuccguccuguuguggauggcuucaguggagccacauuggauagccgcaucuaucauucuggaauuuuuccucaugguucugcuuauccccgagccugacaggcagcggacuccccaggauaaccaacucgccuacguggucauuggacuguuguuuaugauccugacgguagcugcgaacgagauggguuuacuagaaaccacaaagaaagaccugggcauagggcacguggccguugagaaucaccaucacgcagcuaugcucgauguggaccuucauccagccagugccuggacucuguaugcagucgcuaccacaauuaucaccccuaugaugcgucacacuauugaaaacacaacggccaauaucucguugaccgcgauagcuaaccaggccgcaauccugaugggacucgauaagggcuggcccauuagcaaaauggacaucggugugccacugcuugccuuagggugcuacucccaggucaauccucugacucucacagcugcaguguugaugcugguugcccauuaugcgauuaucggcccgggacuacaagcuaaggccaccagagaggcacagaagaggaccgccgcuggcauaaugaaaaaccccacaguggaugggauuguagccaucgaccuggauccaguggucuacgacgcaaaguucgaaaaacagcucggacagaucaugcuucugauuuuguguacuucucaaauccugcucaugcgcacgaccugggcucugugcgagucaauaacauuagccacuggcccucuuaccacacugugggaggguagccccgggaaguuuuggaauaccacuauugcgguuuccauggccaacaucuuccggggaaguuaucucgcaggcgcuggucuagccuuuucucugaugaagucauugggcgggggacgaagaggcacgggggcacagggagaaacacugggcgagaaguggaagaggcagcucaaucagcuuagcaaauccgaguucaacaccuacaagcgcagugguauuauggagguggaucggagcgaagcuaaagaggggcugaagagaggagagacuaccaaacacgccgucucucguggcacagccaaguugaggugguucguggaacggaaucugguaaagccagaggguaaagugaucgaccucggcugugggcgcggaggcugguccuauuacugcgcgggguuaaagaaaguuacugaagugaagggauacaccaaaggcgguccugggcacgaggaacccauaccgauggcuacauauggauggaaccuggucaaacuucauucaggcaaagacguguuuuucaucccaccugagaagugugauacgcugcuaugcgacauuggcgagagcucgcccaauccaaccaucgaagaggggcgaacucucagaguccugaagaugguggaacccugguugaggggaaaccaauuuuguauuaaaauccugaauccuuacaugccgucuguuguagagacacucgagcagaugcagcggaagcacgguggcaugcuugugcgcaacccccugaguagaaauuccacccaugaaauguauugggucagcugcgggacuggaaacauugugucagcaguuaacaugacauccaggauguuacugaaucgauucaccauggcccaccggaaaccaacguacgagcgugauguggacuugggcgcugguaccagacacgucgccguggaaccugagguagcaaaccucgauaucauagggcagcgcauugaaaauaucaagcaugagcacaaaucuacauggcauuaugacgaggauaaccccuacaagacuugggccuaucacggaagcuacgaagugaagccuaguggcuccgcuagcucuaugguuaauggcgucgugaaacugcuaaccaagccaugggacgugauccccauggucacacaaauugcgaugacugauaccacaccuuuugggcagcagaggguuuucaaagagaagguggacacccggacuccaaaagccaagagaggaacggcacaaauaauggaaguaacagcuaaguggcuuugggguuuucugucacgcaacaaaaagcccaggaucuguacccgagaggaguucacucggaaagugagaaguaaugccgcaauuggcgccgucuuuguggaugagaaccaguggaacuccgcuaaggaggccguugaagacgagagguucugggaccucgugcaucgcgaacgugagcugcacaaacaggggaagugcgcgaccugcgucuacaacaugaugggaaagcgggagaaaaaguugggcgaguuugguaaagcaaaggggagcagagccaucugguauauguggcugggagcuagguuccucgaguuugaagcccuuggcuucaugaaugaggaucacugguucucucgcgaaaacucgcugucaggcguggagggggagggauuacauaaacuggguuacauuuugcgagacaucagcaagauaccgggcgggaauauguaugcagaugacacagcuggaugggauacgcggaucaccgaagacgaucuccagaacgaggccaaaauuacugacaucauggaaccugagcacgcucugcuagccaaguccauuuuuaaacuuacauaccaaaauaaaguaguuagagugcagaggccagcaaagaacggcaccgucauggaugugaucagucgcagagaccagcgggguucuggacaggugggaacuuauggccugaacacauucaccaauauggaagcgcaacucauaaggcagauggagagcgagggcauauuuucccccucagaacuggagacaccuaacuuggccgggcgugucuuagauuggcuggaaaaacauggaguugagcgacucaagcgcauggcuaucaguggugacgauugugugguaaaaccaaucgacgacagauucgccacugcacuuaccgcucugaaugauaugggcaaggugcggaaggacauuccccagugggaaccgucuaaaggguggaacgauuggcagcaagucccuuuuugcagccaccacuuccaucagcuaauaaugaaggacggaagggagaucgugguucccugucgcaaucaggaugagcuggugggcagagcccgggucucccagggugcaggguggucacucagggaaacggccugcuugggaaaaagcuacgcgcaaauguggcagcugauguauuuucaccgacgugaccuuagacuggcugccaacgcaauuuguucugccgugccaguagauuggguuccuaccucccgcacaacuuggaguauccaugcucaccaucaguggaugaccacagaggacaugcucagcguguggaaucgggucuggauugaagagaaccccuggauggaagauaagacucacaucucguccuggggcgacgugccauacuuaggcaaaagggaggaucaauggugcgggucucugauaggauugaccgccagagcaacgugggcuacaaauauccagguugccauuaaccaggugcgccggcugaucgguaaugagaacuaccucgacuauaugaccucaaugaagagguucaagaaugaaagcgaccccgagggcgcgcuuugguga

SEQ ID NO: 14022 - RNA, 9879 nt, Artificial Sequence
  derived and/or modified CDS sequence (opt3) from DENV-1__EU482478__SS-prME
agcgugaccaugcugcucaugcuuaugcccacggcccuggcuuuccacuugacuacgagaggaggggaaccucauaugaucgucuccaagcaggaaagagggaaaucuuuacuguuuaagaccucagccgguguuaauaugugcacacuaauugccauggaccucggagagcugugugaagauacuaugaccuacaaaugcccacggauaacagagaccgaaccggacgauguggacuguuggugcaaugcgacugauacauggguaaccuaugggacguguagucaaacuggagagcaccgccgagacaagcguagcguggcucuugcaccccaugucggccuggguuuggagaccagaacagaaacuuggauguccucugagggggcauggaaacagauccagaggguggaaaccugggcccuccggcacccuggauucacaguuauugcucuguuucuggcacaugccaucggcaccucgauuacgcagaagggcaucauauucauccucuuaaugcuggugacuccaucaauggcuaugcgcugcgucgggauuggaagcagagauuuuguggagggucuuaguggcgccacauggguagacguuguguuggagcacggguccugugucaccacuauggcgaaggauaaacccacacuggacaucgaacuacucaagaccgaggugacgaacccugcagugcugaggaaacuuugcauugaagccaagaucucuaauaccacaacugauagccgguguccaacccaaggagaggcuacacuggucgaagaacaagacgccaacuucguuugccgccgaacuuuuguggauagaggcugggguaauggguguggauuguucggcaaaggcucccucauaaccugcgcaaaguuuaagugcguaacaaaacuggaggggaagauugugcaguacgaaaacuuaaaauauucagucaucgugaccguucacacuggagaccagcaucaaguggguaaugagaguacggaacacggcacaaccgcuacuauuacaccccaagccccuaccaccgagauccagcugacugacuacggggcgcucacacuugauuguagcccaaggacgggacuggacuucaacgaaauggucuugcuaaccaugaaggagaaaucuuggcuggugcauaagcagugguuucucgaucugccgcuucccuggacuuccggcgccucaacaagccaagagaccuggaaucggcaggaccuguugguaacauucaaaacugcacacgcuaagaagcaggaaguugugguccucgguagucaagagggggccaugcacaccgcucugacgggcgccaccgaaauccagacaucuggaacuaccacaauuuuugcaggccauuuaaaaugccgucugaagauggauaaacuaacucucaaggggauguccuaugugauguguaccggcagcuucaaacuggagaaggaagucgccgagacgcagcacgguacagugcuuguucagauaaaguacgagggcaccgacgcuccuugcaaaaucccauucuugacucaagaugaaaagggggugacacagaacggacgccugauuaccgcgaaucccaucguaacugacaaagagaagccugucaacauagaagcagagccacccuuuggcgagucguauauuaucaucggugccggggaaaaagcucucaagcugucuugguucaagaaaggcuccucaauuggaaagauguuugaggccaccgcaagaggcgccaggcggauggcuauccuuggggauacagccugggacuucggaaguauugguggcguguuuacgagcguugggaaacuggugcaucagauauucggaaccgcauacggcgucuuguuuuccggugugucuuggacuaugaagaucgggauuggcguacuccugacaugguuaggacugaauagccgaucaaccagucuauccaugacauguaucgcggugggccucguuacucuguaccuuggggucauggugcaggcugauagcggaugcgugaucaacuggaaaggccgcgaauugaagugugguucugggauuuucgucaccaaugagguucacacguggacagaacaauauaaguuucaggccgacucaccgaaaagacugagugcagccauaggaaaggcuugggaggagggcgugugcgguaucaggagcgccacccggcucgaaaacauuauguggaaacagaucuccaacgagcugaaucauauuuuacuggaaaacgacaugaaguucacugugguagucggcgauguggcagggauccuugcucagggcaagaagaugauacgcccucaacccauggaguacaaauauucuuggaagucguggggcaaggccaaaaucauuggggcggacguucagaauaccacauuuaucauugauggaccaaacacuccugaaugucccgacgaucagagagccuggaauaucugggagguggaggacuacggcuucgguauauuuaccacaaacauuugguugaagcucagggauagccacacgcaggucugcgaccaccgucugauguccgcugcaaucaaagauucaaaggccgugcaugcugacaugggguauuggauugaaagugagaaaaaugaaaccuggaagcuagcccgggcaucuuucaucgagguuaagacuuguauauggccaaaaagccacacacugugguccaacggagugcucgaaucagagaugaucauucccaagaucuacggcgguccuauuagccaacauaauuaucgaccaggcuacuucacccagacugcggggccguggcaccugggaaaacuugaguuggauuuugaccugugcgaaggcacaaccguagucguggaugagcacugcgggaacagaggacccucuuuaaggacgacuaccgugacaggcaagaucauacaugaaugguguugccgcuccuguacccucccuccacugcgguucagaggugaggacgggugcugguacggaauggagauuaggcccgucaaagaaaaggaggaaaaucuuguuaagaguauggugagcgccggcucuggugagguagacuccuuuucacugggcuugcucuguaucaguaucaugauugaagaggugaugcgcagccgauggucgcggaaaaugcugaugacugggacacuagcugucuucuuucugcucaucaugggacagcugaccuggaacgaucuuauucguuugugcauaauggugggcgccaaugcauccgacagaauggggaugggaacaacuuaucuggcuuuaauggccaccuucaagaugaggccuauguuugcaguuggccuccuguuccgccggcuuacgucuagagaggugcugcuacucacaaucggucugagcuuggucgccucaguggaacugccaaacaguuuagaggaacucggggauggacuggcuaugggcauuaugauccuuaaacuguugaccgacuuucaaucccaccagcucugggcgacucugcuaucucugaccuucauuaagacaacuuuuagccuucauuacgccuggaaaaccauggcaaugguucucuccaucgugucacuguuccccuugugucugagcacgacaagucagaagaccacuugguuaccgguccuccugggcucucuugggugcaagccucugacaauguuuuugauagcugagaauaaaaucuggggaaggcgauccuggccacucaacgaagguauuauggccguaggcaucgugagcauucugcuaucgucacugcuuaagaacgauguuccccucgccgggccucugaucgcuggaggcauguugauagcauguuaugugauuucugguaguuccgccgacuuaagccuggagaaagcggcugaggucucuugggaagaggaagccgagcacagcggggcaucccauaauauccucguggaaguacaggaugacggaaccaugaagaucaaagaugaggagcgcgacgauacucugacaauucuucugaaggccaccuugcuagcugugucaggcgucuacccccugaguauaccagcaacacucuucguuugguauuucuggcagaagaagaagcagcggagcggcgugcugugggacacuccuucucccccagaaguggagagagccguccuugaugacgggaucuacaggauuaugcagcguggauuacugggucgcucccaggugggcguugggguauuucaagaaaacguguuccacaccauguggcacgucacacggggagcggugcucauguaucagggcaaaagauuggagccgucaugggcuaguguuaagaaagaccugaucagcuacggugggggauggaggcuccagggcuccuggaauaccggcgaggaagugcaggucauugccguggagccugggaagaaccccaaaaauguacaaacagcaccaggaacuuuuaagacccccgaaggugaggucggcgccaucgcucuggauuucaagccugggacgucuggaucgccaauagugaaccgagaaggcaaaaucguuggucuuuacgggaauggaguggucacaacuagcggcaccuaugugucagccauugcacaggcuaaggccucccaggagggcccccugccugagaucgaagacgagguuuuucggaaacgcaacuugacaauuauggaucuacauccggggaguggaaagaccagaagguaccugccagcgaucgugcgggaagccauaaaacgaaagcucagaacuuuaauucuggcacccacccgcgucguggcuucugagauggccgaagcucuuaaggguaugccuaucagguaucaaacaacggcaguaaaaagcgagcacacuggcaaggagaucguggaccugaugugccaugccaccuucacaaugcgucucuuguccccaguucggguccccaauuacaacaugauuaucauggaugaagcccacuuuaccgacccuucaucuauagcugcgagaggguauauuagcacuagggugggaaugggcgaggcagccgcuaucuucaugacagccaccccgcccgguaguguggaagcauuuccacaguccaaugccgucauucaggaugaggaacgcgacaucccugagcgaagcuggaacucuggguacgaguggauaacggauuuccccggaaaaacuguaugguuugugccaucaauuaaguccggcaaugacaucgcuaacugucugaggaaaaauggcaagcggguuauccagcucaguaggaagacauucgauaccgaauaucagaaaaccaagaacaacgacugggacuacguggucacuacagauauuagcgagaugggggcgaauuuccgcgccgaccgugugaucgauccuagacggugccugaaacccguuauucuuaaggacggaccagaaagggugauacuagcagguccgaugccugucaccguggcuucggccgcacagcgccgaggcagaaucgggcggaaccauaauaaagagggagaucaguacauuuauaugggccagccccugaacaaugacgaggaucacgcccacuggacagaagcuaagauguuguuagacaacaucaauacuccagaggguaucauucccgcccuguuugaaccugagagggaaaagucugcggcaauagauggggaguaccgccucagaggcgaggccaggaaaacguucguagaacugaugcggcguggagaccuuccaguguggcuguccuauaagguugcuagcgagggcuuucaauacucagaucgccgauggugcuucgacggggaaagaaacaaucagguccucgaggaaaacauggauguggagaucuggaccaaagagggagaaaggaagaaauugcggccccgcuggcuggacgccagaacauauagugacccucuagcucugagggaguuuaaggaguucgcagccggucggcgaucuguguccggcgaucucauucuugagaucgggaaacugccgcagcauuuaacucagagagcucaaaaugccuuggacaaccuggucaugcuccacaauagcgaacagggaggccgcgcauacaggcaugcgauggaggagcugccagauaccauugaaacacuuaugcugcucgccuugaucgcuguucugaccgguggggugacuuuauuuuuccuaucaggccggggacugggcaagacgaguauagggcuccuuuguguaauggccagcuccgugcuguuguggauggcaucugucgagccccacuggaucgcugccagcauuauccuggaauuuuuccucauggugcugcuuauuccugagcccgaccgucagagaaccccacaggauaaccaacucgcauauguugugaucggacuguuguuuaugauacugacagucgccgcuaaugagauggguuuacuagaaacuaccaagaaagaccugggcauugggcacguagcgguggagaaccaucaccaugccgcaaugcucgauguugaccuucacccugcuuccgccuggacacuguacgccguggcaaccacuaucauuacacccaugaugaggcauacgaucgaaaacaccacugcuaauauaucauugacagccaucgcgaaccaggcugccauucugaugggacucgauaagggcuggccaaucucuaaaauggacauuggugucccucugcuugcauuagggugcuacagucaggugaauccgcugacccucaccgccgcugucuugaugcugguggcacacuaugccaucauaggccccggacuacaagcgaaggcuacacgcgaggcccagaaacggacugcagccggcauuaugaagaacccaacgguugaugggaucguggcuaucgaccuggauccuguaguguacgacgccaaguucgaaaaacagcucggacagauuaugcuucugaucuuguguaccucgcaaauacugcucaugcgaacaacuugggcacugugcgagagcauuaccuuagcuacaggcccccuuaccacucugugggaggguuccccagggaaguuuuggaauacgacaaucgccgucucuauggcgaacauuuucagaggaucauaucucgccggcgcaggucuagcuuucagccugaugaaauccuugggcgggggaaggcgcggcaccggggcccagggagaaacucugggcgagaaguggaaacggcagcucaaucagcuuaguaagucugaauuuaacaccuacaagagaagcgguaucauggagguugaccguucagaagcaaaagaggggcugaagaggggagagacaacuaaacacgcugugucccggggcaccgccaaguugcgcugguucgucgaacgaaaucuggugaaaccugaggguaagguaauagaucucggcugugggagaggaggcuggaguuauuacugcgccggguuaaagaaagugacagaaguuaagggauauacgaaaggcggucccgggcaugaggaaccgaucccaauggcgaccuacggauggaaccuggugaaacuucacagcggcaaagacgucuuuuucauuccucccgagaagugugauacucugcuaugcgacaucggcgagucuuccccaaaucccacaauugaagaggggaggacccuccgggugcugaaaauggucgaaccuugguugcgcggaaaccaauuuuguaucaagauucugaauccguacaugcccucagugguugagacucucgagcagaugcagagaaagcaugguggcaugcuuguaaggaacccacugagccgaaauucgacacacgaaauguauugggugucuugcgggaccggaaacaucgucagugcugugaauaugacgucccggauguuacugaaccguuucaccauggcacacagaaaaccuacauacgagcgcgauguugacuugggcgccgguacuaggcauguggcugucgaacccgagauagccaaccucgauauuaucgggcagcggaucgaaaauauuaagcacgagcauaaaagcaccuggcacuaugacgaggauaacccuuacaagacaugggcauaucauggaucauacgaagugaaaccauccggcucugccagcaguaugguaaauggcgugguuaagcugcuaacuaagcccugggacgucauaccuauggugacccaaaucgcuaugacagauaccacuccauuugggcagcagagaguguucaaagagaaggucgacacgcgcacacccaaagcgaagaggggaaccgcccaaauuauggaaguuacugcaaaauggcuuugggguuuucugucccgaaacaagaagccgcggaucuguaccagagaggaguucacaaggaaagugcgcagcaaugcugccauuggcgcaguauuuguggacgagaaccaguggaacucugccaaggaggcugucgaagaugagcguuucugggaccucgugcaccgggaaagagagcugcacaaacaggggaagugcgccacgugcguuuauaacaugaugggaaaaagggaaaagaaguugggcgaguuugguaaagcgaaggggucacgcgcaaucugguacauguggcugggagcccgauuccucgaguucgaagcucuuggcuuuaugaaugaggaucauugguucagucgggaaaacucccugagcggcguggagggggagggauuacacaaacuggguuacauauugagagacaucucuaagauuccuggcgggaauauguaugccgaugacaccgcaggaugggauacuaggaucacagaagacgaucuccagaacgaggcucgcauuaccgacaucauggaaccagagcaugcccugcuagcuaaaucgauauuuaaacuuacuuaccaaaauaaagucgugagaguacagcggcccgccaagaacggcacaguuauggaugugauuucaaggcgugaccagcgagguagcgggcaggucggaaccuauggccugaauacauucacuaacauggaagcacaacucauccgccagauggaguccgagggcaucuuuaguccuucugaacuggagaccccaaacuuggcggaaagaguguuagauuggcuggagaaguacgggguggaacggcucaaaaggauggccauuagcggagacgacugugucguuaagcccauagaugaccgcuucgcuacggcccuuaccgcacugaaugauauggguaaagugagaaaggacaucccgcagugggagccuuccaaaggcuggaacgauuggcagcaaguacccuuuugcucacaccacuuccaucagcuaauuaugaaggacgggcgggagaucguggucccauguaggaaucaggaugaacuggugggacgagcucguguuagucagggcgccgguuggucucucagagagacagcaugcuugggaaagagcuaugcccaaauguggcagcugauguacuuucaccgccgggaccuuaggcuggcggcuaacgccauuuguuccgcagugccugucgauuggauccccacuucaagaaccacauggagcauacaugcccaccaucaguggaugacuaccgaagacaugcucucuguguggaaucgcguauggaucgaggaaaacccauggauggaggauaaaacgcacauuuccaguuggggagacguucccuauuuaggcaagcgggaggaccaauggugcggcagccugaucggguugacagcuagggccaccugggcaacuaauauucagguggcuaucaaccagguccgaagacugauuggaaaugaaaacuaccucgauuacaugacaucgaugaaacgguucaagaaugagggugacccugaaggcgcccuuugguga
